United States Patent 6,812,339 (POLYMORPHISMS IN KNOWN GENES ASSOCIATED WITH HUMAN DISEASE, METHODS OF DETECTION AND USES THEREOF) - sequence listing, part 71

SEQ ID NO: 16674 - DNA, 126237 bp, Human
agttgggagtgaattactacttgaccttgggtacatgataaccttgactgtagagtccatgcttttcctgagtagttcttcagagtccttcctgccagtgacttggttctaggtgtggagcaggagctggctgtcggaggactcattgaattcagtggaaacagcagggagcatggttttcttttgaatggaaaccatgagtgtagcagttcttctttatgacttgctacataatcatgcaggaaaatgcctgtcacgggattggatcctaggagattagccccattgctaattaaaagccccattaaaagaggggaagttcttttaggtatctacagcttcctaagatttgaatggtttacaaagcagaatgttggctgggcatggtggctcatgcctgtatcccagcactttgggaggccaaggcagacagatcagaaggtcaggagtttgataccagcctgaccaacatggtgaaacctcgtctatactaaaaatacaaaaattatccgggcatggtggcatgcgcctgtaatcccagctactagggaggctggggcaggagaatcccttggacctgggaggcggaggttgcagtgagccgagacggcgccattgcactccagcctgggtgacagagtgagactacgtctcaaaaaaaaaaaaaaaacgaaaaaggtagaatgatggctgggcgcggtggctcacgcctgtaatcccagcactttgggaggcccaggccagtggatcacttgaggtcagaagttcaagaccagcctgaccaacgtggtgaaaccccatctctactaaaaatacaaaaattagccaggtgtggtggcaggcgcctgtagtcccagctattcaggaggccgaggcaggagaattgcctgaactcaggaggcggagcttgcagtgagccgagatcgcgccattgcactccagcctgggtgacagagtgagactctttctcccaaaaaaaaaaaaaaaaaaaaagtcaaatgcagctgggaatgtggttcgtgcctttttgtatattaaccatttgaaacttggttgtaaggtggggttggcaatgtcaggcctggctgcagcagctcatgtctttagagtgtgcctcttccctctctcgtggggctcgagcaagactaccttcatacatgggctctccagttacatagcaactccagtgttaaattccatcttttcttcctggaaaagccgtagaaaggacacctggacatgcctgctgcacaggttgtctgccttccccatcagccgcagaaggaggaactttgctctcttctctcacagctgtgtgtgcataggaggtagttcggatgatgtgggtcccaccatgtattccttctctgttccatgtagagtaaaataaatgggagttctgtttaatgcatcacctcggttcatattgcatttgccaagaaagtgcaattttattgaacattaggattgaattcttaactgagtaatcaatttcagtagtaagttaaaatgccttctattaatggacaactgcaaccgttaatcagagttacagtagattaacagttgtcagcatttatgctaatagcacttataaaccgtgggctcatgatttgcactttataattccatatttctcaaaacagttggtaatactttttgcttgaaggtattgattcttttgtccctttgcttgctacttggagatgtagagaaagctaaatgacattttcacggtgatgacacaatatcaccttctgcttttgcacacttggctttgtgtcaaaatagatggaaagggttcatttgttctggtgctctactgtttaatttgatctggtgtgtgactaaagcaagacaaatagtatttttaatgaaaccatttaataacctctggtagcttagagtcgaaggcattggaaaaatgcaattaaaggatgcctagatgtaaacaaaaaaaaaaaatctctacttcatcttcactgactccattcattttgctttcagggtttcatcaccttaaatggttttgaaccaatgaaggtgtattcccttaaaaagacggacagcccatcgtgtgaactatagagtttgtggacagatttatattggtgagttattgtgaaatatctccaggtaaaagttcagttttctagaatcccctttgcaatgtgtgttcaattagttgatgagtatggattgcctgcagcctctggctgtttcattgggatgtctaatcgtgggatcatattgattgtctttcaattaattgcatctagtattttcatttatcaaaagcaaaatacatgtaattaactctgaagcaatatagttcagtgtaaagtgatttttgctgctgctgctgctatagagataagtcaacggaaattatgctacaaggaaactcaagtcagaatggaaatagtgttaggatttctcgatgtattaattaaaaagaataaaaatgaattagagaaaccatctcatgacaccccgagtcagtcataagtgatagatggatgtctttaggaagaaggcggcttgtggatactggcacctcttcagtcagcttaggcttttagtgttaccagcctctaggatgtcttgaacataccatgatttttctggcggagtagattgggaatgtgggtgcaggctgagatgagcattcaatccctaccacactcattgatggatggagttcaatcctgtgcccgtagcagggttttgggattctaagtttcatttcggcatgtctttagccatttttcacaaaacctggatctttcttaaagtctcaaagtggcaacttctctgatggaattgattttaatcttgctttttaaaaaaaaatgttttccccgtgaggtaacaacatcattcaaaagcaagggaaaccgctagccaattgtgtcctgtctctctcacctgtcacactcctagcagagccttgaggggactagctttggttcccagagaggtttaagtttgtgaccaggccctcaggcctggcttcctgagttgctggaggcagttagagacttggagcccaggggcacacatgggtgaccacctgagggggccaagctgaatctctgcctgaacctaagcagcacagtgggttgtaggatcaggaaaggatctctgtgtgtcccttccttttctccataaagtagatctagctggggaaactgaggtagctgacccagacctagacctccaaatattgcttaccagcttggtgactgagcaagtggtctctgctggcactcggaagccttatctgtgaatcgaacaggtggattgggctggtacccaggaccctccccaccctttaagcttgaatttgatgtagaaattcagaaccctttcctgggagtgctctgacagggctttgctgggccaaaggccatagcagagcgtgaagctcgagttgagttgtgtatgagaggggcccctcagtcatctttgaacacttaaggctcttagcattgaggaggatgaggaactggaagtctgatggaatgttctttggtggaaacctgagggaggtcaggaccgccactcgcaaccttattcagttcagcctttcaggacaaacgttgcttacttttctggctctcactctcagacctgtgtgctagaatctgcccgggtttctcaggcagagacaaagtcaccttgggcctggggttggcaaagatagttccagtgttgggtgctgggtccaaagatgttttcagtgggttgggtcatggtgatgtttccagttggacaccatggaactggccatgttggacatccacgctctttcacccagacaagtaccaggccctgcctgcctgggagcatctccgctggatggaccatcattacgtttcatagatgctcatttcagtgttggaaatcattttctctaaacagaaggatgtgggaacttggtgtataaggatgaaatggactttttaaatatcaaaaatggttgaatgaggacactttcatttgactcagtctaataaccagagccactctgggatcctgtttagcagtgatctccctctcagacagatgagttaacattctccaaatgcatccagaaccagaatgaaattgtgacacgcttcctgttaacaaatgtttcctgagtgctgagcagactcaagacacttacccttatgtggggttcccaccattcctgtatttttggcatccttttgggtaagagttttttatagcactttggaagagcttaagagacttggtgtggtactggagctggccatcactggagcatggtcactgtgctgtgacaacagctcatggtgtccacggcccacgcacacactgagtgtggccccactggcccacctgctccccgcccagcccaccccagaagcaggataaaacttctcccctgaccacttgcagatgctctcatggtggaattctcacatggccccagaaggcgtgtgtttgctctcagaccctttctgctctgtggaacgtcaccatgcccagggagttgtatccagctctgcctgctgtctacatgcagcaacacaaggaggtcatgtgggattgtaaccaaagtaaggaccacgtatggatttcaaccagagcccacctgttgagatctctggtctagacacatcttttaaaatgtgggcagagaagaaggaggtagatgaaaatcacgtgacaccatcagaggtaatggtgaatccgtgaggccctagagccatttatacatcgtttttgccctcttagtattttctttagcatgtcctaattttaaaagcatcccattcctgttgtgctagacttaatattttggtttatggccgtcttttttagtaacttgacgtcaaacacttcagccttctcctgacaagaggctcgttctctcagtaatgaatagtgacgtgctaaatttagatcggatgcatgttctgcttttactatctgttctgtatgttgctatttgtcagaatgaaagctcaacgtgccagatggctttgctggcttctcctggaaaaagacttcgttctccatcacttcagttgggtcatggttttttagtactattttgttgttaagcattaatatttgcagcagtacccaattatctttttttaacaaaagtgtcacagaaaaagtgtttttggttaaatgctcataaatgagggggaatgcaaatcaaatcccttaacttttattatattacgtaaaatggtggtagaatagttgcagctgtggttttgcaaagataggactgtttccggctgccatgcatgctgtattatgtattttgacagatctccaggatgatgtagaagcttggcctgccgaccagggcctctgggaaagacagtctgaggtgacacagtgctggaaactcagtgtgcttggtggtggaagaggggtttgccttgatctgctgtgggaactaggctggatttccatctgagttgtggctgtagcaggccacctagttgaggtcatcttcctgatcattggtcctctagcctgcttctggcaggacagatatcttttttccatgaaaaacagaaggaaagtattgaattactctggaaacacatacctaaaccttggggtccgattgtcaatggttgtgaagtggtggaggtgttgcgccatggccactgtgccactctggtcccagtgtgtggcccccagagtccttcgggcccttggcctcctgagctcctggcctgcatgcatccgtggggcctttgctagggccgtgtgatcctgctccagtgtttgggccagaagcaagactgccaacatccgaaaccacaaaccagaggaagatccacagggcctttcatctctggggttctctaggtgagaaacagtcaggaggctgagatggggcagtggggaagatgccagcgaagctttagccagccttcggagtaggggaggaggggcccccgctgaagctcttggttcttgcttggattttattcctgtgccttctggatgtgagttatgcttcggaatcccagcctccctccaccccccaaggataaatgggaggcattgattcagtgtttgttcttctctcctgagcatctcagcaacctagtgtggcctcccaagtagggatggagagatcaccccgtccattccccttctttttgctttagcatctacatgggtccagggtcacacaggggtcacgccctccattctcctggtgagtctggctttctgctgttactgttgttttccgcttcctgcgccaccctggctgctggttctcatcagagtggatttgcaaagtagggaggaagagaccaggcagaaggcctgaattttcccactgtgacccatgtgtcaacactgtgtggccggcctgggtgggttcctgctgagttgctccttcgctggaggggtacctccgagcagggcatctgcaggatggtgggcacacttgcctctcactcttggcggggccaggagtctctgttgccactgagtgacgttatgctgggaaatggaggcgtggtgtccgcttctctttccgtgatcctcatacccttcccaagacccccattttgttagtgaagaacttgacgcccagatccacctgccagcatgtgtggccttaggtatatctggcattcaggagccgatgaagcaaccccaaactcaggtcgccccgcgtcccttgctggtggaagcctttccggaaacactgtggtagtgagcctggcttcccatacactgcagggtccctttacagtgaagatggcttcccgggggctttgatattcctggaagctttctcaggtttgtcatggtaccgtccccacacccagggttgtgggaggaagagcacttggtccatgtgaagtggggccgcacatggggtgcatctttccgctgagagtgtggcagtgtgcagagaatgggcctctgctacccctcatcagccaaccctggtggagacccccttgtgccctagacaggcctggccactgaactgagggatggcagccctgttgtgtgggacagccagagacacgggtcagcggctgatttctctgaggcttggagcgtgtgtttgttaaaggcaagaagagtgggaaggagtggatggagtgagcggcagggccagagcctcacttgttgaagggagtggtggtgcattgtgtttactgtcaagtttcaggctggggcgtagatgccgatgtgcaaatgagtaggcagggaagtgagctttctcttattaaaatgttggcttactaatcaagtgttgctgggtgtgattagtggcagaggaaaaggttatttctttctgtaaatatttttgcttaacatttatgcgttaccattgctgattgtattaatactcttagaatgcattagaccaataacttgtttttttttaaaaaaatgtcttggttttaagcagtttcagttggtctttatggaaggacacacagcatttcactgaagcttgagggatctgccaggttcaagtgtaaaggggcattagtttcaacttagagcagctcccccagctacaaatgctgataaaatagctcagaagtgcaagagcctggttactttcagtaattttaggatttagtatctggatctgaattttgaccattgttgaaggagcagataattggatgcattttctaaagtaatgatttaggccaaggagggcagatcctttgagcccaggagtttgagaccagcctgggcaacatagcaagaccccatctctataaaaaaatttttttaaaaaatcagccaggtggtggtgtgtatctgtggtcctcaggttccagagtagctgggtgggaggattgtgtgagcctgggaggtcaaggctgcagtaagccatgattgcaccactgcactcagccttgggtgacagagggagaccccatctccagaaaatgtttttaaaactcggccaggtggcggcgcctgcctatgcctgggtggccagattgtgtgagcctgggagctcacgtctgcagtgcactgtgatcacacccctctacttagcctgagtgacagaggcagaccctgtctcaaataaattaataaataaataaaagtaacgatttaggaaatggctgagaattcccatgaccctcgtgtcctcgggcctggtgttttcacaggggtgggggcgggagaaggggagaaagaaggacgtgctgtctgtggcttccttcttcccaggcattcatttaacaccagctgaacacatttgctttattgattggttgattcatttatttttggcaaacttggcaacttccacctggccccatgctgttaaaaataaagtcttcttggtcgactgaatgcttttgcaattcattctttccatgtagcaattaagatgattcccctagccttgtaccagttaaggataaataggaggttttcaaagaaaatgctgcgtaattcatcggcatttgtgtgtgagcacacgggtaatacatgcgagtagcctccgtgagtggactcctgtgtaaggaggtaaaatggaacgtttttctgcacttatcctgagaagcagcccgaacagtgacatttatacatatttcataatgtggtttcttcaggcacgcggagcaaacaaatcaatttctcagcagtatactgtttaaaagaaacagcaacaacctgtggggaagttgcagaagctgttaaaattaattatatatggcaaaaagatagaacattagggggaaatgttaatgtgggaggatgaaaaaacacagccgtggatgagcagcagtgcagagcatctgatgacagtgtttaatttccgtttctttataaatgtatactgatgaacaacaatggcgcccgcacagggtcctcctgttccgtcctttctccaggccgctgggatcgaatgtccccgtgagcatccagtcagctccacgtggtgtgagccttgatttctgggaacggtaccgtgctgtcttttaatagggatttgtggaaaacgagaattggtggtgaaggtatcgaattcctgagccttgtaatgcaacacctttcccgtggtcaccttccctcttccggttcagctatacgttgtttaactcaaaggaaacctttgttgtcgtgggtagggtgtaacctgcaactccttgaaaaattcagcttgggtgatcagtttcctcagggatgtagggggagaggctcttcagcaggggtgggagggtgcttacaggagggtcccagagctgtgggacaggcttgccccctttcctgggggaagctcgcctctttcccggacactgcaggtttgtaggatataccccttggttcagctggtcatggcaagtgagtcctccctatcacccacttccgcggtggtgggacgcctggggggcatggatggggcctgcgtcctaggagaccttggctccagctgctcgaggccactttgtctcttctgcatgtcgcagaagcgtctgtacctcctggggttggctttcctgtgagcatttgggctccctctgcctgggtggcctgttgtctggagggagtcttcagtccctcttagtgcagcagccaagggtgtctcttctcactccctgagccttctgattcctgtatcaggggaagttaaaaagtgttgtaaatggacttggaccaaggagcaggactctgactacgaacttagaaccttccagagtgatttccgcagctccctgaagcagagctagctccttgagctcattgtccccttaattctgtgcatggcctgcatattgtagatgccccagaagtaattttttgaatgaatgaatccaggctgcagtggggccaggggggtgtggagtgggctgggcacatgtaggagcgcatcgcagcagctgtctggaaggctgggttggttctgtgttagctgggagtgttttctgcagacagaaggcaacccagcatgttatactacctgttcaggggaggtgtgcatgttctgagataatcacgccgtgttcttgagctttccaccgcagggaagtgaagtcatgcccccgcctctcctttgtgcaagtagggcggggagtctaaacccatgcaggtagggtgtggggacccagctgtactctcccgccacctgtgggtgctgctcttgcggcagcctcgtaggtgagggataatgtggttcagccaacctgactacatccaagctgggatgatgaggacagcaagaaggcccactggctctgcaagtcctgtaggcctgggtccctcgagacaaagctcagatggcttctgtatcaaattcaaggacccagcatggtggctgctgctttgctcaccttcagaggcctggaagctggtgtttcctgcatgtgtaactgacggccccagtcccacatttgttaaaaaaaaccttcactttgatgagagtacagtactcctggctttttgtaattcaattgaaactcactgccactccctcattacagcagaagatgacctctaaaccatgacacagggcgacagcttcctctgggaaggaggactcaacattgatttgtgctctgatccccacccccctgcaaaccctgggcttaagtggcagcactgcagaggcctgctgaaggccggaaagccctctctgcctgtgtgtttaaacagagcagattgatgcagagtttgatgtggccaggaagaattctttagcatggaattgcatcataacagtcactccctccaggagccccagcggctctggcacttcctcctgatgtttgcaaggggaaggtaatgattctaattgcacaggacttggtcctggccttggtgatggcaggagggcagagtcctcatggtatggccaaaaaatgtttacaacttgaccttgtcctcctctgatggtgttgaccttggacaaactatgcccctctgagcctagtgcctcagtttccccctcttgcaaatgcagcaggtagtagtgcttaatctcagagttgtggggattcaatgaaacagtactgaacggggcttaacagatacctggtacatgttaagagcttagtcaagaatgactgctgagtctggaatgacattatggggactgacgagggaggctgatgagaggtggcttggtgggtacaatgtgcattgtttcagcgatcgaggcactgaaggccctgacttcaccacaatgcaatgtatggatgtagaaaattgcacttgtaccccatgaatatatgtacacacacaaagatgattgctgcagtagcagcagtaaatgcacacagccaaaggcttagcatgtgggagatgccctgctcgcctggctgggctagaggggaaggtagtacaggttgcatctctccaagccggtacctgtggtctatgttgcaatgaacatttcgatgcaagacgaacggaactcaaacctttcttggtcgtgaaggtctgctgtgttcctgaaggttctgtcttccacctggcacttgggatgtgggttgctcactccttgcccatcgacctggtaataatgttttcctatcaagcagtgaaaggtttggggtttccatgaagcctttcccaaatgtcacgcattggggttttagttgtgagggtgtgctgatcccagccgcagccaaggcgaggtgctggcaccatgctgctgcacccgctcctatgcccacctggacatctgtttcgtaatggacatccttccctgggaacatgtctctactcctttaaatggcttgaggtctctgcaatttgcctgaacattaagtgtgaccaaagagcctgaggccagccatggagaggacgaagacatgaggctttctctcgagagccacactgggagaggccgggaacacggccacttcacatgaaaggcggttagattcaggtcactgggtctggactcctgcattttatggcaaagtctaaaaatgccgatttgtaacaaccaatgttaatgaattcagactgtttgaatttcacactgaataatggctggaattatcagagcccacagcttataagatccctggatcgtgtaatcttttctcaagatttaattgatagaatgatgtaatatcacattacttttattaaaagttctggccataaaagagaaacacctattaggatagaagaatttagtaaaaatagtagtaataacaagacagtttggaatatgtcatatattcagtaaatttcaaaagtcttcatctcatttaaaatacagtattgtgcccatagatcctgaatgcaatacctttgtaccctagggcttcctctttcctacactaaaaacattctatttaaatgcagattttgatttgcaatctaggaagaggattctggaagaatgggaagaaggacaactctgcatctattaattttagttttatgttattcgcgtttttcctctcatccttatctcctccagcccttccttcctgtaaaaggatcctttctaaacatacaaataaagacatgcttagaatttcagcacataagaatgttgttacgccttcttttatttttgtttaaaaattaaattaaaaaattttttttccaaaaatgtttgttcctttgatttgtgtacgtgtgtgcacgtgtatttgcccctgggttgtagccttgtcttgcttttccacacatgctcccagtatcttacctaggaaatgagcggaacagtggaattaccaagtgcagatggtagaacttcccttaccagagcccaagtgacttgtgtgatattgagctttggttactaaataaatggatttctggcttttgacattgtactctgagaattgggtggccaatcatcaaataccatttttttcactgttgtctgcatttaatacagcatcttctgccatacgcacttgtcaattcaaacatgagcgttacattttggtctttatgatctgtcaagggaaaatggaagtaaattctttataatatgctaattgatgtatttgggaatttttagatgtagacaacatctgtgcatgccgttaacacagttaatagctcccgttcttcaatatgagaaggttttcagagtctatgtgtgatctagatgagaccttctgtgtccgcccccccaggacttggcagtgtcaaatttaaggctgttttttctggtgccttaggactgaatctgagcctgcgcaaagtcctgttttgaggatgcttctggccacagtgtgctgggattgtgttggttctgggaagagcctggctggccagacctggtcttatctatcacccccatccctactccgtcctagcctggaccagactggctggagtgatgggtccagagaaagagaccgtggacctgaacagtccttgggacccttctgccactcttggaggtgccacctcccctggtagcttggcaccatttgggttctcctttagccatgggtttttgacaactcaagagcttattttccatacaaacttgctgatggttttctaaggcaggaagcattgctttattgagagtgaggaattgtaccctttgaaagctgccccctgaaaagggagtggagagagatggctccagttggagttcaggatgggggtatctttcagtgaacttggggggagggctgagtggtggagcttggggctcatgtcccaggccttctctggtcaggaaagcagagttgaaaagggcccttttaatctggagggcccagaatggtccagccagttgccccggaaaggaagcctcatgtggcatgcatgccagacgctgcacagcttgagttggtcctatgtgtgtggcacagccttacaaggttgaggtatttacctttattcctataaattgatggataaggggggttaattgatttctcttggcacttggcaagaacagaggtcagatttgaacctaggtctaggtttcagttgcacacccagcatgttctgctccacagccttttcctaaaatagtttagatgttggtataaacctgtgcgtactgaacgtgcctgaccgtgtgctagtatgatggcttttctacagtgtctccctagactccatgcttgcagaccgacagcgcgtggaaaggaggctttctggcttggtaaatgctcagtcaggtgagcttgctgagtttattgtaagctttgcagttccattccccacacacccagtggtggggatggagggggcgcagggaggaggtggccccagagcagattgagccccttggtctttgctgtagccaggactccaggctaaagtagcacagggtgggcagctccgaggcctgggtgtctctctgtctctctctctgtctctctctctctctgtctctctctctctctctctctctctctctctctctctctctctctctctctctgtctctctctctctctgtctctctctctctctctctctctctctctctctctctctctctctccctcccccatttctctctctgttcacccgcagcagccccaggctgcgtcattggcactgtgaaggtgcagggcacaggtacaaataggggggtcttctggccatctttggacataaacccccatcctcggaagcatggcccgctcatccccaggtcctggccttcctaagggctgttaaacacacatcaaccaagtgatgccttacggaccacgcatataccagacgcagctgggtaccgtgtattctcttgatattactatattctcagccaccagggctagtgtatgtgggtgtcattgtcattagcagcctagggagggaatggaatttggggagtagtctgcctaagttccattccgttcactccaagagctgaacacgtgctgggtccacacacctgtggactgatggctgggaccgtctcagtgcttggcaaaaaagaaaacggggatagcaggcactttttgaacattgattactgactgctgctgctgttactggtattgttggcattttttgttcgtttggtttttgagacagagtctcgctctgtcgcccagactggagtgcagtggtgcgatctcggttcactgcgatctccgcctcctgggttcaagcagttctcctgcctcagcctccctagtagctgggactacaggcgcccgccgccacacccagctacttttagtagagatggggtttcaccatgttggccaggctgatctcaaactcctgacctcaagtgatccacctgcatgatccacctgccttggcctcccaaggtgctgtgctgggattacaggcgtgagccactgctcccagcctcgtcggccttttttgccttctgcttgtacctcaaccctttggcaaaaagtaggaactacagagggcctgtcattgagacttcaagttgccaatgcccctcacctattcatctgaactcaggcacatgtacatgctcacacgtgtgcatgctcacacgtgtgcacacatacatctgacatggacacactgatatgcacacgtgtacaaattgtgaatggtatggaccccacgtgaggcatgcacctaaggcgcgcctgtagcagcgggacagagaacaggcttccttgtaccctgtactcatcacgggggttgcgctggcttccttgggttggctttgaggagtgcggcttgtgacttctccacggtagagaactgaggccttagacaaatagtcatccattgtaactgttccctgcagtgttgatagaaatggtgttgggataattagactgtgctgctgctttctccttttctcccaggttgatgagtaggagcagtttaatttgagactagtaaattttgtaattggatttaaaagactgaaatgagcggacctggtttccatattacctttataccccagcgaggggaaatgcttgagtcaggtgtggatcagattattttattgtgccaacattaatattgggagcacacacataatctggagtcagcaggttcatccactactatctcattaaattttcaggcaaaagctgcaaaaattaattggaggcatgtaatagtttagaatgtgtgccagcttatggtaatataaattatgtgaagagaagacagttttatatactgagagagggaaaactggtttactttaatgagaagagatagaaatgtagagctattttttcattacagatacactctaaaatgtttggacttagttgatgaatagagttaattcgctgctacagttccaataattcatgttgcacagtttaatgacttctagataaaaacaggattgaaatgttaatttctcggaagaaattggggcactcttgtatatcagacatctcccccccacccccccattaaaccactagttaattccaccaaacaagtctctttgagctatttcatgccgtgtagacttttgtatttcttacctgggctggctggcttttttttaaaccttaatgtatatgataatcttaggtgacagaatgtgttagagctgtgtctaggcaacctgactcagcagagagtttcataccttttagttttgtaaatgaccacgtgctataacctgcattctcctgtccagtaactgtttcggcagggagggggtttactgggttgtggttagccatctgtttagtcgagtagcgatgttgtcccacttctgagctgggaaataggaagtattgatcagtcagctttagattcatgaggcgatagtctcaaatcatgcagagattttatcactatgttattttgcatctttgttttctttttcacttttcataacttggagacattttttccccatggggtaggttcagcaaagttcactgtcttctttctctttaacctactctcagaaaaaaagacgaaaaggaaatacgaagtatagtaatgaagtgttaactaatagtggggctacataattgagtactcggattttgttgccagagttcttagaacaagaatgcaaacatgtcttatttcaaccatgtgcgtgctgtgttttgctttttttgtgtttgacaaaggggacaaaagaataaccccctaagtattaaggagtggagggaaaggagatgagcccccactccctgcgctcccttcctggtttgcctttgggtgtacagttcatagggcttcctagaaacggctgcgttagggccgagggggtgaagacttggcaggacttcctggcagaggcaaggactcccctgcctcccacctcatgaccattgggccttagcaaggcttagtgaatcctgagtggggtcatctttagcctaaacctggagtcaccacagagcttttgtaaacagtgagaaacctactacttcctacagaaactgtgctgtctgcaaagctcagcgtctgctccagcctgaatccccaggccctgtccctgtacacacctagttttgaggtcaggacatcacaaaacatctgccaacatcgaaaagtcatcaggagccacccagacgtggggtgtattggtgggaagaaggagcatcttagtctgcttccttctgaggcccacagttccagaaggactagcgtcctcagagcatgtggtagtggctgttcttgtcttttcctggtggtggggcctggtgacccctaacaccaacggagctgttcccaggttcatttcgtccctttttctgtggtgagatgaggctcctcctgccctccttgctgggtggtctttctgttttgaccacatcccttggaagcgtggctgggctgcgtaactccagagcagcctggtggtagctggggctgccttctgagtttgggctggtggatgctgagtatttgcattcagagccttaggcattgaccttggctttctgggaccctacgcccctctgtttgcctttgtcagtagagaccttctcacatttagggattcattttttccaagatctgtttgctaggtgtgtgtcaaacttcctcccagagcagtgacatggatgggaattgtgagtgtgttgagagacctaccctaaaagatggggctgcagtcatcctcaggggacctcctgttctcagctccacctcagccacacttggctgtgggtcagcttcttctgaatcagcatccgcaggacagcgccacccagccctgccacacttgcttcctccgcgcttcttcagaggctggagcccacccccatgctcgtcgtctgttctgcttttttgatgcacttacttgtccctttcagcgtattgcttatgtcctatgttggttaaaaaaaaaaattgccggtaatcagccccagccatttctcagcatttctagtttggaacttcagagacttcaacttacgattcctttaaggcaggagtttctactttggcactgttgacattttgggtctggtggttcttcattgtggggggctgtcctgtgcatcatacaatgttcaacagcatccctggcctctccccacccgatgccagtgttgcctccctccccaccccggcatgaccagagatgtcgccagatagggcccagtgtcccctgcttgagagcccctggtgaaggggtagaagttgattccatggcccttgtcacactgtacttgagccataccgtgcttggcacggaaaccaccctgtagccgttgtcagaggtggagcgtcctccctgaggtgcgtaacccccacatcatcgttgcttccttgggctgtgttctagcgtttgcgtccgtccctttttctccttgattgcagatggaagggccctgctctgagccgtcgccacatgcctggtgcttggctccatgatgctcacatgggtgttcatgacagtgcatttgacagacagatttatttgtcaccttgtcagggtgacatgttgggatggctccaccacttgtgtgccattgacacttggctgtctgaaatcaggacaaagcatccctgagactgatccgaatgaggcttatcagcaccaggcgtaacttaccgcctgctttcctctgtttctttaacttttaattgaaaccatttagttaccacccctgctgctaggaatctggggacaattaggaaagtcccatctgtcctttgaaccacattatattgcgtttctcctcgcaatctcaagaagacggcacattctagcagcagtgtctttgccttgccgtctcgcctcccactggatggtttttatctcacttgaatgagttatagcaactctttaattcaattattttctccagtgcaggctttgagatgatttagttgaatcaaacacccgggttttccaatgcagagcagtgactcccagcgaggccgtgggagggtttttacattttcacttccagccacggttgcgcgcgttctgtgctgccccccgagcgtcctggcacaagcccctacttaccattccgaggagtagattggaaatggcagatgccgtgggctttgccagtctttccccaaggcaaggaattatctgtccagtgatattaggtcactgcattcccacccagctgtgtcgaaagaagggagggggtggggcagcctgggtgatgggcaggaaggccatttataaattcaagtgtggtaaacagtcgactctcctgctttggtatttgagtttgaattaaacaaagtgtcgtgggtgggaggtgtatcatacgatcattttaaccattgtgccttttaatgtggaaaatctgcccaaaataggacctgctgcagtggttttcacatatacaaagaagtggctagaatgttctctcagaacagcacacgggattagaaaggacatttggccgctggagttcttcagtgagaattcagtgattaagcctgtcttctgttctccttgtgggccccagggttcctgtggatgtccccaccctcagattgctggagtagaaaacttaactttccaaaacactgagttgttttcagcccagcattagaggttaaagatgctcatgtagaaagcacgcaggatggatctgacgaaggaaacagcttctgatacttgagcaggctttggacagtgcagatgaagggggctgagatactgaggcagtaaagagaacggtcagcttggggtctggagtcgctgggcactgagtgcgcgttctgagtgccattcaagcaccacgtaacggttggggctggtgttgggtcctgagatgggccatgggccaccgttaaactcaggaagcacgtgctgcccccccccactctagaaggcgggctgttttcctggcgctgtgtgtgccatgctttgtgtgaacatctcactgggtgtcgctctcatgtggtaactgggcatgttgtagaagtcgttgctcctaaacgtaagccagtgcccacattgggtacgttctggaagaaacagtgtggcccaacatgggcttatccagagacaggacacctgctgcctggtgacgtcaccacctcccgatggcaccactctgttctactccactgcccccggggcctgacttgctactatggaactaaccctgtaggatgaggccgccatgcccgtgtgtgtgtctgtccagatctgtccccacatacttgctggtggcgggtgggaagaaggttagataagttactgtcatagattgtgactatgaagtaatccattagaatcttcagacaaggaatgctgggagtggtggctcatgcctgtaatcccagcactttgggaggtggaggcaggacggatcacttgaggtcaggagttcgagaccaacgtggtgaaacccatctctactaaaaatacaaaaatgagctgggtgtgatggcacgtgactgcagtcccagctactagggaggctgaggcaggagaatctcttgaccccagaaggcagaggttgcagtgagcagagatcatagagatcatgccactgtactccagcctgggcaacaaagggaaacttcatctcaaaaaaaaaaaaaaaaaaaaagaatcttcagacaaggaaaccatgctctttgacctagtaatctcccttccccacccaatgccaagaaagctctaatgcaccaagattttagttatggtgttacttgacagcaaaaagacagatgactcaagcatccaacagtgggaaaacagctaattctttttcaaatgatgccttcacagtttgaaataagtagaatgcttgtcttaaaatgaaaagcttcaatatcaaatgttgaacatttatgaatagaaccataaaaataatcatgggggaaagctgatgaggagcagttcatagtgattatctttagttggtagaattttgggtgatttttttttccatacccactcctcctccccaaatgttctgtaatgaatatatgtttgggtttttttgtttttttccaagacagggtctcactctgtcacccaggctgtagtgcagtggcacagtcacagctcacagcagtcttgacctccgggctcaagcagtcctgcctcagctccccacatagctgggaccacaggcatgcatcactatgcccagctaattttttgtttgtttgtagagatggggtctccctgtgttgcccagactggtctcaaactcccgggctcatgtgatcctcctgccttggcctcccaaagtgctgggattacaggtgtgagccactgcacctggcctatgttactttttaaatagggaataaaatagctggtcaccctgatgcttccaaaggaatcatgcatttgttgaagaggggaacagtgcaatgcaagatttacgaagacagagctgattaccttccctccccagtcctcagatactgtctttctccttgcctttaccaggacgtacaagtgcatctgagcatacggagggtgtctgtgttggcttaccgaaaggagtcctgttactcctgcattcccattcgatatggcagattgtgcatagatacctctgcagaccagtaggcctctccaatacttttgtttccctcttactgcctttgggcatgtgtgcacacccaggattttacctaagtggaatctgtacttactatggttttggtttgtgttaagtcatatcctttgttttttcaattgtctcttttggcagaaccatgtatgctagcatccagctgcctgggctcaattcctgcctctgcctttggtagctgtgtggcattgggaaaatggctgatcttttctttgcgccaatttcctccttaaatataagtaataatagtacctgttttataagcttgtaaaggataaatgacttagtacctgcaaattacatggaccagtgcttggagacgtaagcactttgccaacttgctgtcagtgtggttggttattttcccccatctccccagttttgttttgttttgttttgttatttatttatttttttttttgagacaagatcttgctctgtcgtccagggtgagtgccagcacagcttactacagcctcgacgtcctgggctcaagcagtcctcccacctcagcctcccaaatagctgagactgcaggcatatgccaccatgcccagctaatctttaaacttttggtagaggtcgggtctcactatgttgcccaagctggtgtcaaactcctggcctcaagtgatccttccaccttggcctcccaaagtgctgggattacaggtgtgagccaccacgctggccctcctcagcttttttttttttttttaaataaccattattattccatattttttctatgaaatcatttataaacataaaatatcttaagtctgtaattcagtttatgatacatattcagttatgatacattctttgcatttcactgtttcatgtttcagccaaatcccatccccccaaccttttttttttttttttttgagccagggactctctgtcgcccagactgtagtacagtggcatgatctcggctcaccgcagcctcttcctattaaagtactgggattataggtgtgagccaccgtgtctggcccctatccctctattaagtgcctttcagcaattctgtttttagaggaaaattcctttttgcttctgcttgctccttttaccacccctgcccatgaaagggggagttacctgtccagagcaagtatagctttggccgtgatcttcaaggactattgcattggtgctgactgctggggccccttggcccccaggttcccaccagtggagcaaacacgaagggtgcagcctagtcggaagtgttcccaaggacaacatcagtgtgcagacttccaggggaggggcatatgaaactgagccaacagaggccaagatgagaaccctcctgtgacatggtcccacccattaggccattcccttggtcagctggatggcaaatactagtagtgtatgctatggagcagacatttattaagtccctgctgtgtgtcaaggattgagctaggactctgcaggaaatgcatgtgtagttcagtcctggaagctgcccagcttccgcctcctggaagcatccttttctccccagctgctctcgcctgcacatcttacattctctggctggtccttctgggtgtgttcagccactttgagctgtgcctgcctgatctgcacactttgcaaatgtgtagactcagaaagagaaacagcccaaacagtggccagaaactgttcttggaggctctaggttgacaaaagggtcctttaatagctccaggttgacccctcccctagacacctgtgctccccctgagccacaccgtgacttcggaagttcaactgtcatccagtttggtcggctctttcacaaaataatttcactgattctgtcaggcattttcattactttgatttaaagtttttgtgtcaacctctggtactttagaatctccagatgttgaaaaacaaaatcccattggtaatgtttgttttcctttacacttatgaaaaaagcaacttttattctcgcctaaaatttattgtcgagagcacgtcttttaaagtaaaaaaatgtttgcagcatgtcatacggctctgaaatactacgtaggtcgcagcttgttttgaggcataagtgacaaatatacttgtgagagatgttattcttaccctattaaagaaattagaacatggcttttgtgtctctgatactgattttatatcttcgcaaccgaatttgtgaatcccagctagagtaaaagacacacgtgatgcatgaagaaagtgaaatggttctgtttggtatttatctcatcttgatctttggcttggaagaactgataatgaaactctctttgggaggacagagagctctggggcattcatctcccaactaggtctccgaatttggtgcagttcttgaaggcaggtgggtttacacagtggtgagaagtgggaagtatgaagggtgtgatcttcgccctctttttgtatgcccgttaacaaaactcaattgttaggcgttgagtagggctattgatttctagccaacggaaacacttactgtgtaatttccaggagagagacattttcaggtgatgtggactcattccctgcagttcagaaggtaatgagcaatagtgatcaatcctgaggttatccggggtgatttcagcttgtccattgcattgattgataaatggcatgctctgaggctgattgagtgatgaccagcagcatcaaagaaaaccctcagtttgcatggcaggtattagaagtggctgccttgatgcctcctgtcatcgtttgagtggtaaagagacattctttgtatgtttataactcttgatttggggtcatggttatcatctgtactaactgcacaggtcatcccgctcccatccctttttcattctttagaatcccccacagcggtccacgccccttgccaacttccttccactatcctggttctgttgttactcctgccgactgcagtgctgttccgtgagcttcttgaatgacatcgtacagtatctccgacgcacagtacgtaccagttacagttgtcttgacaggatctcctgtgatcttttgtcccttttcagtttagctcttggtggctccataggctctcaagcatcctggacagttctctgtgggctggcgtcctgggtcagattccagggccggatgtgagctgtgccttgaccatttgaagagctcaccgaaggaggtgggaatggacggtgcaggaaagtaactcaggcacccgaggctgctgagcccagagaagaagcacctgtccttggagtattgttccaggaaatggggaggcaaccggttccagagggcagaactgggttgggagacaaggaagcacagttcttgtaaatcaagaaaatttgtaaagccacataagctgtccaccagtgagagagagcatgtacatgctgtgagctgcagtcaggccgcctggccacaaggcatgttgtggcatgctgtgggagtcggcgttgaagcatcccagagacctcttgtgcttaaacaaagctgagttattcagcacactcctagatgtggggtctgattgttggtcaaactgaaggactcgagaaaatgaggactaagtggggggatgagagacatgtgagtgggtgttgggccagtagaatgacaaaaggagcaggcccaggctctttggaagacagacctttgcccttcagggggactgggggagtgtttcctggcaggtgtggacattcgtcctcatggatgtcttctttataataacctgtggaggacggcccagcgcatcatgccactgaccttcactgatgcttctgtacttaagaagtaatgtcccttggccgggcgcggtggctcatgcttgtaatcccagcactttgggagctggaggtgggcgaatcacctgaggtcaggagttcaagaccagcctgggcaacatggcgaaaccccgtctctactaaaaatacaaaaattaaccgggcatggtggcaggctataatcccaggtactcgggaggctgaggcgggagactcgcttgaacccaggagttggaagttgcagggagctgagatcacaccactgcactctagcctgggtgacagaacgagactctgtctcaaaaaaaaaaaaaaaaagaaagaaattgcccaaattttcctttcaaggttgaagttagggctgaagaatcagggctggctcatgatctcttcagactcagtcatccatccattcagagatcgtgtgtgtgggcgcacgtgtgtgtcgtggactgttcctcaggatccgcaggtgcagtggccgcgctcccactgaacttgtgttctagaggcggagccccctccctgagggcctggctttctcagtgtcaagtggagagcatgttgtcttagtctgctttggctactataacaaaattccataagcaggtggctcatagcaacagaaatttaattctcacaattcttgggaaatccaagaccaagatgccagcagattcgatgtctgatgagggcccaagttctggttcagagacggtactctctcgctatgtggaagggtcaaatgagatcttccttttttttttttttttttttttaaataaaattttgctcgattgcccaggctggagtgcagtggtgtgatctcggctcaccgcaacctccacctcccaggttcaagcgattctcctgcctcatcctcccaagtagctgggattacagccgattaccagcacacttggcaaatttttgtattttctcctgcctcagtctcccgggtagctgagattacagggattgctggatcaaagtttaccacgctcgacaaatttttgtatttttagtagagatgaggtttcgctgtgttggccaggctggtctcgaactcctgacctcaggtgatccacttacctcggcctcccaaagtgctaggattacaggcattagccaccgagccttggccaaaagagctctttcatcaggcactaatcccgttcatgagtgctccaccctcatcatctaattaccactcaaaggcctcaccctctaataccaccaccttggggatgaggctttcagcataggaatttgcagggggacacaaacattaagaccagagagatactttggactgaggggaccctttggtgagaacacagggagtggttctctgtggggaggctgagattggcgtggcaggaggaggccagccatggggcatctggggaaaggtctggaggccgaggggctgtacccagggcaggagccagtgcggttgtggccctgtgagggcagacccggatcttgaccacgaaggcactgggcgttgctggagagcttccagacactgggctaggatcacatttcagtttccagtgagaatcctcctgggtgtctctggaaaatggcttggaaggcataagagcagaaacaaggggatcatttgagtgaactcatatagtagcagagctgtgcattgagattacccacaccccagctgcgagagtccctgttaatgcaaggtggccagtttaaagctgacaggactagatttccccatggagtgatttgctgaaggctttgggctggaagttccagcgcccgcagaaaacttactgttggaggttcttcgccctcgtttctgaaggaaagctcccagctctgcctggagcctgggatggaaattgtctctggttaataggatctttaagacagctaaatcctgcactaaagacttgatgcaactgctgttgcacacggaggtggctcccctgccatatgcccgcagagctttctttcattgtcattacagagagtcaggcgtgtgtacaggaaggagacgggatcctgccgtaatgactttgtcttcaccatcttttctcagctgcttaaattgctgtcagggcagcgtaggaatcttaaaggagggagttttctctcatataattatgctgttggtaaaaatgttggcggcttttctctacttttccccttagccaccaaaataaaactctttatcttggaactcggcagctgtttgcaatccgcctcatttctcctgctgatgtattggtgtcgcagcttgggtgatgggtggtgacgtgagggttgaaggtaatttctgtcgcagtcccatggtcatgagccaagacctggagtgctggaggtgcgccaggtcgggtcatctttgggttttgcccagtgagctgttgctaaggagagggctttgtttgcctagagctgggggaaatgttcaagggcaggcacacattggcagagatctgctgacgtggcgacggcggaactcatggctgtgtgtcaagcctgggcagtaacaggtggcgaaggccaaacctttgggggcagacttggggcagcagtggagacgtgttttggggatctcaaggcgtcttggtgggaaagagtgccggtgggtcaggaaggcgggggtgctgggacactgctgctgcttgggtggggtcaggacctgctacacagataccagacccaccctctgccaggggacacagaacgggcaaggagaagggctgtgcttctgagtgcttcactggtctggaaacccatgttttaactggggccacccccggacccctgagactgaggtggtgtgaacctcagggctggggaggtggcttccaggggaccacctcctcacgccctcccttcccagagaggatggggaaggtttgggcgggagcctccggactggtagggactccacctagaggccagcccctcctggggtaggcacagaggcctccagagcgcctccctctgagtcacattccttctcatttagtcacctttccttccacggggctgctgttggctcgaaatagaaggatgactggaccgttctccgtgcagcttcttccctgagatgttccccaagcccctcaaggcatcctttgtgatgcacttctaaacagcagccggctgggctcacagtggctcacacctgtaatcccacgactttgggaggccaaggcaggaggattgcttgagctcagaagttcaagaccagcatgggcaacatacataacatctctacaaaaaataaaataacatagtgggctctcttctctacaaaaaatcaaaaaacgtagctggggccaggcgccgtggctcacacctgtaatcctagcactttgggaggccaaggcgggcagatcatttgagattaggagttctagaccagcctggccaacatagtgaaaccccatatctactaaagaatacaaaaatcagctgggcgtggtggcgcatgcctctaatcccagctactcgggaagctgaggcaggaaaaatgcttaaaccagggaacggaggttgcagtgagcccagatcgcaccactgcactccagctggatgacagagcaagactccgtctcaaaaaaacaaaacaaaaaaaactttagctgggtgtgatggtgcgtgcctacagtcacagctacttgagaagctgacgtggcaggacggctggagtccaggaggtcaagactgcactccagcctgggaggcagagtgagatcctgccttaaaacaaacaaacaaacaacagcgagtgtatcctgggtgcttgttcggactaaggtgcaaacagagggctttgcgttatggtctttgatcctggtggcattttcattagactagatggtcacggtaatgtggtatcttttccttttttgtagacaggcgactgagtctcagagggcggtatcctcgcccaggtcgggggtctgcacatggctgtcagtgttgtgtcctcggacagccctgtcctgggaactcagaggctcagcagtggtgcctgtggaatgggcctctgttttcaccgagtagttgaccccatctggcacgacagggagactcttttttatccagaagccaaatcaagagaggcttttctgagtgacttggctgtgcttttttccagctttggaaagtatgttgagaatgcgtgctggccctggtggtcttacgttgttggtgtcagatgtaaacttgcgacgtgaaggcagaatttaagtctagctttatttagtccaacacgtgttctgcagcagccgctggctgcagagccaaggggataaccatcccctcccagtacttgcagtctggtggggaccaaccccccagagagatggaccctgtgctggctcagagagagagggcacttaaatcttgcttggtgtgctctgggaaaccctctcctggagcattggcttctgagctgaattttctggagtagaaggtaatgccgaggcctgctggacatatgtcctgtgaaaattctcagaaaggctgggtgcaggggctcacgcctataatcccagcacttcaggaggccgaggcgagcggatcatttgaggtctggcattcgagaccaccctggccaacatggtgaaaccccgtctctaccaaaaatacaaaaagttagccaggtgtggtggcgtgcacctgtggtcgcagctactcaggaggctaaggcacgaaaatcacttgatcccacgaggcggaggttgcagtgagctgagatcatgccacttcactctagcctgggcgacagagcaagactgtttcaaaaaaaaaaaaaaaaaagaggaaagctggcagaatgatcatggatacagtgtgcaaacgtgacttgtgcagccaccatactctcctcatgggggagtaaaaattagctggaaatgatacctgaggcaagaggcctattaaatcttattaataattgattttagtgggaagtacaagttcagtacataaagcaggagctttttggggaagttactgagttttttgtcttctccagagagaggccagaagggcagcatctccaaggtgaatctgcccattggctgtaaggagcatggacgaggacttaagaggcagcccatctggccacatctccaaggcgaggctgtccactggctgtaaggagcatggatggggattttgaagacagtgtgtcccggagccggcctgcagagacaggctgcctggggggaggagggcagcccccagctccggcgtggccagccctgaccttgggccatcagggagggcacgccaagctttgtgactttcaggtctgttcccttgcccacgggctggttctggctggtttctggactgtactgtggccgtgtggaattctctggcacacagcagcaggtacagagcctgcccctgggcagcgctgaccatgctggcctggggtttggatacttgagcctgggtagagacagggtgggttctcggtggccacttcctctgcagcagccaacagcagagacagaaggaggcctgggaccttgccctgcctgacccgcctgtctttccatctgaagcgcccctgacatgctgtgactcttactttatttttggtagtttaccttaaagagtaatgaaatcacattgcaaaaatttgggttctctgggaaaatatcagtcaatcttgattctaaaacttgaacacaatcactgtggccattcatgtctattttttttttccctttaactttttcttttgacataattacagacttacagaagagttgtaagaatggaacaaagaatttctaattaccctttacctagcctctccaaatgacattttaccacatttgcttgtgtttctctcatatacagaaacacacgcacagagtatataatcttcagatccctctgagatatttgcaaatatataaggctaaagtatttagggatggaggagttaatttttcctaaacacagtgcccattctttcacataagacaagtatcaaggtcaggaaattaacattgataatcatatctaatattcagatcttactgattttgccagtagtcccaataagatcctttatagcaaaagaaacttcggattctgcgttgcctctggtttccttgtctctttagtcatctttaatctggaaccgtttcttgtcctcctttgtaccatgacattgatgtttttgaagagagcagatgagtcattttgtagaatggccctcagttcagtttgtcctgtgttttttcctgattggagttgggcactttgggcgggaatgctcaggacccactgttgttgtcagcacagcggattaggagggcacatcatgtgaatttatcttattattggtggggttaactttgatcacttggctaagatcgagtccgtctttctccactgtaaagctattatctcaatctccttttttttttttttaagtcctgtacatgattttgtgcatcgtaacataccaggtctgggtatgggatgtgggaggcagcgctgtgcccttaatttgtggaggtgacgcatgtgcagttgcctccactgaacgttaaaagtgcactcctgtgaccctgagttgagttcagagactcctatcaggtcagaagagctcctgctgttgacctgcagggcacagcttgagacctaagtctggcccttccagatgggccatggctaaggttccctcattcaataaataattgatgacttcagctgctgtatgcatggatttcttgcgtgactatttttccccctttttaaatttcttatgtgcgtctggagaccctttggcagtggggcctggagctccttttagaaaagatccacaggagattgtgtttccaatgatgacagccaagatggcacaggtggcagccctcccatgctaggggtgttgtcaggtcgacagcgctcaatccccattgttccagaacggccagaggacagtgaccaggggcagaggagagtgcactctcatggcccagcccctcacttagcccacctgccctgggctgggtgcactggtggctaccactgcttggtaagaggtacgggtgacagatgtcttggttgacggtgtgggtgtgtgttttttttttacccctaatccaaggaaactgggtgtatttctctttgtgagttttgactgctgttcccctaagtcaagttatatggaagcatgatttatcttctccaaaaaatatgggcccctcagtgaagttaaacagagtataaaatgccttcatggtagttaaatttatactctgttaaaatgatttgtgcactttgcagtaagctgtgatattaagtgcataaatatacagcggagttaacttggaggaacgttttatttgacaggatcacttaaatgctcaggtacagtatcgaaaccatttagcatggttaccaggaatggagggtgagccgactctgtttaaaatctgcagaaaacattcagaatccaaaggaaagcttgtaagtaagtacttctccatggagtgcttaatcgtggaagtggttttcatcacaggagagaggattgcaatttctaaatcagtctccctgcatcatgtgagaaaatgccttgtaaataaactctccattggaatagtcacttgtcctaagcgtggaactgattctattcaaattagcaaccattatagatattttggtcttctattgtcaatgacaatacattttcctgtgggaataggttatttagtccatattgggacattacaggagaattaataattaatgacatgctagtgctcggcccacccttctgtttttgtagccaaggcttgattggattttctgtatgtataatgggctgtttcaaaatggtcttgcctcattgtttcttcatatcttattgaaaccaacccactgttgatctcaatctgtgtaaggagaatgcggagtatggcattcgcaggactgaatccctagattttaagtttggaaggagatccaaccgggcagatgaattgaccggtggtgaatattctgtagcattttcctccctggagaggaatgccgccaccgctgggaaccgtggactggcatgtgagccagtggctgtgaaaggcgctgtgccctgtgtcctccgtgtactttagagcaggagcgtcacacatggtggagccgggtgatatcccgggcaggctcccgaaagctcctggtggcccatcaggggctggtttttccaccttttttttttttttttttttcctcgagacaaggtctcactctgtcacccaggcaggagtgcagtggcatgatcttgactcactgcaacctttgcctcctgggttcaagcaattctcgtgccttagcctcccgagtagctggcattacaggcactcgtcaccatgcccggctcgtttttttttttttgtatttttagtagagacagggtttcaccatgttggccaggctggtcttgaactcctgaccccaaaatgatctgcccgcctcagcctcccagaatgctgggattacaagcacgagccaccgtgccaggcctggttattccaaattttttgattggtctaaaatttgtaatgaatggtaggaaaacacagcaggaaaaagaaagaacattattattggtaagggtcagattaagccctgggtgagagtcatgagtccctagaggtatctgaagaagtcctcctggctttggccatctctacaggatccggtgattgctccgcctccagagctgtccccaaccatcgcagcttggcttgtctgtgacctcgtgtcaactcaaaacagcactttccccccgacactttgaagtcaaccctggtagaatttgtgaggaaatggccagtgtgtgttgggtttaaaaaaaaaaaaaggctgtggaagtagaacaatcttggggttgccacagaacaggcagtttgaggtgacgaagtggctttgtaatcaataataattgataagaccttgtttctagcaggctgtagacaaaaataatcttcttggacctatcttcgcctaggaaatatgtcctagaacctccctcctctgttgatctcaacgcccaagcccatcctcccatgagaaaggtttttttttttttttttttgagacggagtctcgctctgtcgcccaggctggagtgcagaggcgcgatctcggctcactacaagctccgcctgccaggttcatgccattctcctgcctcagcctccagagtaactgggactacaggcgcctgccaccatgcctggctaattttttgtatttttagtagagacggggtttcaccgtgttagccaggatggtgtcgatctcctgacctcgtgatctgcccgtcttggcctcccaaagtgctgggattacaggcgtgagccaccgcgcccggcctgagaaaggttcttatgggaattgtgatgaaggggtcagagcagcccccacctccccccatcagcaccacccagggctgaatctgaagtcagacttggctgcttaagccacaacctaagataactttgaataccaggtgctgaaatcacagaacagactccaaatggtggccccgtttggactaaatgagaggtgagctgaggttgaacacgggaggcagagggccaggggtcccgtgggcatcagctggggtgggcatcaccacggtgcccccagctttttcatgggtgatttcttcagctgacctgggttttcagggttcttttaggcaggctcccagttgtttgtgtcagagagccctttttgttggtaatcccaagcccagaactttccagaatgtgctgttggatgtggctttattctttgatcccttcaaaaaatgaaccacaccgattactattggctgccaggcctggtgagggggtgagtgagccctttctgcgagcccggggagtttggagccagatgggggttcttccttccccgtctccagtcctgttgctctaagaacacagataagggagtcactccatccccaacaggtgccgccttatccctgctgatgtcagaaaccaactctgcagaaaccaactcttccccagctcacacatgctggaaacgctgaatgtgtcttataccctgcatctcattacatgtgtcttgaaaatgtggcttttctttatgtatataaacctacattcacagctctgcacaatcagtggcttgttttccgcttacaatagcgacattttggtggtagcggtgcctgacacgcatttcatttttatttaacttataaaaccttggggtgagtgcttctggacacacaaaagctttcatggagtgcaagagtggtgaattttttctcttttcaaaatggaggcgtggcgcatctggacacacacatcagttggcctgacctgtgcgttcgctacaggaagtaaaagtttggatgacatcactgcagggttatttcttgttattgtaattaatggaccagcaggaagtagcgagacagatgattcttggcagaaatgaccatttaaagggggaaggatgaagagggtctgggaaggaagaaacctttctggacatttaaactctccagggatgaaatagggaaatacgtagacagtgcacaaggaacgagccatctcttgccagagtggatataaaattgttaacccctgctacaactcagtttctgtttttctctctgccttctcagaacaacgccgacctgactggcactgggttttgtctggtccttttgtgccaagtgtgtcttccacgtcaggtcggtggcaggagaactcggaaagtgaagtctgtgctgcgtggagaggcgcgctgcctctcaagtcccaggtgctcttttgtgtgagtggaaggagctggaaggagtgtggggctgtgatgaaagaagggaggtggccgagttcctggggaaagagctgagtggtgacagtgttcctggacagaactgaacctagaggagatcttctggacccagaggagatcttgaccctccttgaagttgagcctcccatggtgtgtaggggccagagctgactgggcgatggccgtgctcccaaagtggttgagctggggctagaacccagctgctgcctggaccagccttccagggccagtgtcacaccccagcccacctgagtggagttgacagggttggagccttaagccacgtttgctcagggtcgtcttctgtggcccagaggtggatgctgcctgtggtgttaagggatgatagtggggtaatgggggtctggagcttgggaaaagaaaggaatagaggaggctcctcatgggagggagggagggagtagttcatttctgtgtacggttccattgtgtgatgatagcacagattatacacccattctgtgcgtggtcatttgggatttgtagctttgagctgttagggatgctgctgccatgatcatgtcatttggtgcacatgtgctacacgcatgtctgttgagcacatacctagaagaagattgctggcccattgggatacacatgctcagctttggtagaaaccgcctggtggttttctagaagagttgtaccaatttccactcctgccagctgcgcatgggagttgtgttccacagctttggcaattcttagcattatcctctgcatttggcaattctggtgcatttgtagtagaacctcagcacgttttaatctatattttcctggtgcatattagataccttttcattggctatttgggtattctcttaagttcctgtcaagtcttttgcctgttctaaaaattgctttgtctggatttttttcttaccgtgtcttagtccattttgtgctgctgtaacagaataccacagaatgagtaatttataatgaatagaaattggcttgcagtttttgaggttgggaagtccaagatcacaaggttggcatctggcgagggtcttcttggtgtgtcattccctgaccaaggggcaaagagagaggagaaagagaaaagggaataaaattcacctttttataaggaacccactcgcacgataacagcattgattcattaatgggggtagagcctcatggcctaatcacctcattaacgccccacctcccagaatgatgggggattaagtttccagcatactcttcttgggggccatatgcgaactgtggtatactggaactgtagaaattcttgatatattctagatggaagaccattgttgcatatttttactgaaatatgttcttactttgtattgtcactctataatctttttgatgagcagaagctttttatgatggctagtcttagattttatggttgatgcatttgtgtcttagatcaccgttgtctacccaagatccttaggacattctcctttgttttcttttaaaagtttggtttactttattgagtctgcctggcgtcagttaggagtccaggttcccacctattattgttttctcggctccgcctgtggaagtcgtagtcaaggtaggactcatggttccacaggtggctccagtgtcactgtgccattgagctgccatctcagctcattgtacttctctgccaggttaaacctgtagctgatgaggaacagccctgagtgatgtgtggggtccaagttgttgagaagggccaaggaaacggaagtactacacagagtgcttcaaggtaagaaagaagttactggagaacaacactgaatacatgctgtgcactctgaaacgtacacccagtcacacttacttcaatgtgaaaaggacagtgttcgccaggcactgtggctcatgcctgtaacccagcactttgggaggccgaggcgggcggatcacctgaagtcaggagtttgagaccagccacggtgaaaccccgtctctaccaaaaatacaaaaattgctgggtgtgatggcgggcgcctgtgatcccagctactcaggaggctgaggcaggagaatcgcttgaacccgcgaggcagaggttgcagtgagcagagaatgcaccactgcactccagcctgggtgaaaagtgcaaaactctgtctcaaagaaaaagaaagaaaaaaagacagtgttcactgcagagggtgcatcccagctaggtcttcatggtgcaccagacaggtcattgcctacagccaattgtctgcaggggatccttgttgccctgagctattttgttacattcttccttatgttcactatattctctgagaccttcatgtagctgctgctttcaggagactttgccttgagggactgattatcatattcagagagggggaatgctgctggtatctagagggtagaggccaggcttatgaacataccacaatgcacaggaaggccccccaccacaaataattgttaagcctaaaataccaacagtgctgagggggagagatacagctgaacaggtactgagaacatccccagcattctgtggtgctgggtgggattgaagatcagggttcacggtttccacgcctgggccgtgggagtaagaacagactgtcctgggaaagatgacatcagacagactccaaccagcaccagaccctgattgggaggagttttccctctcatatgtcgccatgtccggaccctttccggggggcagcacgcagagatgctggccattttatgtgtccagtcctggtgaacttcactatgttctaagagaaatttacttgtatctttctttttggtgaaacttagctgctatagccataacaatttgtataaatgcctatatgaatcaaggcagttgactttccacctaaaaattgtttgccacgtacaaatcggtttccaattttattaacatgtttatcttactttaaaaaataaatcccatttgaaagaggtgcagaaaccagccatgcatgatggctcacgcctgtaatcccagcactttggggggccaaggcgggcggatcacttgaggtcaagagttgaccagcctggccaacatggtgaagccctgtctctactaaaaatacaaaatatagctgggtgtggtggtgcacgcttgtaattccagttactcaggagcctgaggcaggagaatcgcttgaacctggtcaattgaactcgggaggctgcggtgagccaagatggcgtcactgcactccagcctggcgacagagggagactccatctcaaaaaaaagagagatgcagaagccattgaagaaatctcatcgtgtttttgagcttctaagtggacatcatcaacattgagattaagaaagaaagatgatgtaaaatgtaagagagtggcccttgccattgcagacactgatttattgggcagggccacatctgaagacttgggcgagccggcgtggaactgctgtggctgttagctttctctgacactgtgttcttgggctctggaggtgggatctcagctgtttgccattctgtcatctctatttattgcatccaaccgttagtaatgacttaaatgatgattgccaaaactgtagtcaacagttttgttagtgatttggggccttgtaaaataattagtcctgagacatgtatcaaggggaacatactgaatatctgagactagcttttacttgatttgagcctgcaggtcctgctacaagatcctgtgtgtgctccagggacctgcaggcagttacttggggaatcagccatgccagtggtaggtggtagttcctccccagctaccatgagggccccaagcaattggcatctgtttctttgttttggccttcttgtcagtttcctttttttttttttttttttttttcttttcttttttgagacagagtctcactctgcactctgttgtccaggctggagtgcagtggtgcaatcctggctcactgcagcctccgcttcccaggttagagcaattctcttgcctcagtctcccgaggacctgggattacaggcgcctgccatcacacctgactaattgtttttgtttttagtagagatgaggtttcaccatgttggcaaggctggtgtcaaactcctgacctcaggtaattcacccaccttggcctctcaaaatgctggaattacagacgtgagtcactgcacccagcttcgtcaatttccttttcttgcaggacagataggagctgtacgtggattcctttttcttttttgagacggagtctctccaggctggagtgcagtggcgccatcttggctcactgcaaccacagcctcccgagtagctggaactacaggcgcacgccaccatgcctggctaatttttgtatttttagtagagatggggtttcaccatattggccaggctggtctcgaactcctgacctcgtgagccaccgtgcccggccatgtatgtggattatgttctggccagaaaagcccatgtccaggtctcagggtttgtccatggtgtggatgtctagggcccagactggccaccctcagcccagaggaagtgcctgtcttgacctcttgtcttccaccaagtaccctgcgggcagctgactgttccggcccattcccctcaacaacagttgccagattccgtttcctgcttgcatcctctgtttcttaatctgcagcatttgcaaaggtgcagggtctgctttgggaatgtttgggggtggtggtacgcatttcacggtatctgggaatttggttttgtgatggaaggaagaaccattggaccattaactatggttttagagagttactgtctttcttctaagcgttttattcttcactggctctagtcagccttgctttctaaaaaagctcttcaaaacctggcggactggtccattctcctgttccttggccagctgtcatcaccattagctctgttttaatttgcatcttgtaagtttttactgccatctttcaggtcttacttcacttttggggtgggaccccttcgccttgttccagcagttggaactcaggtcttcagcatgttggattaatttcctgtcccacttgggctcaggctcactgtaccaatgaccaatttgttagccggctttgctgcttcctccatcaggagcacacagcaagtgttctgcattttattaatatttcctggtttttccatcatccctgaatccctggctggccccctagtccagtgccaagggccgtccagtggccttcaaccaggctctcatgttcttgggccttcccgcaaatgctccttcccttcccagagcagggagcctgcccctcgctgcctctgtttcccctctcagcaggcggtggttgcatgggtgagtggggcacagatacgaggtcgtggcagccctggcacacggctcgggagcatctggatgtgcctggaatatgcttccatgcaacagagagcagcatctgctcagaattggggagggaagcaatcaccgcatacggggcattttgtctttgcaggaatgcagtgtgagggaagtgggtgattttctttttttctttggttaaaaagtttttattttagaaaaattttaggccaagcatggtggctcgcacccgtaatcctggcactttgggagactgagagcagcctggccaacgtgaaatcctgcctctactaaaaatacaaaattagccgggcgtggcggcagatgcctgtaatcccagcaacttgggaggctgaggcaggagaatcacttgaactccagaagcggaggctgcagtgagctgagatcacaccactgcactccagcctgggcaacagaacgagactccctctcaaaaaatagaaaaaattttagatttacataaaaattgtgatgataatacagatttcatatacctcacacccagttttccgtattaaaattggtaatcattattattattattatcattatcattttttagaaattgagtctcactgtcacccaggctggaatgtagtggccccatcatagctcgctgaagtctgtagtttctggactcaagctatcctgccggctcagcctcccaaagctctgggattacaggcatgagccaccccacctggcctttccctataattaacatcttacattagtacgatacatttgttttttgtttgtttgtttgagacagagtctctctgtcactcaggctggagtgcagtggcacgatctcggctcactgcaacatctgcctccccagttcaagggattctcctgcctcagcctcccaagtatctgggcctgcaggcacgtgccaccacacctggctaattttttgtatttttagtagagaccgggtttcaccttgttagccagggtggtgtagatctcctgactttgtgatccgcctgcctcggcctcccaaagtgctgggactacaggcctgagccacccgtgcccagccggtatgatgcatttgttacaattaatgacccatatatatatataaaactgctgagctcaagtgattggcccagctaggcctcccaaagtaattgatccattgttatccaaagtctgtagttacttagggtaactttttatctttctatattcacttcttttggggtttgtgtgggggggggaggggggcagggtatggaaaaggaagtaattttacatctttactttctgtcaacttcctgatggtggtggagttggggagtagggaaacaacaaaatactctgtgagaacctccattaaaggggagactctcagcagaaatctccatgtcctgattagatggcacaacaaacagaaatgaccgtgtcctggcttggggatttaatattggaaaacaagcttgtcttaatggaaactttcagccagtaattttgttttcttgtttgtttgagatgaagtctcactctgtcgcccaggctggtgtgcaatggcacgatctcaggctcactacaacctctgcctcctgggttcgtggcagttctcctgcctcagcctcctgagtagctgggattacaggtgtgcaccacaacgcccagctaatttttgtattttcagtagagatggggtttcaccatgttggccaggctggtcttgaactcccaacctcagttgatccacgcacctcggcctcccaaagtgctgggataacgggtgtgagccaccgcacttggccataggcagtatttttgtgtgtttgaaactcatcattgtgggcgtttacaagttggactaattccaatactgattttggaatttaaagctttataaaatcataacgcaatttgtagtgttgtcaatagaaggtcctgatttgtaggagctggctggcaggcagctattaggggaggtggtcactcagccaagacaggcagggaacaggaaacccttggtcctgagaaaggcccctggaagaggccagccccgagactgtttggctagtggtgggggtgggcaccagctctaccccagccctgtgagtgcatcgttcccttctgttcctgtagctgatctccctgccccagcctgcgatgggaggatcagcagtaaaataagttgtctaaggtcgcgtgtcaggatccaaaggagaacccggtgctccagctggctgaggggagagtggggcctcggagacagcaggggcagattcccccagcagggcaaagcaaccctgacctccaagttgcaagggaataggtgactcagggagtacctcctgcagccctgctggtctcaagactcccaccttccagggcctggtcctgtgctcagaaacccctctgcatagggtgctgatgagtcctctgcagctccctcacccaagggaccacactgggaaacccagtagttgtctcggccatggcactaagacctttgcaccctggccatcttgttccgggacagccagcatctgtggtgtggtatagagacaaagctgccacctccaggacacttgctccttcctggccttcctgctgccctgaaacctgtggcctgtgtgttagtggaaacattctcagtttcattgctcagtaaaccttaggttatccaaactgcaaataaaatgttctctactttctagatttttataacttgctattttgagagaaaggggatggggttatgtgtgcaaattaacattttcttttggtttatataactccctgtctacgtagtttgaattctttaatgtagatgaagtttcacactcctgaatttgggaatggtcattgtatggtgttcaccctgtgcctagcagaggctcagtgaacatctgtggtcagaatggacgtgtccttcgcagatcaggatggtcgtggggcagaactctggtgcagctgtgaagcttcccaaaatcctctggagtctgtgggcctgggccgcatggtgaaattggctgtcatcttcctcgctttgctttctggctgcttgttggggctgagttgaggcccatctgactgtctggaggtagtgggtattcatccgttgttgcttggcaccagagggcaggtagatcctgtggcaagcggacaggtgagaggcccaccaaggagaggtgaaattgggggtgcctcctagggtatacatcggacccgccctgggtctgcagcccggtggcttcttgggcagacactgcacttggcggcttcagaggtgagggcacagaatgacgcgggtcagggagtcccaccatgggccctgcccatgggacttgatgcttgggtcagtgtacaggtcagggccttccttgaactaaaggctacgtgcacagactgacagctgacacttgctataacttactgctttgagagaaagagaatgagggttatgcgtgccattaatattttcctttgatttctctcatattttggtttacattatatcctttgcctgggttttgagatggtaagataagaagtttgataaatggcatatataaaagcagttttttcccttctaaatggatatttttaagaacagtttgatttacagaaacgtctagaaggttacatggagagttccgtatctcctcacctagtttccttattatcatttgacattacattagtatgagacatttattaaaattaatgaaccaattatcaatacattaatattaactgaagtctacattgtattctgatgatctaatatcctttttccatcccagaatcctgtccagtttttcaccttgtatgtcactgtctttctccttaggccccacatggcggtggcagtttcacagtctttccttatttttgatgaccttgacagttttgattatgatagtatattttgtggattgtccctctactgcagtttgtgtgatgtttttctcattcctggactgggttatgggtttcacagaagactttttttgtgtaatctctaaataaaaaaattcttgaaagaaaaaagtgtaagcctttgccggccaataatgaatcgccccacatagcaggtggacgtggggggtgtctggttgtccatcagtaggagtcgcccttcccttatacctgggcctggtggtcaggcggggactttaggaattcagcagccttgcctgcgttcagctgaccaaagacttttccatggagctgggaagactgcccaggggagataggaagaggcacgtcgcacacactgggcttccctggagacttctggattctcgagttcaccttgaggcatttactgatcgacacatgggctagttccttttttgttacattttaaaattctggtgaggtcgttccatttatggataagaaacccccaggtgtgaagggctcaggtgatgtacccagagtcacacagctcacgagtcagtggcaggactggagattacactgaaggttggtgcactgtgctccctggcttctgtgcaggtgtcaccctcctccaccaggcagactttgagtcgtgcaaacagaaaagatgctgcccacacttcagggccatgcttccagtccccgtgagctacccccagcaggctcctgtacgaaacatgacagcactttctagggtgcttggccgtgcctgcttcccccgttacatctgcgcaccctgcttgccttccgttcctgccctgcactcacctagcatggtgcatgcacctgactgcttagaaggcacgggacgttctgacttgatgttttcccgatttctcgctggtcctgatgttggtagctccatgtgacacaaagcattgagtctctggctctgctggggttaggatttgggatatggcttggtagaggggtggctgcctgtgcctagccatcgccatgttaacagaagctgtgatgtaggggctcatagctcacatccctcagccaagagccactggtcactcagacgttgtcctgggtgttaggacatcagcctgagcattagagggagttcaccatcaagaagatgacggctttttttttttttggctagagtgccatggcacaatcagggctcactgtaacctctgccttctgggctcaagcgatcctcccacctcagccacctgggtagctgggattacaggcgcatgccaccaagccgggctaaattttgtatttttcttaggacagggtttcgccatgttgcccaggctggtctcaagctatcctaggctcaagctatccgcccacctcagcctcccaaagtgttgggattataggtgagagtcaccacacccagccgatgatggcatttttctgatagactggaaagccagctgaatgaaatagctagaagaggacagtgaccctcagcttcttcatatggagcacgaatggatgtaaatttagtgggatttcttttccactggggctggccacaagagctggcagtgtgctcctacagtgagtccctcctctaactttacctcccactttctccctccggcccccttagctctcagctcagagacccacaaaaacaaatcctggggagctgactgcgcaggatgtggacttggtatttccctgatactggcatttgttagccggatcctgcctcttcccttcgccacctcgccttccccaaagcccctgcgggctttgctcttccttccctttattttgctgaagttgacagtcaggtatgagctgcattaaaatgttgactcatccttgggttgttttcaattttttaaaaagtgcacattgagaaaagcacagattcatgtgtgcagcacaggaaatcatcacaaagagaacaaggctcttgttgggggcatttgagttcaagcagagtgccccagttgcaagacttccatttggatctgatgatggctggacctccctggaaagactggaacctgaagagcccagtcaaagaacagtctgtcaagcagcccctccgcaaccacagtttttgtgcagagtggtttggggagcccatggaatggggacagtacgatgtattttctagtggcaaacatttcatcatcaagtgagagtttctttgctgggcatttcctgttctgtgtgaaacagttgtggttacctgtgggtgtgtttcagataatcattagagcatattctctgctcgttaagcagtaaaaccagtgaggtggggaagcttgtgaaactgaaatcccaaatatgcaaaacttggcaagaaagtagagaagagccagaccagctctgagctaagtcaccaaaccagaaaggtttcattctttgtcttttcttcctctgtctttaaccacaagccttgggctgaatccccacatctcactacacagtcagggaagcagggtcaaggctgactggggacactggcgtggcgggaatgggtgaagtctcctgggtggatagtcacctctctgccttttttgaaactaaacttctctgatttttatttcaagttgtcctgaagaacatgattctaaaacagattcagagcacgcactctgactataaatagaacataaggcaaacttggacaatggattgtggcacttttttttcatgtacctgaaattcttagagttggggctctcttcccttgagaagtagaactgctattcttcggagaccgatgggtgacctcagcattgtcctcaccaagaacgctgtttccccagggattgcacccctcccaccacagttatttttctctgaaggcctgagtttggaagaagtacttgcctgttcccgtaattatggaaaccggaaggtaacttacctgtttgtgcctggcctaattcagattagaaaaagatcaatccattgttgtctaatggacaggggacaaatgatgaagaaaacagaaatagcccataaaatgatagggatgtcccggctcccaggcaaactctggtgaaaaccgaggagactatggtgttccctgaggtattcaccatctaactgtcttccacaccatatatataagctgtttataaattctttgtcctggccaaaaatacaaaacctactggcagtgatttattttttttaatgcattttaaataactggattcctatgtggaattggagttggataattaaattacgatggcctctaaagttggggtgcggggggttgagggcttcagcagagagcacccctggaaggtggcactgcagcctgggggtgggggaaaaccgtgcctgatggagttgctgcaggggtccctacacggggtgtccacccttcttgcccagacaccctgtggctttgagaatcgctgtgacatagccacgggagagctgtgtctgcttaatgcttttgtttactttggaagtttgtcctacatgaatgaattcgcaaaacttacattccccgtaaagctgtcactgagagaaaacacagcaataactcaggtgatgtagttaaaccaccattgagtttgcgccatccatgagctgataaatcgtacagcttcatttggtaggaatcagcaattttatgtggcaattaatttttactactgtaggggagccagaggatgagcattttacttcggttttgtgtgtgttgagagaaacttaacggttttgccacagcaagaaaggatcgtgcatgaggcctttcgcacgagtcgacgtgtttgggtgttatcctggggtgtccttgccagcttttgttggttcctcacgtgggcagaagagtgaatgctcagtccccatcggggtgccacaggcctcatgacgtgtggggtaaaacacgtatgtggcttgcggagaaataaattctccgtatttcttaagtatgatgtttttccccaccagaccgattcgcccatgctgtttccacatcagagatgaagatgtgcgcagagtaacacgtaattagctttccagattgcttcgtagaaggataatgtgataattttcccattgttcgtttttggttccaccaatgatggccatttagcacagcacacagttgcggctgaggtccagctcgaggctggccgaggctgtgcacagctgcccagggccctgcctcgctgctggggagctgtcctttctttggctgagctctcttcctgtggaggcccagcctgctcactggaacgccagaaagatcatctgagcatagttgtctgttcagccagcctctcttggggccattaggaaaacgggtgcacagcagatgttgttccttgggtgccctcagtggtttattttttattttattttatttttttgagatagagtctcgctttgttgcccaggcgcccagtggcgcaatctcagctcagtgcaacctccatctcccaggttcaagagattatcctgcctcaaccctcctgagtagctgggattacaggcgtgtgccaccgcacccggctaattttttgtatttttagtagagaggaggtttcatcatgttgaccaggctggtcttaaactgacctcaggtgatccagctgccttggcttcccaaagtgctgggattataggtgtgagctaccgcacccggtccctccgtattttttattactgatggcagcgaccctaaccctaactctaacccctcgcgctgagttctgctgcgtgctgccagcgggtgtctgctgtcccagaacctccccgcagccttcagagtgggtggcactgtccccacgttacagtgttagagctttaaacaggacagacttaaaaaagcagatgtcctcatcaccctcatttcacgtgcgttctcttacagacacaccctactaggccattatacagtaaaccctagcttctattacatcaacaaatagttcagtgtattttcctaaaataaaaggactaacatttgctgagttttgagagcacccctgtgtccccccattcaggggcacctctttctagtagtccagaaccgaggctggactcagtcgtcccctgctcaccccgttttcccctgtaggcaccgttttgagtccgctgggttctgcttctccagccctggtgggagcagtcgctaagggccctctcggtttagcaattgaaacaggaagtgaaacacacaggagtttaggtccatcacaaactcagggcgtggacgatccctgggctacccggctttggtcccacctccaccccagctgtgtctttggccagttgttttctaccctgggcctctgtttagtcattttagatgaggaaagcatacctggttcctaagactgttgggaggaatgagtgaattcatgcaaagtgacgggaacagtgtccaggatgccgtgagccggggagcctgcttattgctacagctgctcctctcagtaagggtgtgacagttgcagtgaccgtgaggaggtggcacctcaccgaggtgcatctgagaacccaggaatgcaggccagctcacaggtccaggatgctgcacgggggctccgtctggcctgtggtaccagctctcagttgcctctggcttggtgtgggggcctcaggctttgctgccgtagacgctgttatatcctcccatacccagatcacctggtgtctgagtcccaggccactcctggaactgggatgtgtgggatttggtgtcaaactggctgttccttggagcaaggaggaggagaggtgagggaggtcctgttcctggcgctgcagggcctgtaccccttcctgtccacaggccttctctggccttcccctggggcagctaggggtgtggagcagggcggctgccagtggagccaccgtcaagggaagtgtgggtgtcgccccggatgcccagcgagagctttcccctgaaccagagtgtctggtgccaacagcgccaccagagggggccgttccactggaagtcctatcgggaagtatttttacagcgcttggctgtccttgcagacgaaaataagatgtttgctttagcaatttgcttagccctgaaaacattcctagacaatgccagggccttagttgaaaatagtatgctcagcttgctgggatggtcccaggaaggatgttttgagtgaaaataaaatggtacataccagggctgtttgccaccgcaggaatcctgggagagttcagcattgagggttgccgggagccgggatctagcaggggctggctatgggctgccctagcgtgcacccctggggccgaccggaagattccagaacagggagaactgtctgcaggtgtcaccctgcatgttgctctttcctccctttgcaccttagcacaccagcccccgcgggtcaagaggggtctccagctgcggtccacagtcctggcctcggcttcgtgtcctctaggttggggcaccggcctctctggggaagcctgcccgtgtgcttcttattcctcgactgtgagaaacttctttatccatctgcaatctctcctcttggcttcccctctctcctggtcatggttctgcccacgcagaatacacccaatccctcttccgcatgactgccctgcacataatcacaggcagagatggaaactcgggaacgttccctgctggggataagcattgccattctcttccacaacacatttgcaagtttttcacttgctcagaaccagtgttgcaggtaagccgcaacagacacacacatgtacacacacacacacacacacacacacacacacacacgtggggggaatggaatatcatgaccagtagttaaggaaaaatgcatttctgtttaaaagccatgttttaagaaaaagtacttgaactcaaataatgacgagtgacttatttcatgacatttgtctctgagacaaggtggcaaatagtatgctatgatcatttgtcgtgtgaagagtgaagtcagagtaacccgctcagctccagagcctttgttttcctctgcggattcccttggcagcatttctgtggaggataaaaatagcacacggtgccttaaaataaatggctgtggggaatgcttgtgtacatcagctgcgtggccacatatgttcacattctccatattgttcactcttcaaaagagtgactgggatagacggttcgaatctgcccgccatatgataactaaagtgacatggaagagcctttggcccccgggaaggatgactccagggatgggcagtggggcaggctcaggtgtgtcagactcgtggctaacccgcgaggtcctgcaggtgagccttttctgtcctttaccccatttcatcctaagtgtctccccacaaaagatcagcaaagccagacccaacacaagctcccaaacaggccccttcctgactcccagtgaatccagacaaacgctgacaagctgacagattccgcctcctggagctggtgggggtgggcgggcaggaaattggcggggcgagaggggcagcacactgagctgcccactgatgcagtgtcagtggccttggagcatggcttctggggtcgacgtcaaaaaacagtgtgaaaatcttagcgtggacattaggctaatgggtccaggtcaggtgtggatcaggatgggttggtggtgacaagccttgggtctggagtaaattccatctaaatcatgtcacttttggctggagtgcagtgatgcaatctctgctcactgcaacctccacctcccaggttcaagccattctaatgcttcagcctcccgagtagctgggattacaggcgtgcaccaccacacccggctaattttttgtattttaagtagagacggggttttgctatgttggccaggttggtgttgaactcctgacctcaagtgacctgcccgcctcagcctcccaaagtgctgggattccaagcgtgaaacaccatgcccggcctcaattcacatttctgaagtgaaattgcgtatgtcttacccctcacgtaccttcatatagctgattttctcctctataagccaacaaaacccagcaggatcctgaaacaactagcattgcttgtgtctcctttttacttaaacacgcctcccacccccaccgcccacactttgtttagcaccagcaaaggagacaaaagtgacagtgccgtctccagaaggttcacgcagtgagcctccggtatccatgcagaagcctccccctgcccatcctagtggtaaggaaatctcctgaaggtcctcgtcacctgcctgaccgtggggatgtgcttttggtggtggtggaatctccgtgtgaagaatttggtagacttgattctctgatctctctgtgcctttttattttgagacagagtctcaccctgtcgcccaggctggagtgcagtggcataatcttggttcactgcagccaccgcctcccgggttcaaatgattcttctgcctcagcgtcctgagttgtggagattacaggtgtgtgccaccacacctggctaatttttgtatttttagtagagacgggtttcgtcatgttggccgggctagtctcgaactcccggcctcaggtgatctgcccaccgcgccaccacacctgactaatctttgtatttttagtagagttggggttttgccatgttggccaggctggtctcaaactcctgacctcaggtgatctgcccgcctcagcctcccaaagtgctgggattacaggtgtaagccaccgcgcccggccgtggcttcacatttcaacaggggaatagttgcgacacacgcccatgcctcgctgtgtgaacaccgtcctccagatccttggcggttagcttggaaaaggcaaaactcagggggagaggaatggatggttagatcaggtgagagcacctttatgggacggtgcccaggaggcatcttgtgaggacgcagcactgtgtgtgcaatcgtatcacgtgaagaacttttaacatctttctggagttttctggtgcctgtattctttatagtgggtgactttggggagggcgcagctgcatattccaggctggctgggtgcaactgggacctccactttgcctactgcacagtggtcaagttcaggtgacagtccaagagtttctccccgtcagggctcctgtaaaactctgtaacagttcataaagaacaagcagaatactaactccgagaggcctccaagttagaaatgctttagaggagaaggctgaaaaagcacctcccgccacccagctcgttgatggcatgaaagcaccaggcctcattcctgccacggccctgagcctggcttcccgtgagaccctcttgggggcctgtggacaggaagtgggacggccaggacccagacctgtgacctgcgtcagagtgtaacgaagtccaggccagtctgttgcccgaagcactgggatgctttttactgaaggagtgtttaaaaggtaagctggatctcagacaaagctcctccaagaggcttccagaggctggagttttgtcaacaaatgaaacaggccctattttaagccacgctgtgtaccaggacttcctgtttttccagagaaacttcttgttttggtttttgtgatgatggatttattgaaacatttgctattcaagtgaccctctttgtgttccaaggaaaaagtcaagctggagattctgtggcctggaaaagggatacgcactcacagcaaaaacgtcatccccaaaagactcagtcggggggagtctgggcctcagtggccgatcagtgaatggacaaagagctaattgccagtcaggggcccagacggatttcatagctcggggtttggcctgttgtttagagggaggcgggggctggtcacaggacaattgaaaggggtttttgttgttcctctcaggctaagttaagccatgtgtgtgtctctctttcgaggagtgctggtctggccaatcccagccacgtaaatcccactcacttcctgctgaccttttgacaccaacagatgttttttcttacaagtgtcattagggcctctctactcgctgacctcatcagattgtgttgaagtcgttttcatcggttttgtctctaacaatccgtttaacccttcctgggtgcctctctgggaataagattgcactgccttctggccttgctgtctccctcctgcccccaggacctggcatggggaacggagcccaacccagagggcagagaggcatgcttccccggctgggggctgccctgtgtaccccggggacagagggacccttgtgtcttcctcgggaaggtgtgatggagaaagcaatgaggggctcaacaggtccctcggagagaaccttccagagctctgcctgtggatacatgctctgatcacacagctcatcaagcactggggccacagacacggactgggaggtgggtccccatggcacttgtgtgacctgtccgcattgctgcccgtgatggggttgggagcgatggagttggaggtcctaaggccacggaagtttctgtagccaacatccctcgactaagagtgcagactgtcatctgacctgactctgtggccgttctagaggcaggaggatggcgttggtcatttaacctttccatgaagctgaggcacaaagagcagctgtggggctggcgggtgactagagggagtgagttttcagcagatgaccctgactcctgggccgctgtgttgtgatgttatcttacaggctctgggcctcctgggctccttagagccaatggcacactcttctgaaggcatctggggtggagggggagtgtgtgtatcctgcctgcacctgaggtttcggggactcacctgaagcctcatccagagctgacagacatctgtgctgggcgtgtcctcctccatggcgtgcacgccttcactgtgcaaaccagcccagcagaatggaattgctggctgcttatgcattgtgtcagttactactcacagccgcttagaatagttctcatcgcacatggagcattctagaagtggtagctgcttttgtttattagttattattattattattactattattattattattattatttttatttttgagacacaatctcgctgtattgcccaggctggagtgcagtggcgtgatctcggcacactgtaacctctgcctgtcaggctgaagcaattctcctgccttagcctcctgagtagctgggactacaggcacgtgccaccacacctggctagtttttgtatttttagtacacacggggtttcaccatgttggccaggctggtctcgaactcctggactcatgatctgcccacctcggcctcccaaagtgctgggattgcaggtgtgagctgccacgcctggccagttagctgcttttaaagtcatgcatgcagctaaaaagcgttccagcctcttggagcctcctccttcccacagtcccactcctcagagggactcccctgccaacagttgggtatgtgtctacctgcctctttgatttttttcttttcatgattttacatgctagtctggctttttgcttctgcagatgttctgtgtctgctctggagagctctcccttggagtgtggttcggggattgtggggtgtggctttgtgagacgtagccgtgttttgcatctggctggtgtggctcagtctgactccacaagcctctgcagtgctgcttctgggggagcgggagatgtacatcggggtcctaaggacataggactaggagtgacctggccatgttgagtctcaggttctctgaagtttggatttggtgacctctacaatctcagaaggctccagaaatgccgtgatcctaggaaatcatccagggccacccaagcatctgggcacatgagggcatggcacctgcgtggtttttgcagccttcccatttctgccccttgtgttgcagttgaggccagctcctgcctcggctcatggtgttccctgtctcagaagcggctgtgtttgtgccctgaacctctgtgcagactgccttcaatatttacctacatgctctttttctctgagagctcagacttaatcgtagctgcagttcaaggaccacttttaagaaaaagcaagaaggtctgtttacccagtgaattaccattcagaggggggtctaggaggctgcattcttaatgtggggcccaggctctgatagatctttttaatgttccccagatttatgggtgtgcgtgagtcagagtggagaccccagggtgcctgagttaactctgtgcatgttgagcgtagccctggaatttattttaagcatctggggtaagtgaacataacagcagactttccgttccttcagcttgtacgcattgctgttgtgaggagaatagcgtttaccccaagagtttacagaagtggatatatcacagacctcatgtcagtctgggcagcggaggatttagagggtttcgcttgttttttgttagtgttctctgtcctgtaggtagtataaactagacgccatgcattacaaatgtattactgtttttatcttttctgttgaactgtactgtgtcagtgaccatagtcagtgtgatagtttgtgtaaagggttgtattagttatctattgctgtgtgacaaattacctcaaaatgtaaaggcttaaaacaacaaaactttattgtcttgcactgtctatgggacaggaacctgcacagcttagcttggtgcctcctgctagggccctgacaatgttgcattcaggatgtcagtggggttgtggtctcatctgaaggcccggctcggggagggttcagcttctcatggactgttgggactgagggccttggtttcctgttccgtgggtctctccttagggcagctggcatggcagctggcctctgggagggagggaagttggcagggaagatgggaggatgcccacactggtagccacagtctcttttaacctaatctcagaagtgacatcccctcacctgtgtatactgtttactgtttgtttagaagcagagcttgtacaaggacatgaattccaaaaggttgggggtccccgggggccatgggattgattctttttctggcatccacagtgtagatgggatctgccttattcagggagagggtcatgttcagcttggaaagctctcagtgggcctctggggaggggcagtgattcagaaaagcctccatggccctcaattcatggccctctactgttttgtgggcacgcctgtgtcaccggtgggtggctgtgcagagctatccggcttcggattccccagaagtcctgtaggggctggaaaggtcactgagataatgtgtgtgcaacctcagtgagggtccctgtgtggaatctgatcctctgccgggtccctggtttcttgtggagctgggcatgaagggcagtctgtggccagtgccctgcccttcggaactatgtggcatctctccttttccaagtgaagttcccatttcccttcctgtcttcccactcatcagacccgtctacaccttcggctctgggctgagatctcccctcccatcttcaggagcgtgtctgagatgttcaccccggcatcatctgaagtgctgtctctgaagcccagagggtctaacctcagaccttccaaaaaccaaaacctattagcctcaccccttctctgcctctcttgagctgagcctgttgatttcccaagggccttgggagtggagcaggctgagcccaggagccactcatccctgggtgtcctccctgggagaacctctgggaggggcctggagaggacagagggccttccttgcactgctgtgttgggggatgccaggaggggctgcaagaatctggactgcaaaagacctttcactgtgtcctcttgctctctgttcggcgggcagtgaggttgccattcaaaagatagagtggcgggtcattttcagtgggctcctcctgctcccatgtccttggtgttgacaatgcactggatccttcctggaggtgagggagccccggccctccagagatgaacccccagtcgtactccagaaacctgggagaatgctgcacctgccctgaggggcagccttggcttcggtggccccgtggattcatgcttgaattatcctggaagttgtgtggggttttgttttcttctttttttttctctctcttcgaataagccttttgtactcctaaagttctgtgttttgaagaaataagtacacttggggtcagcggctgcatgctgcgtgatgcgtattcataaacttcattctgggggaagaatttgagaatggaccggagagaatgctttgacagtcagaaaagtttttctcaaaatttcccatgaacttgggaagtgtggagatgcacgtggctgtcccaaagccatatgaatggagttgatccaagcgcccaattccagcctgagatccagtgggcgctccgtctgggctcccatgggaatgtgttggggctgccgccaagcaggaaccgatggtgcctgtgattgtggaccccagattcctgctggagcccacactatgatacacaaagcccggactgaggcattcaaaggcacaatcaccatccgtttgctgctggaccccaagggcgttcttgataggttcttccctcctctgtgggccgtgtggggatcacctttctttgatctcccaaccctggcatgaggctgatggaatcttctgggtgttgttaacacagacaacacaaaggcaggacggtccaaacaatgaaatcccagacatggagcacagaaaacagcttaagggaaataaggttagaacattccctcctgggtctctcccctggcgaacacaggtctgagcctctcaggaggctgctccctgcgtgttgtgggggtcagctctgggacctgcagcccctctgaccactgctgggaaatggccacgggcacacctcaggccgtgcgtgttgagctgtctggggcgagattggagggtgaaggttgcctctccccataaagcaggcttgggttgacttggcgctttttaataaagccaggattctgcacagattgctgcccctgcatcacaaccaggcttcctgccggggggtcctgagcttgcaggtctcagcagcgcagacccccaccgataggtgcgagcctcccgtctgttggcatgtgttggcgtgctcgggttgctgaaagaaggttccacagacaggccaggacagagatgtgttttctcagagttctagaggctggaagtctgagataaggcatccgcaggggtgcttccttccaaggatttgagagaagccctgtctccgtagcttttagatgccatcttcacgtcgtcttccccctgtctgtgtctaagtgtccaactgtcctcctttttatgagaatattcgtcttggattagagtccactctaatgacctgtttaatttgattgccgctgtaacgaccttatcttcaaataaggttccattctgaggtcctggggcttagaactttaacataattaggggggtccataattcaacctgtaacagtcagtgtgtgacctgtgggcatttaattgaaaaggtttctttttttttttttggttggttggtttctattttgagacagagtctcactctgttgcccaggctagtgtgcagtggcgtgatctcagttcactgcaagctctgtcccctgggttcaagcaattctcctgcctcagcctcctgagtagctgggattacaggtgcccaccaccacacctggctaatttttgtatttttagtagagatggggttttgccatgttggccaggcttgtctcaacctcctgacctcaagtgatccacccaccttggcctcccaaagtgctgggattacaggcgtgagccaccatgcctggcctgaaaaggtattttaattgctttggggacttaattgacatcaagaccataaatgttcaggcttggatgactatggcaggaagtacatgaggagtgggcctccagggacctgcctttccctaagggtctccatgtaccgttttcgaatggtgtctggggtggggacataaacttgggatccaggtatcctgagtcctcggaccttttttcccatttatttgtctggcttgggctctaacatgcacaatatccccataaaatgtctcagagcagatctttaaatggccattaccttgtcaagaattctccagtgggatttcatgtaaaattaggatccctgatggtagctcacgatgagctgtaattctccacataggtgactgtattcatgggcaccatccaccctcctcatccagatgtctccctctccagaggactttggtgcaggaggcctgtgaggaccccagttcattatgacaaggttgcagttctctagaagattctcatcaggagccttgtctactcctccccagcaacctctttccactaacttatattttagctatagcctggaacattctgagctatgatgagtgttaaaatggggtggtgtactcgtcagagacctggagaccgggactggaagccactgtgaaacaggtgaaatgattcaagaagacagctgaaccccagcgacaccccataacagaaacaaaagaactcttgtgagccgcacccccacccttccttttcccggcatttgataggcaaagatgaatttgtgtgacacgggagtgtcccaccctcctcctccccatcagactctgcgagacgcccgctctccctttgggtgcagtcatggataccaaacaaagccttcatccctctgggtttccgttacgtagccgtcttccacgtgaaaaccgtgttaagcaaaatgaatagctgcaagctattttatttcatgttaaataactgtggataagactaagatttttctctttatgactcaggttgaaaagataaggtctgggaagcggtgtctttgaatctagagattttctggagttagggatgtctgatttctacatatcatttccacgacctgtcgcaggagacagggtaccggtgccccatgatgctgcagagcggcttttggtgatagagacgcattatggaatgtgtatacttgtaaggacccaggcatagagtatctgccctcataaagcaaacataatcctccactcctgaggtctgagttggctctcctggatgccagcctttgcatgagtgatgccttagttgaaatgaaggatgggccaccccaggtgcctggagcacttttatcccagtgcatgcccaaactactggtgtcctaaacagttggcccctcagacgtggggtttggggagctgagctgtgcactggggcggtggctacactggcctggtcacgtcaggctgggcagaagagttggagcagggtggctcaagagtcttgatttggtttgactctataacttggctggcatggaacttggaaggctgggtccccactccttcagcaggtgggcccctttggagggagccgttcctgcttgtttttgagataatctctccggacacttggcagcccagccagcgtttgctttgatagcttatctctgcccgtccagcttgaactcccctttcccaccatcttcgaccatgcctgcgggtctccacctctccctggccaccatgtagccctcattccttgctgaaggttccacactgaagtgggttgtacagaggaacctcgtcctggaaagtgaaagcaagtcccactgaatgtgacttggagcaagcttgtgaggtattcgtggcatcagagccatgaagagaaggtggagaggcgctgcctgggggaggtggcaccggagctcaggggggggctccccaggatccgcacgtgtgtggggtctatccaaaggcatcctctgccaaatcaggccaagcatgtgctgtatcactcagtggtatcctgctgctgtgacaactgtggcgactttgaaatgatggtaagaaagagtgtcctgtgacggtggggactgaattaggcacatctgtctcccgtagtggggcattagtgggctacaccagcccctcccattcttctccaaccagaaactgtcaggtaccctgccagtgtggagaagaggtggccagcatcttagaacttggtgaaaggggtgtgtgtgtatgtgtgtggtcaggtggacgtgtgtgtgtgtgtgtgtgtgtgtgtgtgtggtcaggcgggcaaattgaggccagagagcacgttaatgtgcattctggccagaatcaattcctggggaaagttggaaaaatctcctttcctttctaaattagtgtctaccaggaaaaaaagttgtatatcttaagatcatacttgtctcacagcaaactgatcctggtgttgagtcaaattgagcctgttgatcaggtgtgcatagtgctccagaggctgtcatttgtaatggaaagcctaaggggcatttgcggagcagcccagccggcccctccccagcaccgtcctctctgtgtgtgttccgtctctgccaagttgtttccaattttcaacactaactggttgctgtcagcagacgtaatggaaaaatcatttgtcagggtggcccctggctccctggggtcggggactccacaccctgggcagggagcctccctccttcttggcctgtacctccagtcactccgctgtgaaagtgggacccccagctagcgtctcgggagataaacaagtaggcgctggcgctgcatcccctttcccctggcatatcatgctcctagaaacgaagcatctgctgctggaacggtgagaccttctgcctctttcacatctggaactttcggggaaatgcagcatctcatccatgggcccaggccttcccttctaggagtagctgatcttattttctccaggtgcttgtagagcttaagttgggatagaaatgaggatggtggctcatggctgtctctgcagcctctggaaggccatgcagggtgtgcagtgccctctgctggccaaagggccccatcgctggacaccaggcctcccttgggctgggccagctcccaggaagggctgcaacaggaaaaggtcagcccacgtgggggtttccattggttttgagagcaagcagagactgcagagagcatgtccttatacaagcattctggaccctacggtgtcaagagatgagtgggctgggatctcagaaggccagttgggttcccctaaggacagtagaggccccataaaatcagtcgaggattccaggcctctctgaggcaaaattcaaaggcaaacatcttaaaaatctaacctgaagattttttttacaaattcatatctcatcattgcaatttgtttgataagtagctaattcctataattgcctttatttgatatttaaatacaagggcaattcatgtgttaagtgtaagctaaataattaaaagttaggaggattaaatcttcccccatttcatatattaagacagcaatgtttaacattatctcattaataatttattatatactatatgatacatataacacagtgttctataatatggttacaattgacagttgaatacatagtctaataaattgtattaagttttgcataggtttagcatataacctccagatatttctctccaagaagtgtagcttggtggctcttgcctttgcaagtcctcaagttcaaaacccttagtggccatcagtcccctgtgcttttacaccatgctggacacagcagatgtattgtgtgtgcccaattgtattgtgtgtgcccagtttctctgcatgacgttcagatataaacattctggaatcatttcttgcacactgtatgtaacaaaagatgagttttctggtggaaccacttctgtctgcctaaaatttgagatcactaattttttttatctgttcaaccagtcttctcggctacagatcaaaattttcatgccagagtaggaaagagaaaactagaaaaggaaaaattgatctgcattcctgattcctcaagtctaaacagacaggaataagaggtgtcatttagtttgtttgcttatttgcttttatccctttttttttgcttaacctttattattaaataacactattaaaactaatatacagtttatttttaaggcatatttggaagacaagttcttttaaactgtgtgaaaatcctaaacacaagaatggctcattttctttagcaacaaagaccaacacttaatttccattatgacacaaatcaaacaaccaattaggaaaatcacaaattctttctgctcaagtcttctgttcttgattatagcttttagcaagtgaaaatatttagaattttggagtcttgcatttaacacgaggaaatgtattttcgtgtgctaacaacccttaaccaaaacgggaggatttactcagctttgttggccaagggaaagcctggtttttagatttgctcacctccttctgtgtggcagcccagagcctcatagtgtgccctctcctagcactgactccatgtgctcagagacttgctgtgtacatttctttgatgtttcttactctgtgtaacttacaggggcttcacttttaattttttggtcatttcaaagcccctaagaatgttttggtgggagttagatggacagaacagaatcacagatccacattccttagcctcatatccaaattctttttttttttttttttgagatagagtctcactctgtcactcaggctggagtgcagtggcgggatctcagctgactacaacctacacttcctgggttcaagcgattctcatgcctcagcctccccagtagctgggattacaggcgtgcaccaccatgcctggctaattttttgtatttttagtagagatggggtttcaccatgttggccaggctggtctcgaacttctgacctcatgtgatccaccctccttggcctcccagtgtgctaggattacaggtatgagccactacgcctggccctcatatccaaattctaaaatactctgatagcggcagaatttgacctgccctaaattgttgagtctattttttatattctttcttaatgcagttgggtcagtatgattatctgttctggcacaggcatttagatgatttggggggtacaccgtaatagattgtggaagccatgtattttttttttaaacccaagcacttgtgaattctgtagcatacctagccttggggtgtgggaagtggattgtagccctgtgttggctacagctgggtttcctgcattgcatcagccctagggaattagagggtggggcccttggaactgatcgagggcatgtgaccagggtgtgaccatgtcactctggggttgggctgctgggtgctccctggggaaatatgagctccctagcctttctttgatggtggaaccagagtgaaacttcaatgtgtatattagaaagggtcacgactgggcttggtggctcacgcctgtaatcccagcactttgggaggccgaggggtcaggacacctgaagtcaggagtttgagaccagcctggccaacgtggtgaaaccctgtgtctactaaaaatacaaaaatttgctgggcttggtggcttgtgcccagctacttgggaggctacagcaggagaatcacttgaactcgagaagtggaggttgcagtcagctgagattccctgggcaacaaagcgagaatctgtctccaaaaaagaaagaaagggtcctgctagttacctttagggcatggtatgggggcccttggagagggagattttcctgtacgcctctttattggtagtgtataggaagtcagacaccctcttaatccccaaaaacataaaactaaatttgcaaaaattaataaataatcaggaagcaatattcacttttggccattgtcttagttcgggctgctgtaagaaaaataccatcgactgagtggctttatttctcacagctctggagcctaggaaatgtaaaactaatgatctggcagatccaggatctgggagggcctgcttgctggctgtagacctcctggctgtatcctcgcgtggggcagcaagatcatctattgggtactacggactgggtaataatcctgttcctgagggcagagcctcatgaatcacctccagaggcccagcacccagatacaatcactgtgggcattagggtttgcacattcacgaatccaacattcagcatggaagaattttagggtacacaagcattcggtccatagctgccgttctgaaaattggctccattaagctcatttcctatcctgattttctcaaaaagcttcatttccttcctttaaagtacagttttagtaattttgttattaattgtggtgttgcggttgccatttaatcaaaggctgggccagtgctttttgacccactgatccctgactcctttaggacgtttattttgttatatctggctttgctgttgctttaagtttgagacaggctctcactgggtggcccaggctggagtgcagtggctttattcacaggtgcgatcgtggcacatcacagcctcaagagagctgcccgtctcagccttctgaggagggagactagaggcacacgccactgtgccctgcttatatctggtttttagtagttttttccaagtgtagtttacaaaataaaatgctcatcacccgttcagaagattctacccagctctcttcctaagaaagacatctgttgcacaagtttggcttctgaagcctatggaatgtgctcttttgaggtggcctgagcacatgtggctctgttaactccggatgaaaagtcagagtgttttctgggcagaagtcattggtgggctggcgttctcaaggccctgttaactggcaccatatctgcagatgtgccgccagcacaccagccggcaccacaccagcaggatcctcggctatgtgtgcaagagctgggtgtcaccaccgcctggactgttgctgtctcctcatcttggcacagtggtcgcacaggctcctggatgagcctgtgggtgcactgagaggccctgtaggctgcggtgaaggaagctttccaggagtgagtcctgtcgtttgggatcccaggctcagaagggtggtggaccttgtgcattgatgcggccatctgggttgcagggaatcttttcttcctgcattggatcgcctcaacctctcaaacagaaagtctgcgccccactcatgcttaacagtgagatctgagttctccggggacacactcagagaactttggcaggacttgcttaactacgatgatattaatttgtgagcatattgtgaaactcggtctgcctttattaacagaatgtttaaatagatttccttgaaagaattgaaagccatcatcatgtttaactggatttgagagaaatttcattttgaagaaaggcactgtcaaaggcatgcacttactctataaatcccttcagctgcctattcttgatgaaggctaggaagtggagtcaagaaatcgagagggtcggccgggcacggttgcttacacctataatcccagcactttgggaggctgaggcagacagatcacgaggtcaggagatcgagaccatcctggctaacacggtgaaacccagtctctactaaaagtacaaaaagtagccgggcgtggtggcggcacttgtagtcccagctactcgggaggctgtgagggaggagaatggcgtgaacctgggaggcggagcttgcagtgagcccagattgcgcccctgcactccagcctgggcgacagagcaagactccttctcaaaaaagaaaaagaaatagaaaaagaaaagaaatcgagagggtctataaaactgagttgatcccaggtttttgtgctgtgtaaccttaagggcgcttggtagagaacctcatgatggtggcgaggagctggtgatggtcattgagtaaaattaacctgcccagattttagactgtgcttgatgaggggaaccctcccctttcccctgcccttgattctggatatgttggagtttgatagccaagcaagggtttgtaaaatgtgccgtttttcctttttgttctctcatgtcttcaaaaatgtcacattctctgtgatacctccacggaacaaatcttccatacccgtcccctctggaaacaaccaagtatctacaagtggctttcttttccaagccttgttcatcttcagaaatgagttgaatttcttggcaccaaatatttcagccctagatcacagccctcacttaaagcaaataaaatttaaggtccacgtttctgatctttggttggagtttggcctgtgatacccgtaactttccttttgggaggaggtagtgtttcttcttgtgcggtttggcttcagggcactcttcttccttttgaaaagatacagctttcctgttgaccttgaccttcactgaggtttacctcccagcctcagccagaagggaatgattattcgctgcggggatgagtgtgcaagggggtgtcaaaggaaaggcaggagcagctcacagagacctgcaggctcccaccgagtgtttttgtgcatatcctcactggctggtcctcactgccactctgggacatcacagtgacatcccattctacagacaaggagcctgagtctccagaacagctcatccaagctcattccacgagtggggtctagaactccctccacccacgattccgcccctggcatgatttgaggaacaatttcagcagaagtggaatagtgaaacacgttccctctgcttttgttccttccttatttgtgcccgtattgtttggtgtttaggggggaaaaattgatttatgagtggagcctggttttcatagcaggcatcaccaagagagctgtgatgtcagggagcccagagccagcgtggatcgggggtgctggcttgctcagcatggagaccagctggaggccgctgtgtgcagctcagctctaaggagggcctgtggctgtcattggaagatggttatgttaattaagtcctcgtaaatagcttgctccttgggagggctaaggaggaaaatgtcacatttcatacattctttttgcacaagagatatcaggggagaggattgaggctacacaagtcaatggtcactgcccagaccagacccagaggctggtggccttgggagccaagatggccagccctaaacatgggtcggtgccactggcctggggtgtgcagaaaggaacccacagaaggtccagaacagagtgacccccctcccccacccccacccccaaaaaagccagacatgggagtcagcctctttttttttttttaatagtagaatattggcgtttgtggaagctgatggctgatctttcctttgattgcatgattgagattctacttatcaatttttcaggaagccatctaattatacaaattaaaattcaaaggaaagcaaaaggaatgattacgcctcactcgggggttgggggaggagggtgtgaaacccgccttgcctcagattataatgctgtcatttttcatctccgaggtcttcacaaaaattaactgattaattctcttccccccttggatgacgcagctgatgtggaaatctgtttttacaacagagtcaaggaggggccagactgcagtttgaccatcagagcttgcgcctgagcaaatgacaattgctggcccgagcctccctggtcagcctcacctagagtcacttgtgggtgggggggtgggggtggggatggacaaaagctcagatcaataggtttggccccccgcccccactccaataactcttaagttggctatagttagggactctttttttgtgtggttacctttcagaaagcccagcactggctaggcgcagtggctcacacctgtaatcccagcactttgggaggctgaggtgggtggatcacttgagttcaggagttcgagaccagtctgggcaacatggtgtgaaaccccatctcttcaaaaaatacaaaaattagccaggcatgttggcacatgcctgtagtaccacctattaaggaggtgaggtgggaggattgcttgagcctgggaggttgaggctgcagtgagccatgagcttgcccctgcattccagcctgagtgaagaacagaccctgtctcaccaaaaataaaaaagccaacactagcaaaaccaatttttaaaatacgtccacatggatctgctcaagggtaaccccacacattctatgacaacctccatctcctgactgatccgatatggtcagtccccgttttgggggaacttcccaatcgttgaaagggtttggtatctcagggatgttacattaattatttatgtgattggaaattgtgctttttcgtagctcttttatggagaatcacgtaattatcgccataaatctttcggatgccttttcagcttcgttgctgggaaattagccgttaacttacagaaacctggtagacctgcagtctgaccttttgataaagtaactcttaatgttttgcataactgatgaccgtacatcattatcctcatttctaccccttgggcctcatttttatctttatctctcctctttctttctgctagatcactgagaaccactttttctgtgtgtgtgtgtgtgtgtgtgtgtatgtggttgtggtggtggtcttaaaataagactgatttaattgtatttccttgggaaaaaaaaaatacagaagacaatagagtgggccttaaatgttgtttcccagttgagattcaagccacctttttttttttttttttttttttaaagacagagtcttgctctgtcaccaggttggagtgcagtggtacaacctcagctcactgcaacctccacctcccagattcacgtgattcttttgcctcagcctcccaagtagctgggattacaggtgcctgccagcatacccggctaatttttgtatttttagtagagacgggattttaccatgttggccaggctggtctcgaactcctgacctcaggtgatctgcccgcctcggcctcccaaacttctgggcttacaggcatgagccaccgtgcctggccaagattcattaagcctcctttaatcaatgtaaagaatgcagttccagagcagtgacttaaaagctgggatattggggacagctgttaatgatctggacctcaccgggcacattggtgacagtcagaggcttccaaagtgctcagatcctcctgagaaggaggatgggcagcacctcctcttccccaggccgcagtcaggtctccctctagagaatcccacataccccaaaccacatgggagacctttcttgcctcctccatcagcctcacctctacctgaaacgtcatggggatggttacactctcacactaagaaatacttcagcccatatagctgggaccaagtgtcaaggccagcagcctgggaccctgcccttgctggtgctgactgcggtcccctccagctgcaaggaaggttcaggaaggcggcatcggaggaacgttggttaggagctgctggggcttcccacccgcgttctcacgtggtagagtcagggttttgtgttgtgctgagctgtggctttgacccctgacccctgcgcggctgttttggaaagcattgttgtaactcacctggcagcaggccttcgcagagcccctcgagtcgccacggtgtgcgtctgcatctcagtgtgagtgcgtttggggcaggtccaactggctgtcacttggtctctgccactggaatataatttattacacttcaaattggtcagtaaattggaatttatagccctaaagttaaaagcaagagatctgttggaatttgctgcttccagaaataactgacgattgtcttgtgtgcattcacttgctttctattatgagataagaagcaggaggcggctgagatgcacttggtgcagcctccattcccagtgctttgggaaaagagcaagtcccatgtgtccgcatggcaggttcccttatagaaagtagcagttaagtccccagtgagctgttgtcctgtgcccagagggtctccagagagtaaggattcttttctccttgtttcagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtaagagcgtgtttggcggtttttaccaaacatacgtagtccctcactcaaatcttcgctggctgctcccttgagttggctgtgccactccccaagccagagtccctcctccgattccaacactgcataccattggcaccctctgctgggtgtccttggccgtgggcctggccttggcttaggacaaggcctggcttctggggcggggttggggactaggaggacagtttcagggctggtgggccctgaggtctatgtcttccatgtacctaaggttattttgcatataaaagatggtgttgattaggaccatcttttttcacttcctgaaatctcaggactttacctgttttggattaagatatttacaatgctgaattccctgatactatgagattcctgaagagcccagcattgcccctcgtggtgtgttcatgtccctggtatctttggaaatgtctggaagtgttctgttcatgaaaggaaaaataaacataattaaaatctaatggaaacctggggacaaaactctgaagtgttgattaagcactgcgctcttccagctagcgggtggtaagaaaccagcgtgtgggttcgggtttaggggtgagtgcacctgccagatggggtcagtgctacagggctgctctttgctcagggtgattgctggtactgccctacagggtggctctcggagggaagcgaagatggctccgcagccccctctgcacccttcacgcacacgctgaagtttagtagctgacccaccagtttgtggacaggaatatgcaacccacagggcttcccctgcagctgcccatatggaattgtctgtcctataagtagatgtggctcatgccacacggggtggggacatcatagacattctgctgagtgactccatggcctcacagaactctgcgctgcaagaacacaaaagcactgacattcctggggttcagtataaggagtttggcgttaaagggtttttttaaagtaaacattcagaaattataaaaacctacagagaggttggtaggatggtacagtgaacaccaatattccattcagttttccagattcttttgaggggagataaagatagagatatacatataaatagacactgtgtgagtagatgatggattttcttccagaaccatctgaaaaaattcaggggcagcactttactctggactacctatggcatggcaccttttatccaatttcctactgctcccagtaccggaatgaaccccaggaatctaacctcagggacagtattgtctagtataggctgcatattcgcatttcctccacgtctctttgcctgtgcaatagataagggtcacgcattgtgtttagttgttacatctctctagtctccttagtctaaaattatcccctgggcttttttgactttcagagacattggacttactgaagagcccaggccccattgatttgtagactattccacagtatgggttcaccagattgtatggggagttgtaaaatttactcttgacttccactgtaaaggtgcttgattgaggttactgagtacttgcttctggaacacgctcgtgactcagctttccaaggttactagcaggaatgcctctggggctgactccaccccctgcacccaggattctccagggatgttgcatcagaaactagaatgggattgaagagctagcagcgtttcctctgtgtgtttccatggctgtataaacctgacttgggcaaaaccattgtctgcttgcagaccctctgtcccatccagacaggtgctgaaggatggttcaccaaccttcccacccccttcatgtgtaataggaaattttcagccaattttttataacagaagtttgcattaccttgtctatgcatggtgttccagatacatttgcagttatatattttaaatttctcaataactatcaacgcagacaggccaaaatgcagttactccagtgtgggtcaccatctatatgtcagctccctaggcatctcattaagtactcacagttggtcccaagtgctttgttggtgctcctcctatgtataagctgacttagtccttgtggcacctgttatgggtcaggacaggtggcacccatctcacaggtgctgccagagaggcgttgagcagtaggcagtttgcacccaggaacccgggcagtctgtttttttctgtttggccttctctcataccagcttgttggattcagctctttcttccacctgaaggccttgaacatctaacacacacacacacacacacacacacacacacacaccctctagctttgaattctcaccatgtttctattctatcaactacttgtagaatgttctgtattgatatgcagagagcctgtcaaactgtttttttctccctccccactgcctacacctgacacagggacttctgcgtcccttaggtttgttttttttttctttctaaatgattaaaagcatgaagctgccatgttctgctgtgcttacccggtctgctcccaggcttgtaggaactttgtcttcctgctcttggtgtctggatacaccagctccttaaaattcgtcccctcccgcctgctacacaatgccaacatcaagccctggtcgtgggtccctaggctggaatcaggcaggcctctccagggtcccactccaggtactccgctggaatctgagcatcacccctgcacagatacttgtacaacctttccctgttttctaaggcctgtccagccccttcctctttgaaacttttcaaagcaagaaaaagtggcatggagcttgatccttctgtgtgcccagaatctgccgtggggattcactccgccaggctgtgtctctactcggagagcaggacacagacagtctttgggactccagccaaatgagctggaataatggtctttctagccaatgtaaaagccacattttaatttttttaatgtaactctttgagtttgctatttataattgttccttttttttctgatgcctgctatcaagcaatcctataataccatgtaagaattattacgaaggagccctctcgtaacacaggctgatcagaacaagattgtggtctcctcattctcaagtataatggagatcttcctatctgtttagtctgctgacataattgacattgtgaactgcaccagctggagggttttagtacctactttatcgcattatgccagagctcctttggtttgccccaaacatctattggttggaaatgagggctagctaacaatcactcagcattgcaaagggaacccagaagagcatcttgcagagccctgggtttgtagaacttaataaaccacaatggctgttgttggtggtaactttttgttagagctgcttcttgtggattatgatagaatcagtctgtaaacactgctcccctttcctgcggctgttgcgattgcaacttgaaaaaagtatgtgtttcgttttactgcgttttgttcgaatgtgttagagacgtggaaaatggtcccccgaggatggtatcagctgagttgtgagtagtccccttgtaacatgactcagggagggtgcttctccatttcctctgcaaaaataaaagggacctcctcttaaataaacaagctcatgaaacattccgcacctctggaatgttctcacgaccacagaggataaaaggaatgagaacgttgagctggttgggtggatatgaggaaaaaggagacaagctggtttctgtgaaacacatagatagttagaaagtctgggaatctcattctgcatcacctttgtcgcaggaggatgagaagtctgagaagatgctgccggggatgaggtggaagggagtttccccagtgggtctcttctgtgtcgcgggctcttctgctcttctcagtgggttgaacttgccatggtggaagcacatgtcagtgggatgtacccccaagaaaggtcatccatacgtataaggaacaaagacaggcgcctccagggtcagcaaggttacccaagtggtctagaagtccctctggctctttccttcttccagcagcctccttgcctggcaaacacccatcagagcctccaggatgagagagtgactttctctttccccgaggaaagaacataatccacagagtgttgacaaatggttttgtttggtatttaagatttatttgtttttgttctgagtagctgttttcttttcacctatctttgtacagatgcattataaaatcaggacttgttttgtttttgtttgtttttttaaagcactttgagcgcttcgtaaagaaacagagttgaagcctgcctataggtagtccacaaacagttctaataaataactttaaatagccccaaaatgtggattttaaaaatgggattcataatgttgctatacattataattatatgttgggatcaggcaattatgcacatttccagcaattatgtgattagctgtaattacattagctatgtaaatatacaatagtcaactagacatgccttaaaaccccaaagcacaaatgaacatacccaaacaatcttatgcaaaggtaaaggttcaggaaacagccaaggcaaagcttcacagacaaaagtgcggttctttgcaaggggtaaagtttcatgttttgccttatctgtccccggctttaagagaaactcagagtgggggacccctccccagggaacccctcaccccacctgttcctccaccgactctggggatggggttcatagactgccctcccgttctgcagctgtgaatcaggttcggtgttttatttctctgttgttactcatttctcaagcacaaacataagcgtctctttgcaccggtcagtttggtgatgggcggatgtcttcatactcaccacttttttctaatagcaacatgttaaggccactttgcttttatttggggggccagggatgtgtagtgcaactggagtctgtggctggggtttgggggttcatcaccgtcttctagtttggttctgcagctgcggttttcagctcctgcccctaccacagtgaatcgcgctgtttcccaccgcctggttggtggtgccctgtctccatcgatgattgagttgaaacctcccacagtgtggcccggagcccctgggcccagctgcccagggctttactctcagtgcctgtcctcttggtcccggcacctttgggaaaagagcatctctagtttcaggccaagtcagtgccttgaggggagcagtgcttggggtgggcagggggaaggagtgccgcggggggaacagtgcatccgtagtctccgtgtttggaggaggccccagggtagccagacagcagcagacagcagcccgcacgaatgcggagaaccttctgcgcgcttcacacagctcaacctaattgacaggtatttggggtgactgtgaaccagaaccccaagatacattttgctgccggcttcttgccctctctccttttccagaacgtacagtgttaaagctgtgaaatgagactcctctctgattggtttctaccacttggctcgcttgctactaaagctcaggcaccttggcgtgcgcgctcgagggcgttcctctgtctctgtctcatctccatctacagagtgacctcacgtgcctttctcagcccttccacatccagcaggagcctggctgagcaccccagctgggctgtgaagatgccgagaggggagagcattctgggtgtccagcgctggggcacagtgggatcccacactccctgtccctccagcctgtttctcatcacctgagggttttgttttccgtgttccggttgaagagatgtctgtgccaggagggttcctcccttcccatttgcaacctgggatgggtgacgcagatttatccgagacttgggagtgaggctgagagtcagttctttcgtatcctaagaaaggctgaccgtcccatcaaggcccgtgtgctgaaactgtccgtgtgcaggctcaggtggagcaggtctctgtcaggcagccatttgtatttgggcggtgggtgctttgcctagcttagtgcctaccatgcccaggcttgcaaatggggctgtttgggctttgatgtgggctcaggctcagagggctgaagtggttgtggggaggggcttctggggactgtgtccatgtctctgtcgtttttccccatcacaccgtacactcccttgaggccagccgtccatcaccattgagtcatagtcgacagtttgatttacagcccgggtgtcaaacaaaatgaaaagcacgtgatgaatggagggagcacgtgctgtggagggaggggtgcgctccgctccgcaggtcaggggctaagcggccatgccttggcctgtctctacaggcacatgcatgccctggactatttttggggtgcctttctcatcttgaggagtggcaggttttttggactaaggacaaagtgacagaattggactgagaaaggttcatgggggagggctcgctgagccagccctgattaggagcattgctcacaaaaccagaggaaggacggcatcctgggaccttctgatcgcaggacagccgaggagacctcaaacagtggagtgtgatggggcgggtcaccatggaggtgaggtggagactttgggaatctgcaggaaaagctgctaaagagcagaaggggtggtgttcattgagcacctactgtgcggagcgtcttgtgccgggtgctgtccagagctgagcacagcctcttgaggttgagtgtgttccattgctagaaatgggaatcctgacatggtccaaggtgaggcctgtcctgcatcccagctggggtcccgttgcacactttggctccaccaacactttcaaaatgggcagtgcaagagaatgggcttgtttttttttttcttttgaaaccccataatgagtggtctaattttcataatgcagttcccaggaagctttacaatatagttaagaaattgagtcagaagcaatgtgcaggcctttgttttcacttaccatggctaaatactgagagacatgaggactggggcttcttaggatgcagctaatctgaaaaaggctgggttggttcagacactcgacgtcactctcctgacttcctttggcgcgttgcgtgggtgcccaagcctccgcgctccaggcccagaaattggtgagagcactcagtgtgcaagcaagggtgcacggtgcactcagcccctttgatacctgaaacgatgtctgggcagttttgctaattgttgctgtgtgcttgcgtgatttagacgaaggctgctttaaaacccagccagactttgtgtttgctatgtaaccagtgcatttggtgtggcctcccaccctttgcgttagattagccaacttggctactttgggttgaggacgttcgggggcagggggtagggggttgatgagaggaaagactttttttttttttttttttttttttgaaatggagtcttgctctgttgcccaggctggaatgcaatggttctgtctcggctcactgcaacctgcacctcccgggttcacgccattctcctgcctcagcctcccgagtagctgggattacaggcacccgccaccacgcccggctaatttttgtatttttagtagagacagggtttcgccatgttggccaggatggtctccatctcctgacatcaggtgatccgccccactcagtctcccaaagtgctgggattacaggcatgagccacggcacccggcccaagaaaacttttttaatggcacaaattccacaacacttaacttgacagaagcagacaaaaatccagcacaggctgtccacatttaaaagcaggaaatgggtatgccataggccgatttttctgccctgtgtctgccagaaaaccgtgttacccgctaacttctgcagcctccctagggaagcgctcgctgtgggagacgtagagggcactgtggtggctccgtcctgggatgcagcaggcgctgaagagcctcctgagatgttatttccgctatcaccttcagagctgccctggccctttgtgttggtggaggcaggatcagggaatggaagcccaggcaggtgcaggacccccctggggaagctgttccttaagttccttcagttgggaacttaagttgcctcctgagaatgagctattcccctgagaaggccttgagacaaacctggcagcccaccaagtgggcgggtgacaacacagttaagagggacacaccattgagccaaatggccctcatgttactgcaaccttcagactcactgatcccacctgttcttctttttctataaaagtgagaattagaccccagagtcatgttttctctctcatttcaagcagtttcctgcatgattattccaatgggaacatgaaatgcttgttggcagtttgtccaaagactgctccgtcggagggtacccactgatcatccccatcctggcctctcttcccagctcttctggaactgtctggatccatctctggaattgtctggatctctgtaggtctctgttgttaattgacaccttgtgtcgcacagggacttcagaattggctttgggtggacatcgcctctctccccgacacagctatgttacacaatcatcttatttttacttgacataatttctatagtgagggttttggcagaattaaaaaattaagcccgtgagatgtattactctaatgggtcccatctcacttttagtcaacatgagaatttttaagaaaagcagtcctttctaaaagactggagtgtggtgtgtgtgtgtgtgtgtgtggtgtttgtgtaaccagagtgtttggaaaagtgagtccagttacaggtgtttttacctagcgcaggaaaacatctgtcataatatttgtcaaatctcagagccaaggctgtgcgagtttgggtggtttccaagcagaacaggttgaaagttgatagaaatggaagctgggcctcctggttcaatgggaggctgatgctgccccaaagcgcatctgcccacatctgccctgctcctgcgatcaccccttggacaccagctcagtaacctctctgaagaatcattactggtttcttaggcgctaccgggtaaacattcttctatagagccctgtttacatttgagaacttgctgagctgaaaaccagatagcaaagaagctggtgagtcaacagagctacctcaccctgctacaaaaaagacttggcatgggggattttcccggaatgctccaagtttatccacccatctttgaggggtgtgcatgcaccatgagtggggtagcatagtactaacaccacataaggtcatgttgttcattacaacaaggggaggaaagaaattggcaaggtggcttaatcctgaggcgctggccaggcgcagtggctcatgcctgtaatcccagcaccttgggaggctgaggtgggtggatcacctgaggtcaggagtttgagaccagtctggccaacatggtgaagtagatagagtagagacatggtaggctctactaaaaatataaaaattagctgggtgtggtggtgcacacctgtaatcccagctacttgtgaggctgaggcaggagaattgcttgaacccaggaggcggagactgcagtgagccgagatcgcgccattgcactccagcctgagaaacgagcaaaactcggtctcaaaaaaaaaaaaaaactgtgtctcaaaaaaaaaaaatttaaagactggtatttctctttagaagattctagtagagtgctagattgagagagatgtgagtgaggaacagcactcgggtttaatgcttgcaggtatgcatgttgtctcattttaaagtgctttcaatgtatacagcctttgtagcttcctaatcaccggcttttatttttgctatgaattctttgtcatgggaatcctgcagttgcagggcaggaacctaccgtgttagtctgggatgttgcttctctggtactgttccatatgtttaaggaaatgtcttaatacttcggggcactcctttatctaaataactgctgttctttgcattattgcgcctgaagtcctttgtggactctgaaagcttaatccatgtgaatatggaaaagcatctgcaggatctaagcctgctggaattaggcttttcatcctgacatacctaaaggaagatgagatattcagatgcagccgcttcccagttctgctttgcagtgtaaggtttagtcacccatcctcctgttcctgtgacctctgttgcagtcactttaaatcccagattacacacgcccttccctggcactccccggccccccggcagcatgagcccatctgtgtttcacagtaataaggtaaagaatgcatttgggcttgagctcggaaacctgtttgattcacaaccaaagagtcgtctcaaagccagatctcagtattatcaaagcatcaggtttcagagctggcccttttttgggctaggcatccatggcctaggatcacgtgtggacctttttctgtttatccatgtttaatttgtgtttagctgtgccatggattaacgtttcatcacggtggattaagagtggactgacattgaagcagccttattttgcttctgttacctctcaggaatcagtggcaggggtgggaacagccccttccagagggggaggcagggttcatcctaaaagtaccctggtgcttggaagagggagtataaacctgagcgtcagtgtggaagtaaatcccagttgcagcttgggagggctggatagagcaagccaccggcttcatcagtctaacgagatgtcacatggaacaaagctttagggttttatttagctcctaatccgcatgctgagagagccctggtccatgtgagcacaccagccaggaagggggacctggcaggctggggacagcctcctctccgggactgagctgtaaggaacagacctctctggctatcgttggggagtgaggcaaagttaccgtgagtcttatgttttgtctgctaaggtttcggaggattaataattcaggccatgctttgaaacagaaaacccccagttggttgtccctgccgtctcggaagggttagcacacagccaggtctgtttttgatgtatgtaattgaagatttataaagaaaagcttctcctctgcctcatccgcagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgcaccccctgcaggcaggggtggccttgactaacccgggcccctcaaacccccttcacccaggccccagaacagcctactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtaccagaaggtggcccggcgcacaggggcacccatcatcgtgtccaccatgcttgcaccagaaccaagtaatacatcctccccgcctgccctgcctggggacctggggggagcaggggggtgcggggttgtagaagtttgaacataggatggcaagtcctcactcaccaggccacacacacacacaccaccaaacaagaaggacgcagcactgtggccagttgacacggcttctcttaagttaatcagatttgtgtgtcaggccagatctgctggggcagcagtgccctcctgttctttagttgaggtcgggttgatgtgtagatttcccattacggtggtaaaactcaactgtgtttcttggagaaagtcgcaagtcactcagaacagactgcagccttgagctcacgaggggtggccctttctgtagttcacactagggaactttggagaaggcaggaacgtttcatcaaatgctggctgtaaagtgtgcatcctccatttagaagggcgtgatcgtgtggaaacgtacctctcacgggtccgcacgccgtatcagaggcagtgattacccaccgtggagatgaaaatgtgtgtgtttgcatacttgtgggttaaacaaagcaagatgttgaaatccctcagaactcagtttcaaaaacagatttagtctctcatatcagaaaatacagttgggaattccgcgtgcttgaagggaaggatatatttccaagtccaggaaagggagagtgatggtaggtggttttcttcacaacatgtgccaggtgtgatttatggcgtgtgtttccttggacattgtggatgaagtcctaggtgggcgtcctcagagcaccatttacaatttttattttaactctagagtcttgaccacaaatttaaaatgtaaatcagttttcttcctttcaaacataattctttcctccccgccagcctcccctacgtcattcagaaaacagaatccttttcaaatgatttttttttttcctgaatagcttgtgaaaatcaggatgaaacaataagatctacctttttgaaaatagccctgaagcagctgtaggcggggaccgaggcgctggacctcacaaccctgcagagaccaccttaagtttctctgccatcgctgtgtggcccgtgtgtgctattaatattacctcctagagatgacctccaggcattttgcattttgtttccaagtggagactgagcaactggcctgattttctgctttgtcgtatagattctgattttgtctcatggatttttttgaagtctgatcacatcattatttgactttctcaaatacatgtgcggcaggagggacgtcagataatttttccgagggcctgtgcctgctctctcagtcaaacattctttctttgcaaccaactgatttgcatggcgatgacatttgttgctccagtaatttcatctgataatggccgggcttgcaaagcggatctgaaaacatattccttaattatgtgttgctaagtgacaggagggtttggtcataatcacagaaagattatctcctcacccaagtcgtggaaaggttttgccgaaggaggaacctgtaagattgccttttcttttcttttctttttcctgtttattttagacttgccttttaacaaaaacattcgccattatttgggtatggagtgaggggtattatataagttgtttgcagtgtgattgctaacacgatgttttacagaccggaggatattgatttttacttaatttgcgtggcagcgagccagtgccagggaagtctgcaggcagaagccagccagcaaatcaaatgtctctgttaaatgatccaccccatagctgcagtttccctcctcattccttatcgtatgctgattgtggcattatcccccacaccctgtcgggaagggggcaggggctggcgtccctggtagcgcttcagctgtgtacatggctgtacgttttgtacagtaggttccacagaatccgcagtcacatttggatctgtcggagccagcagggaaagtagacggtgtgtgtgtggaggataatgttgacatttcaggaaagcacaggctgggcagtcccgccggcctctggtccaggacgcggccatctggaaatccagtgttgcttgtttgggacgccgccagcctgaacgcatcttcgttctggtgccgcctaactcaagtgcttccctcccatcggagggacaaggaacgcccttctggaagttgactctcttctccccttcgggatgggcggtgttgcactgcttatagtggggtggtttggggtttggggattgttttcagtatctattttattttcggatgctttggctatttttaatgtatgtttgctttttctcagtccacgaactacctgccttatcttggtgggttttgtgcatacacacaataggctcctatttctagtccagtttgctggccaagcagtccagagtgacaacgtgaggaaggcgtatgctgcggggaccccagtgcggcccaccagccccggtgacacagacaaatgggggctccaggcccgcgtgagtggcagcacctggcaggtggtggggtcggctgtcgctctcaggctgacctggccggctatggcacaagtcgcggagccctccggcggtggctgcgagccagcaatctccccgtgtcacgtgctgtcacccgagccctgcctgcaccagatgcagcagggatcatcagaaacaacgaacgaatggggctgcggccattttcatatctttgtcttcacaaaatacagccaagcctgcagcctgcacagggctcagctcaggacacaccctgggggcaaagtttcagatgtgagaaacgcagtcccagcccaaagagccacaaaaagatctttctgagctttttccattttcttccagccgtttttcttgatgcaactggattaatgggggcacatgtgacccctgtctagttgcttagggtcactgcctgaggactccaggatggagggaggagcgcgtggtctgtgtggaggggctgttgaggaggctgatggttgtgacagttacctgtcaccagagctggtcactctcatggcttcttttcgtgtggcctcggtttccagcaactggaggtgtgaacgctgatctcctaggtagaaagcacctccatcaataattttagccctatcagaatctgtatagagggtcgccgccatcggcccacacccctgctgctgagtcctcaagcagccttgcctcttgtttgagactcctctgcaccttgaggtctgtcctggggcagaggacgcactgctcttgagggtcttgacccttaaaccttcggcaggcttcccccatctcagagcacaaggacatttgggggtgaggtccaggggctgtgaccccaggctggccctgcagaccagcagagggatgagtccagcccttcctgtgtgctggccatgcagtccagccagagagagttgtaagggagcaaggaaacctcttccgggctgcccccaggacccctgagtcctggacacagaccactgccctgggcagagcccagcgtgagcttagaggcttgttcacttcttccttccttcctcattgacctgtcccctgctgttccttccttccttcctcattgacctgtacccctgctgttcttccttctttccatccttcctcattgacctgtcccctgctatgtgccaggcctgtggccagatgtttggggctcccaggtgggcaagacccaaggcttgtgtttaggtgctctctggtctgggggccaggaaaggcaattcataaaaggacagttaactgtgactatgtatagcaggcaccaagatggggcctgtggagcacctggagctccagggcttcttggccactcctatgcttggaagagcgtccctacagcgcatgtgtgtgcaccggcagggaagcaggagaagggcagagctcagcaccgcagccagactggggccaggggagaggccaccgcccaggccggcgtggggcagatggaagtgtgtgcgtgagctgtcgtgtgcaagggcagctaagggcctgactggtgttttgagactccctgtggcgtctcttttcttgcagagtaatctatgcctgcgtagtaaaaacattccagcattgtggagccacatagccaggactctgcccctaccccagcctggtagagcaagaacctcggcatggcctcccttccaaatccaagagcagctgaacggttcccaggtgctgacagctcagccttttctagcaaaacattgaacacacccgacatcagtgagctctgcgggccttccgtttggcttttgtacttgatcagtcattgggtttcatggcccggtgttccctgcattcagtgtgcccctgggcaagtcacctgctactggcctctgtgcctctgaggccctggttgtgactgatgcctgacctcctgagactcccagcccttcttgtgacctcgccagatcaccctccgccttcatggcagaacagcagtgatcatccctcctgcccgttgctgccctgaagtattcgcatcttggttgtgcccccttaccagactgaactcagcgagtgcctgaacctggcctcaccctttgttcatggagctcattctgctaggctagactgggtttcttggtcccctttcaggctcctggacgtgccgtagaccccaggaatatgatttcagcccaggagcataaagtagttgaatgcatggcccgaaggagtgccacctgctttgtgtttgggcaagtatgttgagttctctgtgcttctatttccatgtctgtcaaagggggtaggtcttgaacctgtttcctctgcttctgggagagcagtgagcagagaaggaagagagggcttgtgtgttgaggttggagctgcctggcctcagcggggaatggcgcttttcttgtcgtggttgacccttggcctcttctcacactggactactgaggccctcggggtctcaggggccaaacttgtcccccagctctgccgccttcacagcacttcctctgaccccgtgggtgtggatttcattctgtccatggaggacgtggggtgagccatgccgggacaactagacagcggccaagctgctgaagaaggccctgctgtggtcctcagttttgtgcaaagactgctctcctaggcctctgtcttgttaaagcttagtgggccttttttcaaaagtgagtatctgggaatttctgtaagcccaccttgcatagagtgtgtccccctcgacagcgcagaccccctccacactggtgggtgggtgatctgaccaggagtctggccagagagtaacgtggatgcttggtgtcagctggctggggtcgtgagtctcaggccttgtgcgtaacaggctgggctcctcgccgcatctggagagctccaagggggaagaggtcgacaaatgatttctgccgggcgtggtgcaggactcagagcaggtggtgaatgaggtcggcgcttgctgttggtttaaagggattgacccgtgttttcatgggaggccatgtcagccaagactgctgctgggaccttggccagctctgcccgcgttccagtcaccagaccctcttctgtctgtctccacaaggcccgcgttgactgacctcctcatgtctacaggggcgttctgtcttcctggtttagaaagcagttccacatggagtagggaggtcttggccagcggaccctctgctttccaggaagcaggtcatggggccatagcttcagtttctagataatagttttgtgtggctgtgctgtccccatcccatccccccaacccccacccagtgctgtgagaaccacatcacacctggaactctgtgcatggccaagctcagggcctcctaaacccctccagggattgttgctcctctgaaatctttaaaagctgttgatcttggccaaggtatggttcctattttcctggaaggtttgcggagccaagggcataagtacctgagcagattccacagaccaggtgagtggccccatgttcacctggccataaaaacaaccaatgggcccctacgctattttgctttaactctactttcaaatgtggcctttgctcttgagtgtccagtgtccatcctggggctccacaagtcacatttcagctctgtcaacctcagtgcttgagttgagggtcttcctgggtcatggggcccaggctttttggtgtcaggcacacagtttggaaatagttctcccccattctgtggttgttttttcaatttcttgatagtgtccttgaagcatgaaagttttaatttggagtcttacgtatttgcttatgccgttggtgtgacatctaagaaaccattgcttaatcgagggtcatgaagatatattcttatgttgtcctccaggaatgttagttttagctctgacattgaggtcttgatctgctttgagtaaagttctgcatatggtgtgaggtaggggtcccattcagccagttgtcccagtgtttgctttgtgctttgcagaagctgagctgtggagagctgggctgggtagagcaaaattagagcttcacgccagacttcttgcatttggaaactaacattctaaggaagaaagacgtggtttttttttttaagtgagaaagccaacatatattaacaggaaagcttttcaggtgtttggcacaaatttatttacccccaagaacatacgaagccagaattctaaagctttttcacagattccttgctcatacgtgggagaggtttttttggtaagtttatgaaagagaaatagtacttgtaatccataactaattagcccacgttagcgatgtagaaacgagtgtgattaaacgtgcagttgtcaggtgtgtgtttcccactctgaggctggcttcaacaaagggctttctagttgttttttacataaaggataaaaaaactagccttcgttcacttttcttgccccctccagtgggagggaggaactgctgaaggaacaggaaggtacactgtagttaaatttagcccaacagcagctttcagcatgtgaataaaacaacttttgccaaattgttaggagagcaaaaaatccaacctagaaacacccgtccccactgacagagtgggcggccccctgggacatgttctcctgagagccatggagaaattcatcccaggagggtttgcaaatgtcaatgggacatggggcagcctgtggctgagttagcaccctgggtgtgcttcaccagaaggggcaagagtaggaaccctgattcctggtcccccaatgcagttgtgtgggatgccagtggcgttggcggggagcgcgtcctgcaataccagctagatatgaacacggtgcctccgcagggctggtggggtgcacctaccccaggtggcccatggaatgtgcctcttgcccctttgccagggccgaggtaggggaaaccagccttgagagaatctagggccctgactgagttcagtaaatattagtaattgtcactattgtggagtttgtttgtttgtttgtttgtttgtttgtttgttggttggtttggtttggtctggtgctttttttggtttttggtttttggtttgtttttgtttttttgagacagagtcttgctctgtcacccaggctggagtgcagtggaacaatctcggctcactgcaacctctgcttcccaagaagctgagaccacaggtgcccactaccatacctggttaatttttgtattagtagagatgggatttctccatgttggccaggctggtctcaaactcctgacctcaggtgatccccccgcctcagcctcccaaagtgttgggattacaggcgtgagccactgcacctggcctattgtggagcatttgacaaggatgatcccccatctgaaatcccaggaagactctggacatttttcctctgacagactcagagaggttcaccccctaccctgagtcccacagcagggggtggcccatgccatgatgatcctcaggcacggtgcattagcacagcaagggaaaatcaacaatggtatacacttggggaggagacaccagtccgagctggaagccaaggtctgtgtcagcaagaggaaacaggacaaagtggctgggctctggagcaagagtcatgacgggctctggagcagcagtcatcatgatgggctctgaggctcgcttcccatgggtaacactggggtgatggtgcccaccctacctgccccccacggctctgagaaccgcatcacaccggagctgtgtgcatggcaagctcagggtccccagctggctccacgagcacctgctggtgtttgcctggctccagctgctgccctcaagaccatgctgcatctgagctgctccgactgcggggccaaactccttgccctggatcatgctgctgcctgggagagttcagggaattaattctcccagtgaagagcaaatgccattcttttgtgtgattaaatggaatgtaaaatgttctttggtcataagaggatttaagctggctgttgggaacagctgtaacacacacaagggtaaagttttaataaatggaaaagtaaatgtaggaaaaggtgagggagggtggtagggccggaacacagcatcccgtgcaatcctgtacacaaggataggtgggaattctgctctgagcttcctagcaaccaaagaaagagggaaactgatcacatagaagaatcacactgcatgtaagatgggaccgatgaacccgttgctcagaagcagaggtgagtttctcctgcctttatcgcctctccaaagaagcggcatcagcgctggtttgcagtttgctttctggcattacctccctgctcctcagcctgcaccttcctccgctacccgtcgacagcctcctgcgtgtcaccttctgatttcaccagggcctcatcctggttgaagttgttaagctcttcttgcactttggctggatacagtcagctgttctttggcgctgacttcccccggggttcctacctcctcttctggccctgcctcattaagggattgcattaagggatttttcgtggtggaaggaagctctgcctgcggaactgaatgttggcaccaactgcccagcgcaggccagtccattccccttccatccacagtgcttagagctgacctctggcctctcaacccaacacgtttccccactggggatttgcctattagatgctttttatatgaaggaataaatatgcctttgtgatgggttctagtgttttcctgtaaactgggctctgagcctgggatgctgtagaagttactagattttaagaaaaagttagagaagaaagaagagtggaggcggcatccagccagctgttgtgctgagaatgttcacttcctggctgtgagctgggcctgggcgcagcgctcttggcccttggcctgccggacagcagtcctcgcggatcactttcctcttgggttttaggaccactcgaaaaacgagagtgtgctgcaagcatgaggcttctccctctcccatctcagccttggctgccatagctaaggaggagggtgttattttgcttttgtggacattcaccctgggaaataaggtgagaaaattaagactgggtctgccaggctacaggctactcagggtccttttgcgggaggacgtgttgttcatttctctggaacactggtggaattggtccatctgattccaagggacaagccagcagccagggcggccatccagagggctcctggtcccggcactcatgggcagccatcccctcgggcagtgactcagtggtggcccctggaacttggcagtggcactcggctcgctgcaggttcatggaacatccagggcgtttgccctcctggttgctgctacttcctgtaccttggaggaaaagtcccttggggcactgggaagggtgggcggggcctcatggccttcctcagcctgatcgggacccaccaaagggtcccagaccccagtctcactgcaccctgaccatccccttccccgtcaccccgggtggtgccagagcctttttgtgaggtgcagggatccgggtacccagcgcacagtaggcgttctcaaactttcacacagtgagaagtcagactgagccatccatctctgggttgcctgtggcctttttagattcctgcagaatctcacccagccccgtgtgtgtccacactggacacgctgccagcccagcacccagcctcttgtgcggccggcgagtgagtgtgcagcagctggccgctctgccagattcctctggcaacaattcgtacttttctcttctctattttcccttatttttctcaaacatccccttctgttgttgtcaggggcacatttttagaacttgagagctgttcacccaacacctccaccagcggtatccacacagcgggcgggcgaggcgccttcttggaagtgcttcggggagcactgaggccagcccatccctcctcagcctcgagccagagggagtcctctagggtttgggctgcatgggcttccgggacgccctcccaactgcaagaccgggagtggacggagggagccctgggagcccggctgtggccccagcgaggcaggggaggatggccaggccacaccagggaccgcacagcaaaggctctgtttcaaaaacagacgtcacgtttcctgcttgtggcctgtggggttgtcactgattttttgcattgatatgaaaaccagcagtgcttcttttccatctgggccatggctcttctggggacagtgcaggactcgaagagaagctaatggccttgcttgggtggggatgactagttttttcttttgtgttggtcacttgctggcaagcgggttttcccacctcactggctggttgtccagcagcgtgaatccgctgcctgagaagtgagtctccaaacaatcacagcgggactgaccacgcaggtttccccattactgcgctatgaagctccctcgggctccggtcactcagacctaatgtcgaggaacgtggagcacatttttttcctctacccaaggaagcagatgtgtggtagctggtaaacatcctccacaccgcagagtatcttctaggaaaactgcctggtacggggagcttgggttgacgaacgctcacttttcttggtttttattcgcttggaggtgagatctgatgattggcccttctctctggttattgctgaaaaggacagaagggcgtccctgccggccaaggcggctgctggtggctcaacctggagagcctggattctgagcagccgtggtcactggtcttgtccaccacggctcagaactgggtgaaactcagctccccaaactcattcttcccgagactttaggggaagtgcttccttccaagtcagtgctttctggagggctggtgttcccgtctcggcaagttctgcctggccagaggcctacgggctcaggcatctgaggcacagggcatttgggccatttgccaggaggccgccaagaggttgctccccgtaaggaaggtcaacctcgtgtgcattgaatcttgcattaaccctcttagaggccagtgttaagggccaagttgacatagatccatttcttggatcaggtgtttgttttttcagttaattttttagagccaagtctcactctgtcacccaggctgaagtgcagtggcacactcatagctcactgcagccttgaactcctgggctcaagggatccacctgcctcagcctcctaagtagctgggactacaggcacgtggcaccacgcccagtaaattttgtagagatgggatttcactgtgtcgtccaggttaggacaaggtttcttatcaccggggccatgaatgcctgctgggccaataggacaccgtgaggaggaccgtgtgtccctgcatccagcttggggagtggggccagcacacacgtgttactatcctgtggcgtctcggtcttgcttggatgtgcccttctgttctccgccgttctgataacagttaccatgatgacgtctcttttaggctgcaagatctagagagacacccgggtgggaagagcgcatgcctcacgtgagaagcctcaggcccttggttcttgattttgtgtgcctggttgatagatcgaacaatcacattcctgcagtaaaagagagagaactttaagacctacctcagcctgccgaggcaagatcacctgtctgtttcctagggccaggcctgatgatgtctgtctttccagtgtccagagcttgttgagttgaaccaatccagcaggtggtttgcactgcggtggaccctggggttgcatgcttggtctctggtgtcagagagacctgagtttgagtcctgactccatcacttacttgctgtgtgaccccgggcaagttccccccgcctccgttacctgctggggaaacagcagcgcctacggcacagggttgtgtggagggtgcaagagaagtggccgtgaccatccttctaaatgggacaggctgtattccatggtcatgatgctcagcatatggtataaggagctaactgtttaccatccctttgttaccagaaacttgactccctgtgtgtttgggttcttggtgcataggtgattttattgctgcaataaagtattgaaaaccaattaagtaaaagaggctgacggcagcggtgcccgcacgagactattttacaacttcgggcgtttccagtctcaggtatttccccagcttccaggcacatcctgggaaagtctagtctgtgtctaattactgtggcacagaatgcaccctgcccacatgggatatgtaaagtaggggtatcccaggcggccccttggctacaggcagctggttttcattacaggtgaggctgagcagatggtgggcattcttggtggtctttccaacaggctccagaccacctcacaactcggagcttgggcctttgaactgagaatctcatagtttaggagctgtgggctggaaccacatgctggcagctgccaccctcgagacagaaggcccatcgccatagtcatagcattctttgctgctggctggcagcttggagaggcgaggtgggcacctcccaaggaggaatgagttaggtggaccagccagtcctggttttgacgactgagttcaccagggtgaacagatagtcatatgggagcccctttttgtccttggcaggtttgtgcttcttttggccgggcgcggtggctcatgcctgtaatcccagcactttgggaggccgaggcgggcggatcacctgagttcagaagtttgagacctgcttggccaacttggtgaaaccccatctggaaggctgaggcaggagaatcacgtgagcccaggaggcggaggttgcagtgagccgagatcgcgccactgcactccagcctggacaacagcgtgagactccatctcaaaacaacaacaacaacaatttttagtctttggcgatgccctgaggctcatctcttccacagaggcttggaggatcggccacacgagtggggtatgcagaggcacaggcaggtgggggagtgagaaccccagggcgcatctgaccttggcgtgccggcaggaagagaacaagcagtcctcctggaagattccaccagaactgtttattggacaggggactcagacgatgtgtgtccccagccacagtggtggctgagagtgtccctatcctgtgcatgagatcctgaccacccgtccctgcagggaccgtccccgtgttgggaagcaggagggtatgtcgcagagcctcacccagtgggagccacaatccttattccttgctcctcaggcttggatgttgctccggcttctatcccccacatcctgtcctccctcccggagcccagggaccacccatgtgaggctgggccactggggaaatctcgcacacgtagcgcgtctcaccagaaatagaagcagagcctcacgtccttggctgcttcgctgtgggaatgccttctaaggcgccgtttttggtgatgtcccttcacggatctttcaggcccagtgagtcagcagtgtctgcattcacacaggctgggtggggttgttggatctgccccgggtggatggcacctgctccctcagggcaaaaattcaccccagaacatgagctgcacccggggttaggtgaaggtgacggagcctgaacactcaacaccagaggcagccaacaggacggtgtctgggcttccaaaaagccaccagtgcctaaaaacactttcaagcacctaacatcactcttggttttgtttttattttaaactccattacaaaccgggaaatagctgtcactttcctgtgttctgggcccgctgtgctcctccgttccgcatagcgcggacactgcagggtgcgggctgcagcttccccaggggctctgaggaacccgttgaagtgactgcacgtgcttgtctttctagggttgcagatgagcttcgttttcaggggggtttgtattttgtgttttttctgaacttgatggtgtgggtctggacatctctttccaaccctggaagataccacacatgctcttcgttattaacatgatcacccagaaagcttttgggggcctgagaacatggcccaggctctggggagcatcagactgcacctgactggctggataaagacaggggtacctggagcctcctgcctcgccagctctgtgtccagctgtcacctgagctacaagggagattacctgggagcctctcatgtgtcacatcgtgactcattcagatacatgttttatttaagaagcaaatctatttatcagggtgttcctgtggccatttcttcaccaaacctccagctgactttgcagagaatgccaaactcagaagccgaggagtagcttaaaactaggttccccatggggcacatccagccttctggggagcccacttggtgtggggcaccccaaacagcacagcccctgggtgctcagaggccttggtgaagctagatttcccaacactcgattttttccctccttacagaaaagcagggggaacttgagggataattcacatgaaacctttgccataaacccttttaaattgttcacaagtaagagcccaactttggaagattaagatcctggcgtttttagtgtgaggagtgggctggctgaatatgctgcagattgtgagctttttcctacctggttgtacctcactggaggaaaaataaggataatccctatagctgctaaggatgtacacggtgatggcacagccatcaccgctttctaagtttagaaggtgtgcttcatgctttaaattccccggcactcattttgtaccacgctgctctctcattctctcctcatgctgtcttccagtgcctggttcaggccagtccttgtccaaggttgagttaaatcattttcagctgggccaggtcttcaacagcttggtgtgtgtgatgccactccagggctgaggtcctggcttcaggaagaatgtggggatcgattagtgatgtctgccatgaatgcagaaagagagataagggttgcgcatttgcattgcatggtgggaggaggagtgtgcacatgagccagggaatctgttgggcgtgtcaggtgatacttaaaactcaaggattgggttctccattctgggggagcacatactacctatacattactgagactgtaaaatgaaatcgcagcctctgggaagctgggcaaagaagtggacgcagcattgggagagcttcccagaagcaacacagagagaaagcccatttgccaaatgaaaaagcagataacaacgtagaaacaaagctgagatttccaatagcagttgctttttttttttttttttttttttaaccttaaaatagtgccactcttagcaacacagattttcttccaaattatgccttgaagctgctcccggagccacccgctcatcagcaccctgctcctgtggtccttctcgtgaaaggcagaggggagatgcctgttgcccgcagtcttctctgcagctgccgtgggaacaggcaccttcccggctgctggggacacaaggagggggagtcaccgtggcttgctcactttccagatcagccaactgcagaacatttgttgttgtttagatcccacgtctgacggtttagaacagcttttataacatggttaaacatgtttacaaagcaagggagacatctcttaccttgacaacacgaggctcccacagaccgccttcccccactcagagctccacagccctgtgtgctgggctggcctgtagacccactgaggcagctgtgtttacaagtctaacgccaagtgtctgagaggcacttgcgtacgtcccagcatcagaatctggcccccagcttggccctgtcacgattttcagttttatgttgtagaaacccaagcctctgaaataacactgttagcaggccttagttctgattctgtgtctggctttctagaaatcaggtctgctgagctcagccagtggggatcgggtcatgctggattgcagaaagcggccacttaattggggagcaggccgcatttaagaggaagcttttctgagggtggtgggatcggtgggatattaagtggggcttccttggaggcaggcggggcctcaggttcggctgtgttgggtcactccctgtcccgccccggcctctggagtttgtgtggttttgtctcctctttcttcctggatcattgtgcatgaggctgggagccacaccggctgcttaggctcctcctgcctcccaggccacctgcaggtcacaggggctgatgaagccgtgaatcgcttggctctgtttggaatgctcgttccccggtgccataaagaaatagcacttgaacataaatttaatttacttagtaaggccatttttactttctgcagaaagggtacactctccagcagttttcccacgagagttcacccaacaaaggacacagggtcatttataacctgacacgtccaccctaccgctgtgtccagtttccgttggctggaaagggacctcacattctctatttgtcccgattggctagcaacttagaacttttttaaagaggcaaaggtagaggggaacaaaggaaggaggaagtaacttgtggaatgttgagaaaggtaaaaacaccttcaaataaggaagaggaacaggctatgacctaatgcttgcttggaccagtataagcatgctaaggcaaatatttaggctaaattgcgggagctaagaacataacgtacattgatttccttattacggctagcaaatatttaagaatgttagcacagatctttgaataaattttgcctctaagagaagttagtatttattcctaattagacggggaggaaagtctttgaagaggaacctctgctttactctgtacagctcggagctgcttgcagcactctgacaccttctgtcgggatctttggaagacctgcctggatctcccgtctgtggaaggatccaggtacttcttacaacatctgtgttagggcagctggtgacggcacccggcaaattccagcaactgccctcattccacagaggctccctcctgcaaggccactactgtgactctgagcagcggttcttctcatgaatgtgatagctcggtcagctctaagactgcaacctgcagggacttcatggggcaaccctggggtatgtggccagtgtctgtccttgggcagccgtagcccctgtcaggaacagggagtgactcaggcactggtgtcttgagactgctacggtgtcaggaaacttccataaaatctagtgcgttttaaaaaaagaggccagagccggccaggcacggtggcttattgcctgtaatcccagcattttgggagaccgaggcaggtggatcacctgaggtcaggggttcgaagccagcctggccaacatcgcgaaaccctgtctctgctaaaaatacaaaattagccaggcatggtggcacatgcctgtagtctcagctatttgggaggctaaggcaggagaatcacttgaacctgggaggtggaggttgcagtgagcggagatcgtgccactgcattccagcctgggcaacaaaagtgaaactctgtctccaaaaaaaaaaaagccagagccagcctttgcctcctatgtcagaaatgatcatttgcagctgctttgctttggggtagaagcctcaaatcctgaaaccctttaccctggggcaggttgtcttgtgctgtaagcaacagaaacccatttagatcatttttaaataatgagaatttctgttggaaggatgtcggcttagctcacacagtgtctaggaagactggaaaatgggtctcagaaacactgcaggcagctttgtgtggcaggatcaatccagttccttcttggtgactgctcaggggaacatcccatttgccttgcatggtactgagccagaaggtcaactccaggcctgtctgcctgtatccgagaaagcagcagctccccacaatgaaatgtagcgttttccagctccggatccttccgccatcctccctgagatctacctgccttaggatctgtgagatccacgcactttgcttttcctgggtgtctggttactgttcacaaaagtccagcagtttggcctggtgttgtctttgtttttgactgagcatctctcatttcacaagtatttattgcagctgcagctctaagcaataccaggcccagggatgggcgtcagcactgccttgagctggtgcacagcacatcccggacggaggggcagggccgtcctggtgcacacgcaagcctgaaaccagatagtaattgataccaggggagccggcagggctttctgctctacacagttaatgtgggcaagctgtcaacagtaaggcactgatgtcatttccgtgatgtgtccagttgcagctggaattgtcctgaaatggacaaggcaggtttactggcgggagacggtagaaaggaaaaatagcgcatagagggcaccagggccctgtgaccctcgtccgcaagtgtctcctcatacctcgtggttgcgcaccgtggtacggggccaccctgagcgctgactcccgggctgtgaagtgggaagaacagcagcactgcaggactcttgtcagccttgtggtctgtacgcatggaaaaggccgtcagctgtgcatagcaactggaagccatggctttttagcataaagcccagttcttcggaagccctcattacgtactgcgccttgggctttctcctcgcaaattcccaatcctgccccactgggcctggggaccccacgtccctgaaagggtcgtgttccatcttaatgtatatgaatcttactctgtgtgtcagttacatcctaataggttaaaaacttgctcaaatggtcagaagcctgaaagaggcgtcaggaatcctgtgtgaggtaagatgggggatctgtttgcaccttcatctctccatatgagatcttccatatgagctcttccagaaacctctgccccaggctccagcaagcctgtagggcagcggctgctaggcaagggcttgaatttcagtccagattctctggtgtgtgggtggacagtttccttctgggactgaaggagcacttggaagatggtgctttcccttctagagcaaaccttggcattgtcccagctaagctctcatgcccagggcttgggggtctcctgtggcctccatatccctgcacctcatgcagggcacgcaagcatcccacccactcccaaccccccacctccagccgtcgtgcccggcatcttttcccagcatgagaacccgttggcttttctcttttcccgccttgccatgaaggacctgctgccaggattcgagcctcagaccttggacaggtctcgggccagcctcagccacgttctgcgtgcccggccatcagggagggtagagggtgggtttcaccaaggagaaaggcaacccgtgtcggggagggagccgatcgctaggcaacctggagtttgttaccctggtaacggatccatgcactgatgatgctgcggatggacatcttgtgacaatggcctctcaggctccccagacgcatcagcggctctggattcccaccttgcgcccagcgtggttttcctgtgtggctaccatttaacgaacagcttggatttcttataatcaggcactctctccgataaccatcctgccagcacccctgaaagtgaagttggggtgttcctcactgtgtgtgggcgaccgcctggggcatgagaccaggacttccaggccccacagggttgtgcgctcagacctcaagtaggggccagaagagtgtactgaaacagaaggaatcttgtggaatttggcagttgtaccattttcttagcagaaaacaggagcccaggtgggagccatgtgtgtcgggttcctcgtcaggtgacggtgctgttgcggatctcgcggatgagctgagggggtatccagctttgtgctgcacgcttcctgtccactcatacaggtcgtgggctggtgaggacacgggggtgttggccctcgtccctgccttattttccccctcccctgccctgttttcctggtgcagaaggatgttggagtgcggatccatgcggacaccctgtttggggacctgggtgtcggggcagcagcaggagtgactgggtgcacgtgtgcctttggtgtctgagcgtcaggtgcagctgccgctcagggctgagaggggccatgatttctcccagccgggggtggcaggagaactgcacttagcttgggggccatgcggggctggctgtggacctggctaccccagcccattcttctgaggctgggacaaaagccttttttgtactttgtgctcaaagagacaattatcccaagtcccactggccgagcacggccttccatgcagggctggtgcaggtgctctgggccgtccctccccagcaccgtgtatagtcttaacaggatgcagtcacggccccagtggagggggatttccttcctcgtctccgagcgtgtggctaacggaatatgagccttggtggtccagcaggagcccccccgtggctggggtcccagtcatcgtccccaccaagtggccagcttggggactactaagagcccttgaggaggttagggatggaaggcgaggccacacagatgaagttggcctttgtggaaggctcctgcttttgcctgtgggaccctgagcctgctgccttgtgctcaaaggccagtgatcccgggaatgtcacaccttcctggttgggttacccatggtgggtcaccaggctgggctcagcctggagcaatggcctggaccgtccagcctcagagggagggaggggatggggatgtaaggccgccgtcagggttgatctggatatctgaaaacttgatgagccccaaagttttaatctgaggctaaagagttctaatttgacaagagacattgccccttcctggcatctcggcggattgcacctctggaactcaggtagttgttctcttgtgtccagggtgtgggtcttgaagatgtgaggtttgggcagatggtcaggaggacctacgaaatccaaggatggatttgaagggggcagtttttgttggagaaaatgctgcttctctgtctctgaggtcttcggagcctgctgggtttgctgcacagaataaagagagaaaagaggccctgaggctctcgctgcatcctgggcgggccccgcagggtgtctgccctgtatgtgcacggggcgcaagcatgcgcgtctgtagtgtggcaggtaaggccttccaccaccctgctgaacgtctagatgcagccgcgctggtccagatgaagttgctagagaatttgtacttggacttgtgggaaggaccactggggcccttcctggggtcacccctgcccctctgtcctcacagctgtcccttcaccttgttggcagcaccaggaaatctgtcaggattaatatgatggctctggcctgtctagagagctgcttgctgtgtggtcctttgagaagtttgctctcctgagcccctagaggcctcctgccctcaggcataccttccctgccccagacccgccatttctcctcacccagcgcaggtgagaggggctggaggagcctgcccaggccgcctgtttgtgcagggcctgtccaggaagttcctttggacgcacacgccttatcccctgtcatagtgtgtgaggggcagctggtgccggtgcaggcagggaggcacgcggtgcagggacccgtcctgtgctggactagcctgtgctggcctcggggccccatggtcctgaggctctcgggactatggtctgctggcagggaagcagccgtgtgcgtctccagccagagccgcaagtggatgggaagtggctcctcttcgtgtcagtggctccctggaaggtgatgcaggtggaggcggtgccctcgctgctccgccaccctcgcttgcccaagccctgccctgagtgatgagtggggagctgcccctccacgcaccctgtggccccagccacccacccactgtgctcaccccttccctcctggcaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggtgggcccaccctgcccggccggggcctgcactgaccttgggcagtttcctccccagcatccccccattagatcgccccaagtcaccggcaggccccagaacccctgttccctgctttcctgctgaactcctctgcctcaggttcaagggtgatagggccagggggccaggccaagtggtgccggtgggctgcacggggtggggctccgaccctgtgctctgttcccacgcaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggtgagtgcgaggcagcgctggctgcctggagttgtccggagctctgtgggccctgctcgggtgggcttggagaagcagctggaactgggaccacggagcagccgcttctggctgtagcaaggtggctgcctccaggccgggctgtggagcaccttgcggccctgccttcacatgacacaggtaggatagtccctgctggcccttgtgtggggtctgcggggctgtgaggcatctctgccctcagagcaacacccagctggcacaggctcaatttggagacacccagtgccgcctccagaggggagaatgcgactggccacatgtcctctaaaccacccctgctgggtgcgtcccctaaatgacccctgccgtgtgtgtcccctaaactgcccctgccgtgtgcacagctctaggcccctgtccacatgggaacctgggcctcccgttctgggagggcagccttagcagcatgtggtccaggtcagcaccaaagcaggtgggcccctgcccaacacagttgatgacagaggcttccgaagaaaagcagaggcagcaggcgggaacccagagttgggggcttcaaagctgcttatcggccccatgcacttgcggctgggggtgcatgttgaggggggcctctgcccagcaccccgtgtgagctcgtgagtgctgagtgcagaggcacaagaagcagaccgctggcatcgagcgtcctcgggagagggccaggtgggcactgtgcttgctctgtgtttggaacacgccacccctgcattttgggggtgggggctgtactctgccttacgagtgctgaggtgccccaaattcatgaggcaccatgaattccaaggcagcagcctggccttggaacagctcttcctgtgctccaggaatagcccaggcgctatttccccacctctctcccatcggctaaggccccagtgggccccggtgcttccgggacgggctgggtgtcagatgggctctgtgtgtgagcggagtgttacatacatctgagaatcctgctctcgggcaccaccggccacgttttcagggaggccacccccatgggctccagctgtctctccacagccttagcctggggcatggagtgtatgggtcagaatcttagttgaatccttcacggccagtcggggcagcacccaggtaccggaagcactgggtgggtcttggtgtcaggagcagggctggggagccgggcgagcagggagctgcccgtacactcacaggggtcaggacgcagtggggtggggctgccccacgggcaaatcccaaagcaaaaggccagggaaggagagagagtcactcagattccacaccccttagggtcctggaagcagcagcttcacacatccacccctcaccctccccacacccctcacttgctaccagccacggcgtccttccgagcccctctgttggaacaaagacactccagaagatgtgagtcttcaaaggcgtgtttaatataaactaaaattttccatctttccctggcacaaacaaggatatttttgtttgaaaacaaatgtcctttgtgctctgggtagagctgaaatcccaagtttcaacagcagaggagaatacagcttcatgtgccaggggctctcaaatccttgtcccccgcacctcttgcttctccagcacgtcggcccctcaccacacagctcccaggcccatacgggtgctgaccctgcccttcctcggctggaccagacgctgctttccagggagagaggggaggtccttgcctgtggaacttcctatttctccatttctagaagtgccccgcacaggcagtggggccagaaaggcaccaaggcctcaatgacagggggcctgggagggccgagatgggaggttgtgttccctgagttctgagacccacagaagacgaccaggaccagggactgcggttttggaaaatgtagaagggctgtgagtggtggattttcattgatcctggtcccatctgataagggcgcttggaagacatctgcggggcccttttaaagggcacttttcgaatgtagactctggaggcggaaaatgagcctctgtccagacgtcctttgtctccgaatgcatattccccacatcatgcggtcaacgggccttttgtgctgagggctgggagcggcaggtggctgcaggcaggccctctcctgatgaaagagggtccctcgcaggcccagaaaacaaggccctccatgttgcacgaggcagcacactaggcctctggtgacaccttctgggatcgcaaggctctgagctgtcagccctggaatgacaggcgagagtcagcgcttcacggcaagagcagggcaaggcttgaggaagctgctcacctgcacttctccccacgagccgggaagacctcgagagggccctacacccctccccacccccgccgcctctagcaagctggtttatgtggtttccttgccagcggcagtcatgaagggattaaagcacgatggcactgaccgtgagagaaaagcagcttgcctctttggggccgttttccaggctccgtggatgctgggaggcccagcctgcgagtatcagagccacccatcgtgtggcacttgaaggatcagcttgactcatccagaagggaggctgcatccacagagcgatagaggacagctaagaagatgctccctccgagagagcggtgagggttatggaggttcctggcagtggcgccgccgcggtctgggtgggaaggttctgccatcccaggcagtggctgcagctcttcctcctgcaccatctccccgtcctgggactctgcactccggtgagcagtggaaccacggagctgaatgtccaagttcggtgagaagactgaccagatgtcctgcctcaacctgcctttttgtgccacccacccacccgggtgcctttacacacgtggccttgtggggtctcccagccagcatcagctcatctcctaggaggaggtgctgctgttgacgccaggcagcactgccgagccagccccggcagcagcacggagccagcgtccttgagggtgattctgctgcggggcctccctgctgggctttagcctgcccgaggaatgaaaattgtcccagccgccaaagattttcttgaacctctggcatcagcctcagtctgtctgacttaataataacatggcatgtgatcaagccccagcttctctgctgagctatttcaaatgaatgaggccagtttcctgcaagattcctggcatccagctcgtgggaaagttggtcggcctcagtcaccgtcaaccacactggtcccttggcaggggtcggtggcccagaggagccctcagtggccacgttgggtgggtgggtgacctgctcacagtggcttcaccttctctgagctgtgtgtcttgctaagcgggtcactctcaaggccctagacctaggggtggcccttgtggggagacagccacgcagccatctagaaagtgggtttgtggcacccactggtcttgtttcctgtccagtagagccgaagaagctgccttggtgattgccgtccccaccccaatctgtccccaccccaatcttcaggacttaagatagaggaatcctgggctgccttaaaggtggccctgtcccagtgccttgggcaccccttgctgggagagacactctcctaagggtcccaaagctgggattaggagggaaccatttcacttgggctgacgtgatgcccagatagccacacccctcctcagagagctcaactgggagccacaggctggctgctgagcccaccctctggggccccgcccctggctcggcccctctggtctctgctgcaagcaggcctctggatctccacctgtcgggtgtagggaggggccgttcccagcctggccctctgcctacttgcacccctgttgtatctggcagtcattcattcttccccagacaccctctggctgaggagggtaaatggcagggccctttctgcctatgacttgggttaactctccatgccacagctgctttgtgctgggagatacttgaccctggtctctgcagctcgtgtggggccagagggctcaccccaagccaccctcggccctgacctgaaggctgctccacggggcagggagggcatcctgtctgctctgagttcttcccagcagagcagggtgctgagcacatgaccacagggcgattgtgcacacgcttcggccatcggttccgttcccggggccagcccttgcatccgtgtgggggtggaggtgtttttttaaaaccagtatgtttaaaacgtatgttttttgcatcaaactgttagcatagcttaaaaccaaaagccattctttgtcaccctgccagctccatgagggagaccctgaggggtttgaggctgagtggggtccacttggaggagtctggtctgaggcccactggcttcctgccactccgggtcctttcttgggactcagtgcaagcccaggaggaagccagtcaggcccaaaatcagccataggagttgggttggtcatgagccacgtcctggagcaaaagtcctccttgggagggaggggtagatgttggggctagagcttcccatgcatcagagccagagggcctaccgcccacgtgcccagccccgcgtctgctagacgataaggtgggcctcccccggtgccaacaaccgtgtctcaggagggcgggctgggagccctggggcttccccactgatcttgaggttttctcatctccggccttggcctcatccctttcaggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtacgtgccaccctctgcgctgacccccaacccctccgacactggggctggtgtagtggggacccctcgggaaaggcaaccccagcctgctcttgaggagccagggcaggcagggccagcaccctccccgtgttgcacggggtaggagatcggagtcaagacccatcaggcaactcaccctagaggcaggatctgggctggttctggaagaatgcgtgtccactgctgtctgtagtgtctggcaggacagcattctttgctgtggggcagcgggcaaggcgctgtgcccagtaaatttccctgggcaggggtgaagggcaggggctgtatggaggtgtgtcgtaaagcagcagccaggcttggggctcgtgtaggggctggcgtagggttcagtggagacgcgggttatggacatggcctcactcctgaaggccttcaaatgccaggttggggtggcacagtcaggccatcagcttggaaagctctcctgagagaggggcaggaaaaggagacgtgaggagaggcccaggagggtcttcagcagggtggtaggggccggtgccacggagaaggtgatggtaagcagcctgattccatgggggctcgaggaggtccccaccctgctcaccatcagggtccacaccacacccaggagacctcggcccgttgccactgaatctcaaccccaccgcttaccagctctgtggccttgtgggaattacctgagctttttgcctcaatttcccaatctgtaagtagatatttggtgggatacgtggtatctgccttttgggactccaagaaggcgcatgtgcacacggggccagtaatgttctggcctccgggagactcccagctgctgctcagcccttgcttggagctccgcgcctccgaggacgaagcccccgtgctcctctccccacaagccccgctctggacctggggtgccacttgaacaagagagaagttgctggacgcttccaggagtgcacacctttctgtccccgctacaggctgtgatctcctgggtctggcctcgcccgacgcctggagtctgagttgaagtgtcgggtgctggggatcttctgaaaggacccaccgtgttttgactttgttggaaaacagatgtggtgtgtgaacaccaggctccctctgtccgggccccactgggcctcatggctcggagatgcagcttcatctccatctctgaagcccctcctggggcctcggtggtctctggccaggctgcagagcctgggggtggtcatgagcaccctgggtacacggtggggcctcactggggaggtgcttgtttcaggggcttctgactccagccgtcacgggacttcttcctggggtcgttcctgtagctgtgcccttgtcattcaactttaaaaaccctctcggtgtatagaggtcagtgcagccccctgccgccgccctgttttctcgagactgtacactaacccctgccgccaccaccctggatcctcagcacagggactgtcgtgctctccttgttccctttccaggtgtctctgtagccttcaggactgtcgctgctgcagccatcctgggctaagagcttttgctggcctcgggttctactgagcaagagtcccccaggcccagcgggctcagtgcagcaggcggggtgggacggtgccgccaagagagggcagcctggggctgggggcatggacagaaactgaaggaaaggcagcctgtgggagctgcgcttttaaaataagcggcatggggggccggggggggcgctgtgacgggggagcaggtctcttctgtagggactgggttttgattaagtcagtagcaggattaagtcattgggtcatcagaaaatctcatggataaagttcaaggggtttgtgaactttaaaaaaaaaaaaaaaaaaaacaaagaaatagccgtcggcacggttcaaatctgggcttggtgctctgggctgcttttccacaggccctccaggccctggatctgcagagtgtgagccccactgattgaagcatgttcgtgcacagacgccatgagggggatggaggctgcaggaacgggggaaggcaggcgggggtcctgtgaagtgtgagctcccagcagttgcatgctggggtcctcagtttcatgttgccagtgcgtcagagagccatctctcactccgtccctgccaccgtccagtcctgcctgctgtaaagggtgacactgaggaggagaggcgtgatggttcgtgccttgctatactagttgtcctgcagctgtccctgatcagactggccttattcaacctttgttctaaactacggcagttgtcctagccaggccatcggttagatggagctgctgcaggaggagccatccagcattgaggtacccctggaacacaggctgcctgctcggaaatgcgcatctttgtccttctcctgcctgcaccttggagccatggctttaaagattccttctgtgatctccaagagaaccagtcgagcatcaacactaaccattttgttttcaaaatgctgaaaactgctctgggaagctggaggtgctatcgagggggaccccatgggtttatgaaatgacagccgttggggagtgggagacacctcctcatcctgtgacatagctggcgggaggcccaggctgcataatgcagatgggcgcgaggccccaccagtgggacaggtccaggtctgatggtcatgtgccctgcctcccgcccagaacacagtagcatgtggccagtctgcactcgggccagcctgcagggagccattgtgctcatgtcaccctttgcaggagcgagcccagcaatgaggaggcaggacattactccctgtgacattgagagcaagtttttcaaacacaaagctcatgttaagaagcctgcagtgcacacaagaagtggggagaggggtgggaacggaggacacgggtggtgatgggaggggcatgtgggcttgtcagaacactctgtgtttgaaaatgtcaataacaaggaagggttttgttttgtttttaacaaaaatcctgctgtacccaatataagcagcaagcactgcggtcctcacctgtcctacaccggccatggtggcccctcgcgggcagtgctcgcctcaggcctcactaagctttgggcacacggtttctctggcagcagctaccagcggggatgccaagcccggactcagctcagaagcaatggaggtggcagcgctggggcgcgggctgtggactcactcacctggacgctctgtttctgtacaggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcaggtaatttgaaaatagatgccatggaagcttctgtcgaaaggtggtagcacttgcttgtgggcacaagagggacacggagggcaacggaggtggtttctggatacactgttgagcagggaagaggccctgcaacaaaccagtgacaagccacgtgaagccccttcctcgggctgagccaggctaagcagagaaggacaggcgctagccaggacccagcttcagaagcttcccagaacctttaaagaggccagcagctcggcacagtccagcctttccaccgtgttgcttcctctcaggatcagcagcaacggccctggcttccagccgtcaccaacacttcccactcccttccctcaaactgcagcacacacattaaaccaccagaccaacaaaactagcttgcagctttcttctttaaaccttggtacaagagtcttccaccatgccagtgtgcctgtaaccggcttttctttccttccacagatgaggcagggagcattccttgtgaacgcagcccgtggcggcctggtggacgagaaagccttagcacaagccctcaaggagggcaggatacgaggggcagccctcgacgtgcatgagtcagagcccttcaggtgcgtgttgccccagccgcctaccaggagcccacagggcccagctccacacctgacccccacactttgaactcgaggcccttttcccaaacaggtccctgggcaggaaactccagagatgacatttacagtctctgttcttctaaggattgtgctgtattctaattgtaaaagggctggaagtttcccagaggtcatcagggaaaggagaggcagaaaattggtgggggtgtggcagtggttctggtcttcagacagacaggcatcatctctgccctggattacagcaggacaagccttcaatagaattgggctttttgatctaccaattatacggttcttacacaactttgataattacattcaaaaattcccagccttcataaaatatcatcacagatgttcctgtatccatgctatctatgtagctacttttctacatggccaagagctcccttgtgctgaggagggcagggagcgtatgcgacatttcccgcttactctgttttttctacatttttctagctttgctcagggtccgttgaaagatgccccgaatctcatctgcactcctcacactgcctggtacagtgagcaggcgtcactggagatgagggaggcagctgccaccgagatccgccgagccatcacaggtgagcccctccgtgcctctggcctgccaagggcagcctcagctccacagtgcagccggctcctgtcctgctggctacaggcggctctcgacaggtagaattcacttttagcatcaaatttatatgagttgggccctgtttatttacgtaagccctgaactaaacttcacagagggaaccattccctttagtcccagacattataaactcgggggtcggggggcacacagaggctgaaggtcagtgttgaagagctcaagcacttgggcctttggatgttctacatttttacaaatgcttatttccccacataagcagctacaggtgtaatgttgaacttactgtgatttgtaaaaataatatgattaattttaatcatcttaccctaggtcgcatcccagaaagcttaagaaattgtgtgaacaaggaattctttgtcacatcagcgccttggtcagtaatagaccagcaagcaattcatcctgagctcaatggtgccacatacaggtgagaaaaggaactgactttgtctcagcttgtgagcaccacggccccggggccagggagagaagcccaaacttggcggaagcttaacctcccgcagatgctaagtcagggtcagaacaatcagccttctcagcaggaactgtgtacaccgcccccatttcttccaatgcctaatttcatggaacaaacagaagctcctattttaaaagggggtgtgttcggtcagatgtgattgaccacaggtgctaggaactgcctttcattctaaagccatcttaaaaccagaaggcttcccagtcacgtgtggtggcgcacacctgcagtctcagctgctagggaggctgaggtgggagaggtgcttgaagctgggaggtggagattgcagtgagccgagatcacccactgcactccagcctaggccacagagtgagacaatgctgctaccccccgaccccaccccaccaccaaaaaaaaaaaaaaaaaaagggcttctcaaagagaaaggtatacgtagataagatgttcaagtgcaaaggcctgtgagcaagttcattttccaatttgaatcttatgtccacagaaggcattctggtacagtcaactcaggatagtacaatcaactcaggatgatgaccttgtccacacactaaaaatgatacctgtagtttgggtcagctgagaaactggagccatgtttgggaacgcagagtgggggaaagacaggagccctcacagggagaaggggttccttttgtggtattttccatgcacgaatcggttttctcccacacccccccccccattattgctggcttcccaggaaaatcagtagccccctcatgcataaatgaatgaagttgcagccttgaatcttaagaaaaatttttgcatattctaaaccagggtttctagctcttggcaataagtatatttggggccagatcattctcttcattctctcgtaggaggcctggcctgtcctgtgcattgtaggacgttcagcggcatccctggcctctacccacgggatgccagtagcacctcccactcccactcatgatgattgagaatgtctccagccacatgtcccctgctgtagccacagtgacgaccagggtgcatttagtttgtgtaatgaaggctctgacactcttgaagaagctatgccggtgcttgcaggtcacatggctgtcttcacatttcatccagccccgtccttttggccctcaaaagtattttgagcctatcacagcaccagattcccctgttgggtggagctgggggcccacctcttccatgtctccattgttatttatccttcacgtaagctggggctcttaggccccctagaacagtatgtgtgcactgaggaagggaccctaatgaccagagtccttctgaaggtcttggtgacaggatggcaggccaggagctgggggtggggtggctaccatagtgagatgcctcctcctctacctggatggatgataagtctgtgtgaatacactgagtcccactttgcccgaggaccctgtgttctgtggttggcgaatgcagtgtgtcctcacacagcacttcgtgcttgcaatataaaaccagcccgagcctgggcgttccgaggaaggcgggcccccagccaacagccagcaagcataccacttcccatctcaggccatgggagtatatagccaaccagcctagaaagcttagtgagttctggctgccataattgagtagcatagactgggtggcttgtaaagaaatgccttgctcgcagttctggaggctggaagtctgagatgaggctgccagcatggtcaggttctggtgacggccaggcagcagaccgtcagcttcttcccacatcctcatatggcagagagagggccagagcactgactagactcccttgtgtaaaggcactgatcccattcatgacccagtcatttcctcacccagtcacttcccaagggctctacctcttaaggtcatcacctttaaggtgtgggatttgaactggaattagggggatggagggagacaaacattgagtccctaagggtccattgtactctgttgggaaatcattttatcagtcagaagtaactggtgaacagttgggagtccattttgtacaaagtgggtttttttaaatagtataatgtatccacattcataaatagtatgggctaatatcttcttatctaaaagctacaaaattagtggccccgtgtttggattggactagttttgtttttatgaattagttgccagtgttttatataaaaattgagacttctccttgctttggggatagggaagataaactatcccataaaaatcgttagccagggccgggcatggtggctcacgcctgtaatcccagcactttgggaggctgaggcgggcggatcacgaggtcgggagattgagaccatcctggccaacgtggtgaaaccccgtctctactaaaaatataaaaattagccgggtgtggtagcgcacacctgtagtcccagctacttgggaggctgaggcaggagaatcactttaacccaggaggcagaggttgcagtgggctgagattgctcacgccactgcactccagactggcgacagagtgagactccatctcaaaaaaaaaaaaaaaaactattagccaggcctggtgtctctcgcctgtactcccaggactctgggaggcctatgatggggcatcacttgagctcaagagtttgagaccagcctgggcagtctggcaaaaccgcatctctacaaaaaaatacaaaaactagctaggcgtggtggctcatgcctgtggtcgccactacttgggtgtctgaggtgggatcacttgagcccagaaggtcggtcaaggtgagccatgttcatgtcactgggctcctgtctcttatgaaaaggccagaagtagaagagccaagagcttggcaactctgccctgaacttacaaggccctatttctgtgtgttccttagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacttgctcgcataggattgaagacagtacaggctcctgtacagagaagcatctctcacatctgaactgcatactgagcgggcaagttggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcaattgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccatccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctggacaacgctggctgcaatgcagactgcaatggctacatgcttttccctctaacaattctc

SEQ ID NO: 16675 - DNA, 126237 bp, Human; identical to SEQ ID NO: 16674

SEQ ID NO: 16676 - DNA, 29357 bp, Human
ttaagagatgtctagcttctctcactttattccaacctgccctgcacacttaaaagcacaataaaccttaattatgaaaataatgtcatttcagcattaaaatatatttgataggtaaatccccagtcactacagggcaattcaaactatacaacatggcatacaatctgtcctcagtttatcttttcagtttcagatccaaataaatattcctccagtctgctatattatgttctagtcactttgctagctgttggctaacccatatactttaacatcactactgtttatgcttttccttctggctgtgctcctccatgacctgtgtacttttaacattttgtatatactctaacatagcaattaacacaccatattatagtttgactgtcaattattcgaaacagcagttatggtttattcacatgaaaatttcccaatccttgggtgggcgcgtggctcacgcctgtaatcccaacactttgggaggccgaggcgggtggatcacgaggtcaggagctgagaccagcctggccagcatggtgaaaccctgtctctactaaaaaaaaaaaaattagccgggcatggtggcgcgtgcctgtaatcccagctactcgggaggctgaagtaggagattcgcttgaccccgagagatggaggttgcagtgggccaagatcgcgccactgcactccagcctgggcgacagagcgagactctgtctcaaacaaaaaaaagaaaatttcccaatccttaccactgtgcctgagatatagaagatgaacaacatatgcttgataaatgacattccaaatattaagctgtgtacaacaggcaatatctacatcaacgtttaattgttaatcccgcgtaaaagttttaacatcgtagagtcaataacacttgggaaatagataaaaacgtactgtccaaagaagagactaagaacaagataaatagggaaggataaaaagtaaaatgtgttgattatttaggacgaaaggcactaaatacagccagagagaaactgtgaggaaagcatgtggcctctagtctagaacactagctcaagaaaactcacttcaccggaagccagaaatgagcagagagcggaaccagtgaagtggcctttcaggcccacgcagtcagcgtgtgtggacgtcccgaagagctattcacacattcaaggcgttctgctttgaataaccagaatctcgagttcctgggcggcttgagccgcagacacctcacccttgagaaggcgcaccctagggtggcttctgcaggactaatggcctgagcaatgcacttgacctcaccagcccgggataaggtgcgcgccgcagagaaggggcagtgcaaagggcaatacgtgcttaagagcttggggagcgagggccctcaagtcaattacaggatttgggtgccaggtcctgaggatgcagcaggcacaagactgacacgatccttgccctcgtggtgtggctcttcaaattactgtggaaacgcgactgtctcgagctgaggagagggcagaacatctacatttcccccacccggactccaggttcctgaagtcacctctccagacgcggggcggcggtggccgcagggaaccactccatgcccagcttgggcctcctcccgtgaccccaggcccaggacggtccccttggttctcaccgaatcctttaatgagctcggtgaagaccccggggtcgctttccatgaggcaccactccccggcattgcccgtcatggccctggccacacaccgccccgatccacctctcgctctcagctgccccccgcaccagctgccgccggccacagatctcagcaaacccgccgccgagctcgtcaaccacacgtcaccccgcctacttcccgacagcctccgggcgccgtcacctgcagcgcgactgagcgcgggaggacgctctagccaccctagagacatcgaaactcttcccaggccttgcagcacccgtagcggattcggaagggctggggcctgagaagaaagggcggtgattcacagcgccgaggaggcaacatccgggatcctcgcccctctggggcggaggcggggcaaaagaagaggggcaggactcgttcccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtgaggacattgcgggaggccggctgggagccttttgtgcggccccagggacgcgcaaattctgaccagtcctccatgtctctcacccgcatcccaggggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttgtccatggggctgctagactagtggaaggggatgcggtgcgtcaagggaaaattaggttgaaaacaaatgtcgtgtattaatctaaaaacatttggaatggttctaaaactggatgatgagttaaaccaaatatttactaaatatttactaaattgccctcattcagcaggctcttatagaatactatagtgttaagattaaagtttttaagagtatattgaagtcgttaagtgtatatttactccttaaaagctacatattccaagaaagacctttggcttccagaaaaaaaaaatgttttagtgggtaaaactctgactccttccttctcaaataggtgacttgtgccctggagttagggagccttgtgctacagattatgtgaagccatgaaataaacgtggtaaattttattgagggaagcaacagagcagcttttgtattaaaaggagcctgagtacgctatggggtagaagccaaaatttgtatgaagtgttggtttaaaaaaaattttttttgtaactttcttgaagtttatctccggaaactctgccctcaacttggagactaggaggattctgtacagtatatttccttgagatactttattggaaaagtttaagaggcacagagtccagaatgattggcatcagagcccaaagtagtttgtggtattttttttaatctgtaatattgctatgaacttgaaaatgttttctgtgcaaaatacatcaaaactaaaatgtacttgatacccaacttaattaacatggtacctattgtagaaagaccaaactgaaaatttagcctttggcacaatctagaagtaagcagagaagggggttaagatgcctttcattatgttaacgtttaatcctgagagtttacataaaaagccagatttctgggtctttgagaaaaatgagatctggcaactactagttccataccacgtggcaaccagttggcagctcccctcagactagcatgctgtcatttttgccacagttccttcctcatcagtttttatagcatcacattgatcagtggattcagatacctgtatcatgggtaaacaaacctctatcatgggcccaattttctattgttgtttctttacatttgtcatgcactctcatagatatgtcagctttgacttcatttaaaaaggaataatctgcaaatgtgtttgacttcttgagatgaaaggcagcattttcaaataaattataaagagactttggaagatattgagatgtgtaaattcaagaaaaatgtaggattccttggaaataacacattagtactgataaaagatactgtatatgctgtagttctgatgattgtgaaacaagtgctattatataatgtgtgttactagcatttcctgattttgcattctaaattaaatttaaaagtagagaaatggacattgtataaaatatccacaaccaatttaatatgcggccatgcttggccgggcaccgtggctcacgcctgtaatcccagcactttgggaggcccaggcgggtggatcacgaggtcaggagttcaagaccagcctggccaacatggtgaaaccccgtctctactaaacatacaaaaaattagccgggtgcggtggcaggcgcctgtaatcccagctactcaggaggctgaggcaggagaatcgcttgaactcggagggcggaggttacagtgagtggagatcgcgccactacactccagcctgggtgacagagtgagagtctgtctcaaaaaaaaaaaaaaaagtgtccatgcttttaatattatagtattgtaatatttaacttctcaagaacttaatttatagagatttaatacaacattagttgtatggtgtgttttaagagcactagatagataggtcaggcccatccaaagaattaactatatctttttgttgttaatctggatttacaacacttgattatccaggaatggattaactgatgaccaggttctgacctcactcactgcccaattgccttctaaaccactgataatggagcttaagctttgaggcaggagatgatggcagttggagaaagaagaaattaagttgctgtatatgtcttgtgggtatctcaaattgcttttaaaagtcaaatataaaaattgtagggctaaatataatttttgtgtaatcaattgtattggtgctctccattctgatatagataatagcagagttaagtgcttgtttatttaaataactttccaaatatattttacctggctagtttatgtttgtatttttaataatagatttttagaatataattcacatatcatgaagttcactattttgaagtatccagtgcattgggttctagtatattcacggagttgtgcagtcatcaccactaatttctgaacattttcatcacccaaaaagaaatcccctacccattagcagtcacttcccagtgttcccccactccgacagcctctgacaaccttagactaatgtactttttatttctatgaatttacctactctggaaaattcatataaatggaattgtaatacaatatgtggccttttgtgactggcttctttgacttggcataatgttttcaaggtttgtttacattgtgtcatgtatcactacttcatccctttttattgtctaataatagtccattgtatggatataccatatttttttcatcccttcatcagttgatggacatttgggttgcttctcctttttgaccgttatgagtaatgttgataaaaacatctggatacaacttttggtttagatacatgtattcatttttcttaggtgtgtggtagaattcctcggtcatatgctaactatatttaaccttttgagaaactgccagactgttttccaaagtggctgtatgattttacattcccaccagcagtatatgagcgtttcattttctctaaatcctcaccaacacttaatattattgttttgattatagctgtcctagtggatgtgaagtggtatcttattgtggttttgatttgcatttccctgatgactaatgatgttcgtcatctttttatgtgtttactggccatttgataatcttctttggaaaaacaccttttcagattctttacccatttgtgtgtctttggagtaatattcacatcttttgcctatttttacttgggttatttatcattttattattaagttgtaagtgttcttaatatattctagatacaagtcacttattgtatgtatgatttgcaaatattttcctttttcttgggttgtcttttcactttcttgatggtgtccttggaaatacaagttttaaattttgataaagtccagtttatttttttattttgtcacttttgcctttggtgtctgcgttccaacactaattctgtagcatcagctgggtgtcccccacttccgtttagttctggcactagctgcccagggttggcatcagatcccacaaattaaaggacaaggtccccactaagaatgccattaatttggacaccagctgtaaatggggtccccaggctactcacacttctgccctgcggactacaaattcaagacttcccataatcccctcaaggctgatagttcactagaatgactcacataactcactgaaagtgctctacttgcaattacagttttattataagggatacaactcaggaacagccaaacaggaagtagacacatatggcaaggtctggggcaagggaaggatgcagaacttccatgccatccttgtgaaatgtgggatacaactcaggaacagccaaacaggaagtagacacatatggcaaggtctggggcaagggaaggatgcagaacttccatgcccatccttgtgaaatgtgggcacatcaccttcccagcacatcagtttttgttcaccaaggatgctccactgagtatcgatgaagaaagtttttatgaggtttcatcacatgggcatgattgattaaatcattagctacatggctgaacttgatctcaagtcctcctcctttcatggaaggttggcctgaccagtttattcctctaaacatatagttggtctttctagtgattagcccccatcctgaagctacctaggggcccatgttgcctcattaatgtaacaaagacactcctatttctcaggaaataccacgggtttttgaaactttctgctgggtattatgtccaaagaccaggtactctctcttataagatgccacagtatcacatcactttgccgaattttgagtttatgtgtgtatcacactcagtgacaagaaggagagtaacttgggacatgttattctgttttctgtcttttaaaatatgaatatgaccctggtaaatttatataatcaagtaggaaggtgccctggctgctaataatgttatctgttccactgttttatgttgcactctggaaagtacagtcacagaagcataggaaaacctgagcagtttctgctgcagaaatactgaaagggtatgtcctcagggttgtcatttatatcataacatgcaaaaggaagagtccatgaataagtaactttatttcttctaatagggattataaggattatacttagagattacctcttagacatccttcatagatttaaaagttcattttgctgcttgctctagagaagtacctgaatacctaatattaaatatgttagaaaaacagaaattttgttcttagatgacatttttactcagtattcattacttttctttagaactttattttttcttgattatatttttcactacctgcatatagtacatttatcattctgattacagaatttatcttaaagacttgtattatattttgcattataaatattgaggcttttattctcaaaatgtgttatgggaaagagaaaccaattgtgcataattatttggcaaatggttcagaaagtcaactttaatgatatttggctttaagtatgtattgctaattacataaaagcaatacaaaagaggagacaaaaatgataagatttggtttctactttcaagggaaccaataatgtagctacatgtggtcacaatgaataatacaaggaaaagaatttgaggggagagggaattttgaggtttggtttgggaccttttaaatcccaccacttgggccttggtgcaggaaagcaagtttagtagaattatctgatattagatgtcatttcagtgttactcatctaacaaataaaactaataagcagaagtagacaggttgaagtgcaaccagagcctgtttttatgaaagctgagggagagactagcaaagtctatgtaatgtaaagatcagaaaaacataacattgtctactggaattggcaattaaggtatcagtctttgagaagcatgttagtcttcttaaagtgttttggatcgaaaggtagagataaaagccaaattgaaaagaggataataataaataggagaacaggcatccactgcaacaggagtttcaacctatgctgtattcagtaactatgaatttgtccctaatgactaatatgatcattacatctctgatgccacctgagacctaggcttccactaacataagcaaatttatactagcgtcttatttggaatattgacactaatattccgaacacaattcagatcactgtccccctcagtcacattcaaaatgtgaggctcttcattctcccatgcacttatccctacaccactatgtgttcccctctctgagacccagtctttcattcctcccctctctaccaaacttctccacataccatttggcattctacatctcctgtcaggggggaatgtcttcagtttccttatccctcattccttcaaatctatctttacctatactctttacccttaaaagataaaggaaatatctcttgctgtcagtaggccagtctcaacctggatgctctaagctcattctcatttctttaagaaattccttcagttatcccccttctctactgtatcttcagctctccaaattgaatctttcaatgttagcatcttcccattgaaaaaggtaaaaagattttttctctaagtcccatcctcttttactttccttcatagtttataagtatgtgtctacaaaagagtagtctagctgtgaagtttcttcctcactgcatattctcctgatctcactgtaatcaagctacttcttataccactctactgcagttgctctcactagtcactcctacttgctaaacccagtggtcattttctagccttttatttacttttcctctgaccatttgaaattaccaaccattcactccttgaagttctcttccttgtagtccatgatactattctctgtcggttttcttcaactctgtgcacctccttttccgtctctctttaaaaggcctttctctcattagcttttaatggttaatattcaccaagattctatccttagccttccttgtaatatataaacatgttcaagtaagcatgatcttcagaacaaaacttcttttatcttgtgttcctctttaagttatgaccgtatctgtcaacatgtctttatggctctacaggatgcttagacagtttcttttctagaatataaagacagatcgagatttcagaaacctcttcctggagcgccttccctaaactttatcagttttttagtttgccttctctgctcaaatccttctggattatttagacagtattattttatacttccttgctcactcacttttccactacagcacttaatcacaatttgccttctctgcacaaatctttctggattattgagacaatattattttatactcccttgctcactcataatacttttctactacagcacttaactacagtttgcattgtgattctatccccacaaatgagtgtgattttcctgtgatgaggagaaaaaaaaattttttttctttctttttttttttttttttttgagacagagtctcgctctgtcccccaggctggagtgcagtggcaggatcttggctcactgcaagctccgcctcccgggttcacgccattctcctgcctcagcctccctcctgagtagctgggactacagcgcctgccaacacgcccggctaattttttgtatttttagtagagacggggtttcaccattttagtcagaatggtcttgatctgacctcgtgatccgcccgtctcggcctcccaaagtgctgggattacaggcgtgagccactgtgcccggcccaaattttttttttttagtctctttaatgggagagaaattgtcttcatgtcttacacatagtatgtattcagtaaatgctggtttaagtttttgttggttgtgctgttttgttagccatggacagaagcccagtgcaccgaaataacatgacagattgaaggacctcaataaacagtgatactgtagtaacaatagtggtggactgatgaagaagtgacaattgtggttcctccattagaaggataaagagggatgttgtttccagacagctagttctaggagttttagagctaatggaaggagtagagtgagggtagttacagatgacataaaaccgtaaacctaaaaatggcttaaacaataaggatacatttatgacataataggaagtgtataagcagggcagtttcaggtaacccgatatcaaggacccaggttctttgttttttctgttctgctctctttatatattggtgtgccatcttaaactggcttatctcaaggtctgaagatggttgttaccactccaggcatcacttgcaaatgaaaatgtcagaaggcagaaaagggaacatttctttttaagagcctgagcccccttttaagactgaagaaaacctcaaaagtgttctcagctgacttatcatgtcatactggccagtcatgacacatgcccaactccctataccagtcatgtggcaaggagagcaccatgattattgggcctgggtcaagcagcagcagcagctgggaacttgtgataagtatacatgcttaggcctcactgcagacctactaaattatgaaagaaactcagggcagtgcctgagagggctgacccaccaatctatgtttcaattagtaattcaagtaattttgatgtacattgagtttgagaaccactggcttagagcaataaagatccatcccttggggctagggaaaggcctagcctcctttgaaggatatgaggccaagaagaggagaagagagaagggggaagaatgaatgttagataggcaaccaaacatgtttacacaattcttcagggagtatgatctttcttacttagtgccagctactattgctgccctcccttcttttattctctgtgtgggcctcaagatgccatactgatctacctgcttaatctctgaaggagcacactgtatctcaaaaatgtgacgccttagttgcttctgattatcacaccactgtggctatgatttgtttgtttgctgtgaagggcttttagtttctttagattataaaaataggaatacaaaacaaaaacactttaaaaactgaagatattactggtagtcatttcaaagtattcagatatggtttttttctttcattttctgcctttcctgatttttcttcaggacatttatattgattttgtactaagggaaaaactatggaacttaaaagatgtttttaaattaaaagagttaataacatttcagtaaacctacattttgttttccttttgtaattttattgtgcccatctagttgtaataacattttgcctttttgttaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggtaagcataagatcttcattgggaagaagggtgggtaagggatattcaataaatagcaaatttttatttaacataagacaagtgtgtaatattttctagaaatagccttttattctcaaaatatacattaattcaaatatatttaatgccttcctgggattacacccctaccacaggcgatccagacattaataatcaagaatcaaatgacaggtttataggttaatattctgaatcttaaaatgccaccgtcctaactggaatgctcacccaagtgattctggactgtgtaagtagcaggggcaagactaaaagttgcaataagccttggatatgggtacagtcactagaaggaactgcttttgagttccagctttgccagttactcatcagatattcaaacttggtctcagtataatcgtttgtaaaacttaggtaactgtacacagctgttccttaagattatgtatagaaaactactctgtaaccaataaaatgctaagtagaaaagcaaaaaaaaaaaaaaaaagttgcaataagcaaatcagctccttgccagtaggcggcagatggccatgctgtacccactgctctagcccattccttttttccctccccatcttcctaggaacccatcttccatggaacctaaaggaatataccagatatagtgctgaacttaacaattcaggaagttaattgtcttcaggcagttagtcaggggacataataacttggggcagtttttctgtatctatggaaagagacttttgaaaagttagttggctccgtaataattactagtccttttaagaaaagaaataagaaaaactcttgggcaggagtaatttgaagtgtgaagttccacaaaaatcaacatgttcaaaatttgactttttttttttttttgcaccggaagtgaaacttgaaaagacagccactcagaagggtgggttcacatttcagttctgtggacttaagccaagtaagttaagctgagtttctgaccttcatctattaaaaggagggtaaggagaataagcttacaattattgagactaaatgtcccagcacctaacatgtagtagaagtacactttggttctctatttctcccttccacacatatttttatatacagaatctcttcagtaattcctgacttattttttaactataactggggtttttcaaatgaaatgtaaataataaattgcaaatatttatatgtataaacattttattttgattttattagattacatgttttaaaatagttgaataatacagaaaaatatgatgcagtcctactcttcaaaagaaataactgcatatcagcagtccacaacccttctgataccagggactggttttgtggaagacagtttttccgcaggcagtggggagggcagggtggtttcagaatgaaactgttccacctcagatcatcaggcatcagattctcataaggagagcgcaacctagatccctcacatgctcagatcatagtaggattcgtgctcttatgagactaatgcccagctactgatctgacaggaagtggagctcacttgcctgctgctcacctcctgctgtgcagcccagttcctaacaggccacggactggtatccgtgtatagcctgggagttgagggcccttgctgtatatcagatgttgtaatttactccagatttttcctaaacatatattactgtgtttcactaaattttgttacatgccttctatgtttcagtaaaaagtatattattgctattgctattgctgtttctttcaggtcagtagaaatagttgcatatataccattgtatgactgtaatttattagctagtctcttattgacaagagttgtttctggtttttttatactgttacaaaaatactacaatgaaaacacttgcatagagtacctactttcataatggttaaatccacaaacagtatgtgaaagggatcagtgtacccacatttgaacacttaactgttgtcattattttttaatctctttcagtagaatcatgaaagattctttgaatttacatttttgggcagaagctcatctttgcatgtgctgattatatatatatatgcacctatatattgtataatatagtatatataatatataatgttagtatatagtatagcatgtaatatatatatacctatatacatatatatacctatatatgtatgcatatatgtatgtatatataatatatatgtatgtgtgtgtatatatgtataattatacaattacatcatagcccttttgtccacttagttactgtctttttaactattgattgtggtcactattcattcaacaaatatttatttatttatttgttgtatttattttgagatggagtttcacttttgtcacccaggctggagtgcaatggcacaatctaggctcactgtaacctccacctcccagattcaagcaattctcctgcctcagcctcccaagtagctgggattacaagctcctgccgccatgctctgctaatttttgtatttttagtagaggcagggtttcaccatgttggtaatgctggtctcgaactcctgacctcaggtgatccgcctgccttggcctcccaaagtgctgggattataggcatgaaccactgtgcctggccctcagcaaatatttattgagcacctactatggatagaaactgttctaagaacttggggttcatattagaggagttgataatgtattatttatatacagtgcatgcattttttcttcttttttttctttgtcttttttttttttggttgggggacatttctggcacactaaagttttgaattttaatgtagtcaaatttatccatgtcttcataggtttatgttttgtgttaggattagaagggccttttccaacctaaaatatttatctgtggttttttcctaacattttcttggttaagaaacattattttttacatttaaattttttatccaaatatttgatccaacataagaaggacttaggcatccagctttatttattggtttgttgagatgtgtcttggaagtgtggagcaagtactagactaagagaaagaccgcccattactagttctaactggaccaattagtttctgaacttgtgaaaataattattctgtgctttgtctttttggtctatataatgaggaattagtagatgtttcctaaacttacttccacacataggattctttaatttgaaattgttgagggcagaactcacagttgaaaccatgttagtaatagcaatatcacattggacagagaatccctagcatttcaaagcttaaaaatttggaaaaactctaagctacagaattaatagtattttaatgcctttaagtgtaatgtgtatttataacagacaaaacaagtcaaaatgtgattcaagtcatcaggtatggtatttttattgtgcacccactgcatggccagcgcaattacagaaccgggtaggataaaactgctttaaggaatttttattttcactggaaaaacaaaatagaagatatactcacaggaaacatttactcatttaagatgattttgcaccaaaatctggaagatagcaagagtcacaatacttgagaagttcctgcatgttagtgttaacttttgatcaagttatttagcattcaaaaataacataataggctcagttggcatagagatgtgtttcatgtggcctatacaatatttttgggtaaaaatgaattctttgtcattatctttaaaaatcgacataaaaacccatattctggcttctcttgaaagtaagttttttttcttttggcagcactaagtcaatacgtgtctacaccacttgtcagggcacactctgttcagtcaccacaccctaacaactctctattacatcactgtgtttgtttgtttgtttgtttgtttgagacagagtctcactctgttggccaggctggagcacagtggcacgatcttggcccactgtaacctctgcctcctcagttcaagtgattctcctgcctcagcctcctgagtagctggtattacaggcatgtgccaccacgcccagctaatttttttttattatactttaagttctagggtacatgtgcacaacgtgcaggtttgttacatatgtatacatgtgccatgttggtgtgctgcacccattaactcgtcatttaacgttacgtatatctcctaatgctatccctcccccctccccccaccccacaacaggccctggtgtgtgatgttccccttcctgtgtccatgtgttctcattgttcaattcccacctatgagtgagaacatgcagtgtttcgttttttgtccttgcgatagtttgctgagaatgatggtttccagcttcatccatgtccctacaaaggacatgaactcatcctttttatggctgcatagtattccatggtgtatatgtgccacattttcttaatccagtctatcattgctggacatttgggctggttccaagtctttgctattgtgaatagtgccgcaataaacatacgtgtgcatgtgtctttatagcagcatgatttataatcctttgggtatataccccgtaatgggattgcttggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgatcgtcattctaactgatgtgagatggtatctcattgtggttttgaattgcatttctctgatggccagtgatgatgagcatgttttcatatgtcttttggctgcataaatgtcttcttttgagaagtgtctgttcatatccttcgcccactttttgatggggttgtttttttcttgtaaatttgtttgagttctttgtagattctggatattagccccttgtcagatgagtagattgcaaaaattttctcccattctgtaggttgcctgttcactctgatggtagtttcttttgctgtgcagaagctctttagttgaattagataccatttgtgaattttggcttttgttgccattgcttttggtgttttagacatgaagtccttgcccacgcctatgtcctgaatggtattgcctaggttttcttctagggcttttatggttttaggtgtaacatgtaagtctttaatccatcttgaattaatttttgtataaggtgtaaggaagggatccagtttcagctttcgagatggagttttgccacgttgggcacactgttctcaaacccctgacctcaggtgatccacactccttggcctcccaaagtgctagcattacaggcatgagccatggtgcctggcctcaccgtggtggttttatttattttatttgcttgtccctcatagacattttaatgttgtaatccaatccctgctgttttacagaagtggtgaaactaagacctagaaagaccaccatttattggcagagtataggctagaacccagactttctcacccccaatccaaggctcttttctctttcttctattggaagaaattgtggaggaaatcaacaagttactgtttccttttttttttttttttgagcagtaatacttctcagctattaaaacatagtgtaaaagaagctaccctgtccacttctacttatttctgctgtttttgtaaatatatatattttattcaacagcaaaaagagacaagtgaatataattaatataatataatacattacaatacaatacaatattaattgagatagatctgtactctcgtgagttgttctgagattatggacctgaaactttctaatgctggtgtctttaaaaagaaaagaaagaaaagcctctgtaacaaaatactcaggatacaggtttttttactctaaagtctcatatttaaatagtaatgatggaataagaaaattaattcaccccatttgcttaattgttatatcatggaaagcagcatcccagtgtaagggcattaactcttgtgtatccagttatgttgatcatataatgcattttgaggaaacatgttctgtttttttacttggtaatcctgcatgctttttcaattctttatcttgttaaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtgagtgaattatatgttacagcatgtgattaaacatgagtaatttagtgtaggtgctaaaaggataaacttggggtagctatatatttatacttttaaaaagaaattatttaaaatatatcttgaaattgatgtctgtttaaaacacctaccatgatgtccaacatgatgtaggtggcatttgtgttagtttcactccagaaaatctactgccttgctaattaaaaaaaaaatcatctatgcatttccttcataaaatatacttcacatcctttttctagtaaaaaacaagttagcttatttgataagccttttacttagacatttttcattctgaaagtactttgaaccccaaatgaaagcctcagagactgtattatgaatatttttttatataggtatgttatactgatttattttcccttaattcctggtatttctgcctatgttattgcaataggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggtaagcattatcattgttctttattagctactactaactgagaaagtggctcctaaattttagaaatgccgtcagtgcatttttaaggtatttcgagatgttcattataccaaattgcattatggctcttaagtgtaagtttaatacattttcatttttctcttttctatatgaaatgtagttattagctacaataacacaaaaatctaaggagtatacataatcactgttttttgctaaaattttccttatactttgtttctaggctcgtatacatccatttcatattttgatcgcattagaaacttacaagacaggtcatggtctcagagggaaactgaagtggcgccctgatgaagaaattttgaaagcattggatgctgctttttataaaacatttaaggtagtgatatgatttttgttttaaaacaaatgactgaagacttaatatcttttgtaataatacattttaaaggtagtattaatagtttaatcattttttaattaggtattcatttgtttttctttagttcatatgtggtgagtatataattaatatcgtgtaagtttaagagtaaagtatttctctttacctttgggtagcaactaattattctaagatcattttggtaacttttaagttactaactgtattagtttgttctcacagtgctataaagaaatacctgagactgagtagtttataaagaagagaggtttaatcggctcatggttccacaggttgtagaggaagcacagtggctactgccctgcttctgaggatgccttgggaaacttacaatcatggcagaaggggaagcaaacacgtccttcttcacatggcagcaggaagaagtgatgagcataaggggggaagctccttataaaaccatcagatctcgtgagaactcattcactatcacaagaacagtataggggaaatcgcccccatgattcaattatctctacctggtcccacccttgaacatgtggggattatgggaactacaattcaagatgagatttgggtggggacacagccaaaccatatcaacaatcttggcagaagggggaatatggtgctaaactattagaaactgcccccatgatccagtcacctcccagaaggtcccaccttcaacattggggattacagtgaacataagattggtgtggagacacaaatccaacccatatcactaactttagaaatttgcattcctgtcaggtcctttgacttggtcctctgttttccccattaattggtagatagatctcatcagtcttgataaaaaatgagttttttagtaatggaaatctcacatcaaagacacaagctaaaacatcttgctatataacaaaatactagcaaccaaagtcagcagcaaaatagaaggattacatactataaccaagtgatattcatccctggcatacaaagatagtacaacatatgacaaccaatcaatgtaatacatcacattagtagaatgaagtgacaaaaaccacataatcatcttactgatgcagaaaaagcatttcacaaatttcaacattccttcatgatgaaaaataaaaccactaaacctgaaatgaacttcctcaacatgataaagtccagagatttaaaaaacaaagatgtttaaaccccatagctaatgtcataatggtgagtgattgtaagattttcccctaaaatcaagaaaaagacaaggatgcccagtttttccactttaattccacatagtattggaagttgtagtaataaggcaagaaaatgaaataatgaaagacattgcaattggaaagaaagaagtaaaattatcctcagatgccatgatcttgtatttagaaaaccctaaagttaacaaatgaattcagcaaagttacagggtataaaaccaacacataaaaatcagttgtatttctatatactagcaatgaacaatccaaaaaaagaaattaagaaaacatttccatttacaagatcatcaaaaaataaaagacaggagtaaatttaagaagctgtaagacttatacactgagaactacaaaacattgctaaaagaaattaagtcatgaataaatagaaacacatctgtgtttacagattggaagacttaatattgttaagatgacaatactatccaaagcagccaatctacagattgaatgcagtccctttcaaaatcccaatggcatgttttacagagatagaaaaacccattctaaaattcctaagaaatttcaagtgaccccaaatagccaaaacaatctttaaaaaaagaacaaacctggaggactcttcagtaactctttcagttactacaaagctgcagtaatcaaaacagtgtggcactggcaaaagaataaacatatagaccaatgaaatagaaagtccagagataaaaccttgcatatatgttcagttgacttttttttttttttttttttttttgagacagagtctcactgtgccacccagtttggagtgcagtggtgcaatatcagctcactgcaacctccgcctcctgggttcaagtgattcttatgcctcagcctcccaagtagctgggattacaggcatgcgccaccacactcaactaatttattccatttttagtagggacagggtttcactgtgttggccagtctgttcttgaactccttgcctcaagtgatccgcccaccttggcctcccaaagtgctgggattacaggcgtgaaccactgcatctggatgtctgttgacttttgataagggtgccaagatgattcactggggaaaggacaatcttcaacaaatggtattgggaaaactgcatatccacatacaaaagaatgaagttggaccattatcttacaccaaatacaagaattagttcaaagtggatcagtgactaaatttaagagctaaaactagaaaacaccaaaaacacaggcagcaaaagaaaaaataaattgaacttcatcaaacttaaacattttgtatattaaaggatactatcaagacagttaaaagataatctacacaatgggagaaaatatttgcagaccatatgtccgataagggcctaatatccagaatactgaaaactacaaattcagcaaaagtacaaacccaatttaaaaatgggcaaagtacttgaatagacatttttctaatgatatacaaatgagtaataaaaacatgaaaagggccaggtgcagtggctcacgcctgtaatcccagcactttgggaggccgataagggttgatcacctgaggtcaggagttcgagaccagcctggccaacatggtgataccccgtctctaaaaaaaaaaaaaaaaaaaattagctgagtgtggtggcgggcgcctgtaatcccagctactcatgaggttgaggcaggagaatctcttgaacccaggaggtggaggttacagtgagctgagattgtgccgttgcactccaccctgggcaacaagagtgaaactctgtctcaaaaaacaaaaaaaaaacatgaaaaatactcaacatcattaataatcagagaaatgcaaatcaagatgacagtgtaataactacttcacatctagttggatagctaatatcaaaaaagcagaaaacaagagttggggaagatgtggagaaattggaaccctagtgtatttctggtgggaatgtaaaatggtaaaatggtgtagcccctgtggaaaacaatttggcagttctcaaaaggttaaacgtagaattaccataccatccagcaattccatttctaggtatatacccaaaagaattgtaaacaggtattcaaacagatatctgtataccagtagtcacagtagcattattcacaatagccaagagttaaatgtattcttgtcttttatttttgatgctattgtgaacaaatgttttcttagttttcttttttgaattgttcattgctagtatatagaaatacaactgattttgatgaacaacccaaatgttcatcagcagatggataagcaaaatgtggtatatataatggaatattattcagccttagaaaagaattaaatttgatacatgctacaccatggataaatctcgaaaagattatactaagtaaaataagccagacaaacaaggacaagtattgtatgattccattatatgagatatctacagcaggaaaatttatagagacagaaagtggaatagaagttgccaggggctagggagagacatggcaatggggagttactacctaattggtacaagttctatttgggatgatgaaaaagttcttgaaatagatagaggtgatagttacacaacattgcgaatgtacttaatgccaccaaattgtacatctaaaaatggttaaaaaggtcaaatttatgttatattttaccacaataaaaatttcctactaaaaattctcattttacttcaatgaggaaagattttaaaaataggatggtaacttatttaactaaaattattgaataggttatttcctttgttttacctgtaaaagctaagtatttttattatttttttttaattttcagtcatagctgctatgccagatgagcatttttaaatagttgtcaattggtatatcaaaaatctgaaggccttttatcagtctttttaatgtaagataagtaaatatgatttagaaatttagtctacttataatttctgttatgcttttaatgattgttttgttttctctgtagacagttgaaccaactggaaaacgtttcttactagctgttgatgtcagtgcttctatgaaccaaagagttttgggtagtatactcaacgctagtacagttgctgcagcaatgtgcatggtgagaacacctaagacaattttgccattctaaaaacatgtttactgtagagcaaaactataagattaataatgattaagaattatgttttcacttttttctgtcatttcagcttgtcacatttttaattttatatttaaagataattgtgtaaagccagagtgttaagtgtgttgaaaaagtatgtctaaagaacaagcagagtagaaattttaatttttacaacaaaagattaaatattaatggattttttaggaagtagataatgcttagataaaatgaaaaaaagacaaattttttaaaaatttattttaaaaataatgcttaaattatttaacgatttgaagcttaaaagatctgggaactaataggagtgtctagagactttagttctatcctgtcagtgaataacaaacagatgaatagtaggcaaactttttagcttctttactggggctttatttcttatctaatgaaatgagaagaatatttactgtatttgcttcaaaggatagtcatgatagccagtttttttgtgaaagtactttgaaagctgtactactgttaatgtatagttctaaaacacactaataaaaagttaagaaataaacatcagtgtttcttttaaacatgaagttggataaaattcaaaatattgtatttccccccaaatttgctgaaaattactgccattgaatttttcaggttgtcacacgaacagaaaaagattcttatgtagttgctttttccgatgaaatggtaccatgtccagtgactacagatatgaccttacaacaggttttaatggctatgagtcaggtaagaaactgtgttttttaagtttacttagttaagtttacataacgtgtagaatgattttatattgatgtcatgtatggtattaatctgtgagaacaaaattttttttgtcttaatttttgcatgacaagtacaaaaccgaaaatatatatgcaggctttgggaaggctgtatatattggtgctaaacaaaatgatactgtaaaaactagtatttttaaggatttatttacttatttattcatgcttttgttccaaattagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaaggtaaaacaaattctaatacggttcctcacccaaataatattattttaatacttgattttttttttttttttttggagacaggacctcattctgttgccctggctggagtgcagtggctcagtcatagctcactgcaacctcaacctcccaggcttaagtgattctcccaccacagcctcccaagtagctggaactacaggagcgtgccaccatgcccacctaattttttgtaggaatggggtttcaccatgttgcccaggctggtctcaaactcctaggctcaagcgattctccagccttggcttcccaacgtgctgggattacagccaccacacctggccattcttgattcttattcacttatgtgtttcaaaaaatgttactacaagtagttctgtatcttatataggagccagtgtccgttatagactcagcagtacttaaaataagaaaaagtattgattacacacataaaatttattttaaccagtttccattgctaaacattactaagaatatcctttgcaaacagtatttttggtaataatcagaatatttgttttaccttagctgtaagttttttttaataattcagtgtgctccttgaaaaattgaaagtattagtgagttttgcaaaaggattacataaaattaaagctataatctatgctctatgttttatggacatatctgtgttctaatcagtatcctccagttgagctttctgaaatgacataaatcttcactctccaatgtgggttgccactaatcacatgggacttttgagcacttaaaatatggctagtgtgactagaagtagaaatagaacttgttgatgaagagtagtggttctcaaagtgtggtttccctaccagcagtcttagcctcacctgcgaccgtattagaaatgcaaattcctgaggcccgtcagagacctgctgaatcagaaactctgacgttgggactgtgttttaacaagccctccagaggatttctgatgcaggcttaagtttgaaagctgcaggtaagggaatagttttgttttgttttgttttgtttttttaagaaatggggtctccatcactggagtgcaatggtgctatcatagcttactgtaacttgaaattctggcctcccaaagcactgagattacagccatgaggcactgcccaaccaggatagaatgtagagtaaagactgtttggttgtgagtcccgagtctttctcttactctgtgtggacctgagcaaattatttaactgatctacatcatagtaagttacttacctcttagagttgttttaacagttacggtagatgtattatttaaacagtgcattgtagtttctcatgtgtatacattcagtgattgttggtttttctcaaaaattcaattattttaatcttacatttagctgtagaggacaagttcttacgtggaacatgtgtatatcgcacatatcaaagtcatcagccaaaagttgatcatcccagagatatgtccttatatatactcatacacactgccccagcatttgatatgttgataaaaatatctggcacccttaataacctgacaggtttcataagtacaaagtgcctaggctgctcaataatgtacactgcagcccatagaacaagtaaagtaattgaagagagaagtagaaatttcaggcagattcttatacaattttattgtcccttcttctaaaactcccatattctagccttaaaagattgacccccgcaaaaaaatgactttgtatttaaaaagctctggtagagaaatgttaaagtgttttaattttggaggtattttgcatttccttacatttatgtttttaatatgtattttggtctttttctacagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacgtgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcacttgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaacttttcaaatcatggcat

SEQ ID NO: 16677 - DNA, 61847 bp, Human
tcctcagggagtttgaaactgtaactagttcagagaagagggtggagggcagccccgaataccccagcatttaccaatagagcaaacagggactcaggagcctggggagtgaggttagccggaaaccctcagagtggagcactggtgctcttactgagagaggaaggtgtgtccagatggaggatgtgattaactgtcctcaacatccctgagagaaggagtaagacaagggcagggaagagaagagaatgcaagatttggcaacatgtaggtcattatgatgactatgacaaaagcagtttgagctcaattctgtgtggagtatagggaaggagggttgaggacgtgcatttagaagggtacatagttctcaagaagttttgctgagcacatctgtaatcccagctatttgggacgctgaagtgggaggactgcttgagcccaggagttcaagaccagcctgggcaacatatcgagtccctgctttaaaaaaaaaaaaaaggaagttttgctgagaggctagatggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggagcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggtaagtcagcgcgggcggggcggcaggctgggctctggcaaagtggtctggcctccatcagtctcttcctcgaccctgcggggacccgcttcctccctactcggggcctgggagcggaaaaagtttgggcagccgggacactcctgggcgccaggagccacgtccgctaagcacagccggcgagtgcgcgcgggcggggagccgaggtcgcgctccgccgggcgccctccctccctgagctccggcacgcgctcacgctctctcccccagtccctttttccctgttactggaggggcgggtcaccccgcaggtagtcagggattgctgcgcccacgtgggagggagcccccttctgcagcgcgagttccggcgagagcacgtggagagaatcgtggctgcgggaggctgctccgctgccgcgtggggccgccgggggccgtccgcgctcgcggaccgcgtgtaggagacgagcggttcccttctccttccccgcggccctgcgggggtgggctcgaggagaagctgacccgggaaggagtaggaaaggggcagaggaactccgcccgccgcgccccctccccggaactgtggcgcccggaactgaggctcggcgaggggcgtcccccattaacccccgcccctccaaatcagcctcgggaccgcccagcctcgtgtcctcaggatctgcctctgagtaaggggaggactttggttgttactttctggtttgccctaaaagttactcggagaggccaacgcgccgcgttcctggattacttgagattcttgagatttatgtccttccgaaaacgagcttttttttccttaagcctcgacctgtctgttcccacctggctccgcagctccctatggctgagcgctcaccgcggccgggtcatttacataagaaagagcctcaggccaagccgggaagctctcattccccgcctcggggtatgggggtggggatggggccggggccggggacgggcagggccaggggcgcgctcagaattgagtttctgaaatgcccgggattaggggattggctcctggcccgggcctgggctacgatttgaggtaggggacaagttgggaagggattagctggagggaggttgttttaagagctgtgaggcaacggagcgttgctcagttacatacttggaatttcaatatctgatgggaacacatttttgggaaaatgtcttgccattaccgttctgtgcgacaacctgctcatattcccattctggcggtcccgagggcataggaggcatattaatgtagtgatggcgcgtgaacctccaagaaaagcagaagttacccagcctcaagtctggaggagcgagcagaggcggttgatttacttgggttttactgtttgtaaatggctgttattctctaattcctgggatgtggctctgcaccttgattcagtttacttaaaaacgtgcctttgatttgagctggcaggatcttggtaacttctcaacttctaagaactcttggggaaggctatcatctcttggcaagtcctaaaatacacagtggagcgtcattaatctcagggagttctcctttgggtattaccccaggacatttgaatccttgcataaatttactcttcctcaatccagaggagggcaccagggttggaaccccgttggagttataccactctcaatcttggaatgggggtcatctctcttcccccagagtggaacgggaattaaccagggtatctggaaatgagttgtaatctctgtcttgtggtttattaaccatagcaccctgagcctctttggacagcccgtttctctttgtgaaatgcaataataacagtaggcttgtccactttatggagttgcgattattaagcgctgcagtgtgcaactgtcattcctgtaggttttctctacccttgcagccacctgtcagtttgagaagtgtccctgaagacccttgggtgtatttcctctaaactaccaataggggcagaattgaatcaggcctttaactcagtaattgtcagaacctgggatttgactcccagcttaggtgagcgaagctgtttgattccagtggcagttacatagaaagcagagactcagagtatcttggaaccatctttctgagctgccattggaaagaagaattaagagagaagaatgaaaatttagtataactttagagtcttttgaaaagaccttttgatttggacccttctgaaatccccttgtgataagataatcttacatattctgggttgtagtctgaggacgtggaaggcttgggttcacctgcccaacgaggtcacttgtcgtctcctgatggacaagcccagtgttttggggcattagagatgagaatcagggttatttcctcacttttgccaattggaactcaggagcgactgcagagcacctactgtgtacctggcactgttctaagctcttaggtatgtcagcttattaacattcaaatcagccccatgaggtgaagactgattgttattagcatccctgtttaactgaggcccaggggtaacttgcccaaggtctccagcttttctgtacgagctgggaatcgaagccatgcatttggctttagagcaccatgctcttgagcacatacttgcctgtctctggggaatgtgagcgggctcctggcccgggcctctgcccactcctggctgctggtagcacccccacccatcatgaccacagatggaactagctcttctgttggtttgatcagtggcaccagtaccctctggctactccagctgagagtcctggattcattttcatcaactctctaactctgtcaactggtctcttggttactttggaggcctgctaagggtgtccctaaaactctttctggagccagactggatcatttcaggagctctctacagctcttaattgcctcccgcttctaccccccagcttagcctcatcttcctctccatcctttcattcctctgtcctgcctgttcacactaggtccttttgcccttgtcttttttttttttttttttttttgagacacagtttcactctgtcaccaggctggagtgcagtggcgctatctctgcttagtgcaacctctgcctcccaggttcaagcgattctcctgcctcagcctcctgagtagttgggattacaggcatgcgccaccatgcccagctattttttgtatttttagtagagacagggtttcaccatgttggccaggatggtctcgatctccttaccttgtgatccacctgcctcagcctcccgtagtgttgggattacaggcgtgagccaccgcacgaggcctgcccttgccatttttgtggccctgaactctgcttggcttctttccacttaaccccttccagctcaaatgcagtttactgtcttaattttctttctgcttccttctccccctcctgtgtgccaacattagtgtgtttgaaccttgcatgacatttgtttcattccaccatctgttagagttgatggttttcagtttgggttccttcctcagggcagggagaatcttggctgttaggtttgtcgctgcagttcctggccactggtgaggtgctcagtgagtacaagagtaaaggaggagacctttctggagaaagaagctaaaccagggctgcaggaagtggaggagctgggcagggccagctagtcttaggccaaagggatggtatatgggtggacacttggaggggtagttcgcagttatctcttcatccaaagcatgacctgaggccaaagcatgacctgaggccggtcctgaggagggagagagaaagggaggagagtttcctgtccttcagcaatcaagactgtgtgtcctgcctatggagagatagaagattctttctatttttttttttttttttttgagacggagtctcgctctgtcgcccaggctggagtgcagtggcgcaatctcagctcactgcaaactccgcctcccgggttcacgccattctcctgcctcagcctcccgagtagctgggactacaggcgcctgccaccatgcccgggtatttttttgtatttttagtagagacgaggtttcaccgtgttatccaggatggtctcaatctcctgacctcgtgatctgcctgactccgcctcccaaagtggtgggattacaggagtgagccaccgcgcctggctgattctttctattgattgagataagttagtatacaagatgcaggattttgtcatttaagaatggagaatcagggttaaccatagagataaaatgaagtatatactcctttctctgaccattgaccaaattgttttaatacgcatagactggtgacatttgcactggaatcctgtaatagacatagctcatgtagattccttgttgtatgagcaaggggtgaccttcaatgctgggcttgagaggaatatcttggaagcgaaaagattgaacagagaccccaagagtcaagaaagccaagaattttaatgtttttttaagaacctacagtgagtgcaaggccctctgagtgtgatatgggagacagaaacccagatacttttcagttgtctagagagatatggctgctaggtcaaaagagtgaattaccatgggtggggctggagttagagcctcaaggaaccttggcacattttggacacctaccacgtgccattagtccgcacgtatgggattagagtatcaagagtaaattgctgattgaaaccttaataatattatttttgtctatgttaattttgattggacaaactgacattgacaggtacaattcactccatttgttcaatatgtaacatcttggtaacctaactctgtccctttctctgctcagaagacaactgatggtagttaggaatactttgtagcttttgttaaccatccgtttgttttatattgccaaacttacatttcagagagagctaagaagcactttttcctctacctttgaatgaattaactcccctgagctcagccaaagtcaatttttttttttttttgtgagacagagtttcgctctgtcaccaggctggagtgcagtggcacaatcttggctcactgcaacctccacctcctgggttcaagtgattctcctacctcagtctcccaagtagctgggactacaggtgcgcaccaccatgcccagctaatttttttttagtagagatggggtttcaccatgttgaccaggatggtctcgatctcttgacctcgtgatctgcccactttggcctcccaaagtgctgggattacaggcgtgagccactgcgcctggccttttttttttttttttttttttgagatggagtctcactctgtcgcccaggctggagtacagtggcgtgatctcagctcactgcaacctcggcctcctgggttcctgccgttcgcctgcctcagcctcccgagtagctgggactacaggcgcccaccaccatgtccggttaatttttttatatctttagtagagatggggtttttcactgtgttagccaggatggtcttatctcctgacctcatgatccacctgcctaggcctcccaaagtactgggattactttggcgtgagccaccgcgccaggcattttttttttttttttaaacatcacttttcaaagttgaacttttccagtactctggggagtttggggcaattggaggtccttttccaaggggggaatcagagcaacacaaaccacagttggcaatgggagtaaggagatctgatgaactgaaagaacttggagccccagaaaactggcttcctttgttcagatacttccggtttaaaagaccacatcttgataagacgttcctcattatcatcgttgagctttgaagtcagcaggtttggtttgttttccaacactgtacgtagtctgtctttgccttttcaaagctgtgggggttatgccgggcgcggtggctcacgcctgtaatcccagcactttgagaggccaaggcgggcggatcacgaggtcaggatatcaagaccatcctggctaacacggtgaaaccccgtctctactaaaaatacaaaaaaaaaaaaaaaaattagccgggcgtggtggcaggcacctgtagtcccagctacttgggaggctgaggcaggagaatcagttgagcccgggaggtggagcttgcagtgagctgagatcgcaccaatgcactccagcctgggcgacagagcaagactctgtctcaaaaaaaaaaaaaaaaaaaaaaagctgtgggggttgggatgtggcaaattaaatccccatagctcactggacacgtcttcatatcacactctgtggatcacacaccatgcttccttgtgctggagtggctctttctgcttatctttaaagcagttttctcagccttggtgctattgacattttgggacagatacgttttttgtgaggggctatcccagcctatcataaagagcaagaatttccaccttactcaaatttccagagacaaagcctatctttttaaaattcttcatttagagcagtagttttcaagtaggagtgattttataccccagtggactttggcaatgtctggagacatttttggttgtcacaaaggtttgggtgagtgtgtgttactgacatctagtaagcagaggcaggtttgggtgagtgtgtgttactgatatctagtaagcagaggctaggaatgttgctgaatattccaccatgcacaagatagctccccacaacaaaaaattacctggcccaaaatgtctacagtgtcaaatttgagaaactgctttagaagaacatggtccatccctgccacccccttcagttttcaggtgtattgctgatggtcatacagcaagttagtagccctagttgggatcagagccctgagttgtcaacagtgtgccatgtcttgtgaccgtcatggtgggaaatgggcttctacaaaagacgaacttaagatgaggtctacagttcacagcagtctgcagatgcccacagttccttgctggggggcaggtttccagggaacgggagctagttgctgtttctgtattctcaaccagagaaatgtgggcaatacaagtgctccagaaagccagcaagaggagtttagtcagttgcccttggaagatgctcaccctggtgctgctgtagtttccatggaggctgggcatgagccaggcttcccaacaagacaggcatgtgagctggtgtaatggaaattcagaaggcacttgagctggggagcagaggaggtaggccagtgacatccactgagggacagcctgacagttactgggagaggctgtttgatgagctggagtcaggctccctggggttgaactctggctttctgcataacacgcagtgtgagcttgggtcagttactctacctgtctaggcctcagtttcttttccctataaaatgcaaagattgtttggataacactttaattgagtagttgtaagaatgaaagagaaagagggttaacaggtgtcaagctctgagaactgtgcctgacatatagtcaatgctttatgtattaagtattggtacttaacaatggttcaacttgatttttttttgacttcacaatggcacaaaagtgatacgcattcagtagaacctgtactttcagtatttatataaccattatgttttgcactttcagtacagtattcaataaattacatgagatattcaacactttattgtaaaataggctttgtgttcgatggtaggttaggtgtacgaaatgcatttttgacttactaatcgggacataacctcattgtaagtcggagcatctgtacatagggagagacacagtcttagatgtcccactgcaccgtccgcctggacaggagcaaaaagaggccctgctttaccctggataactcccaagagcttcttttagagtaagtggtttcaggtccatttgtgtctctgtgtgacgttggattgaatcagaggacagagaagtcagaaggatggaaagttcctgaagccagggaagaaggatgcgtccaccgtgcttctaaaaccttctctttcctgggcgtaggagatccatccttaagctcttcctctaaattgcttttcttctggtcctctacagaggtggctcccccattcgaggtctctgggatgcctgggacattagtgcacttcaggttgaagcatccttgcgatgtcgcaggagacacagttgtgctgaatgatcacagggttagttccagctccttttccctaacctctgtctccccggtaactaacccagagaagagcagaggcttcagagggcattgtggaggctgcttacttgggatttcatattcttctgctgtggagtttgtcagttaaatacttgctcactcatcctcacatctctcccagacctggctttccacaggggaaatcatttgcagtgccctgtgctgaagagtcacaggacccgccatgataggtttggccccaccgacccctggaatttcacagaagggaatggccattctcacattctttcggcagattgggtgaggttccctgggcatcctgggatttggcagtcagctctttgcccctcatatacagaccctgggctgttgagtgtgttccttcctgctgagcccagggtgccctgggttcttcacgaagcccagggggattctgcatgtgcaacccataccctccatcccacctcttgaacagccgttgccttatccacgtcaggagtcaggagtcttggccctgttcctgtgaacagagaatctcatttcccctaaaatgctgccctcttttaggggtggtcactcattttgtttgcagatggatctctaagcatttcccggacattctttcctgccttggttaaatcttatctcagcgttaaccaggagagtgagtcaggctctgagaaactggctctggaagcccttggggcccacccacctcctgcccactcagccttcctgcctttccaccatttctgccctggatgcttggaggtggtccatgttcttaaaaggcctttttcccaatcccttccttctggcatctccatattgtctgaaggaataaagccagatgaaccatctgacagctttaattagggttaaatgagggcattcgaaactgccacttttccttctttcccatttgagggacttcctcttcctgcttcctgtttcctcccaaacttttctgtctcagtcccctccatgaagtcctgtagcctcttcccatcagctctgtgtgtagtaactcaggccaccctcaagctgccctccaggtaggtcctgttattatctattattcaaatgaagagaccaggcacaaaataggatagtaccttgccccagggcaagccagaatccagacccaggcaatgtgactccagagccagtgcccttaacccccagcacaaagctgctgggacaactatgtttcagtttcacttatgtttcagtttcatggggttatgagtcaggtatcagctgggaagggacctttgggaccatgtagtctaaacaaacccttcattttacagttaaggaaaccagatgttgtgtactaagggaccagcccaagctcacataggataagccccagatctggaacccagtttcttgatccccatcatgtttttttaaaacacagtttgtgcagcatgaactcttatcattttaggtgtcagtttcccaagatcaaaggcaggatttacttagctgtatctagggggatgccctaattgtccaaactgggccgcttttgaaaatggaggaaagcactatcagtagttatgccatgaccacaggtgtaaactgagattgtcttgggtaagcagggaagtgtgggtaccttgcctgtggtgggtgtgatcttggggtggatggggcagactgggacagacccagaggtatttgatccagcaagtggaccgctggcagcagacaggagtggggagttcagatgccactgtggggcaagaggctcagaggcagattctggtccctggcctggggctgtcgaggggtaggcagagtctgacttctagggacctagcatcctaggcagggcagacaggtggactgggaggaaaccatgctgctgcggggatcccatgcagtgtgggcgccagcctgaagagcaaggcccgacacagagcacctggtcagtcgggagtagccagctcttccccttcaccaagttacttgtcaacttttctctttggtgttcccatagccccttgtgtataactataacaaaggtttcttgagcacctattatatcctagtattgagatagctgctgctatgactgcagagaggccatttatgctgggctatggagggtcagtgggagtttgttagacaaggggaggggacattttgggcagtgaggccaacacatacacatttctaaccatttcaagacaaacactcctcagattcacattgatgtatgtgatttaagtgattgtaaatccatattttattaatgtaaaggaaactgcctactgttctgcccttcctgtcagtttgtaattacttgttaatgtatctgtcttctgccaatagactcagccccttcctggcagaggctggtgtctcctttatcccagtatcctcagtgcccagccctggcacactcaacttggcactcagtcaatatctgttggcaggtgaactgtgccagggtcacatgcatctgggacataatccccctttgctctgctgctccgcagtcagaacagaatgtctgaggacaggaggaccctgggccgggtgtcccaaatgcccatctcctggaccctggacaggtgctgctgcctaaggtctgtctggctgtaacttgatgcagctgagactgagaactggaagaacaggaagccctgtgactcacaaccgctgcaacaggatcctggaggagtggcccgtatgcctccctggtcagctctgcgcttacccgctgcctcgggtttgtgagtctgcagtgtgtcagagctggcattggcctgaggtggcatggctgccctggcgaggacaagttccttgtcccatctgaagaagtggcataggagatctgagtttcggttcatgggctttcagaggacaggagacttacagaatccatgttctgctgtgtgtcttccccccggctcatctttttttcttttatcagaaacatctggccctgccctggcaactttgtagaataaacttgctgctctttgtacagcctcagccttcccaggaggagtctgtgagggcattattattaatgaggtcactgacagcagttgcttggctttcccagggtgggcacacctgtgccctaggttagggcactcggctggtcactggatgctatgggtcttcagggactaggcctgtgatttggggaggcttctccaagtcttggtttccttgtcagagagttgtggtaaaacactggcaaaggaataatgcaaaaatatgaaattcttttgaaattaagttgcaagcatgtgtcagcacagagtcactggaagtctttgtgtggccagatttaaatgatggatctctctttgtttggcctcttttgacctctttaatcttctttggctctttgactgtgtatagtgggtaaacttgggccaagtcagtgcaacctgcctttttttttccagcgtcttttgaattgaagtataatgcacatgggaaactgaaagcagcaggtaaccaccatccagatccagtaacagatcattacctgaaccagccccgtgttctcctacccaccaccaccatcaagtgtaatcactgtcctgactaacagcataggtctgtttttgtacttaatataaatagactcatacaggatataaaagatgccatttgtgtctggcatttttcagccagtgttttactgtattttgagattcatctatgtggttgcatgtagtggtaggtggtgcattcttgttgctgtatactatctcttgcaccactctggcttgtttttgtttttaagagacagggtcttgcactgttgcccaggctgagtgcagcagcgtgatcatggctcactacagccttgacctcctggcttcaaatgatcctcctcagccaaagtattaggattactggtgtgagccactgtgcccatcccaccaccctgttttgactgtggttgatttaaagcagacgaaagtagtcataataaggcccctgacttccagaaggtatggtcctttctaagtttctgtcaaaggggccaaataggagtgttgacctaatatatagatgacccgattgtatcttcaggacaagaacatgcatgttaagaaaggtgaagttcaatcagttggtcttctagggtctagaaactaaaaggtaggatttttagctgtggtcatctagggcacctggagagacggttctagataatcaattagaaatatcccaagactggggagacaaagttcagctgtgccacaggcatcctgcatcctttgctttgatgcttctatgcttgtggagtaactttcttatcctatgtgatcacttgaattcagccctctaccaggagggtgtgccctgcagacacaagtgatgaacatttgcttattcatgtattatgtattttctgcttgcttactaaaaggatttagtgatttggttcagctttcagtaaaaagatttctagaacgagagtcatcaaactggcgagatgattactgaaaaacttgacaggccaggtgtggtggctcatgcttgtaatcccagcactttgggaggccaagatggaaggattgcttaaggccaggagtttgagaccagtctggacaacgcagtgagactctgtctctacagaaaaaataaaattaaaaaaatcagctgggtacgagggtgcatacctatagtcttagctacttgggaggctgcagtggaaggatcatgagcccaggagtttaaggctgcagcctaggagtttgaggctgcagtgaaccatgattgcgtcattgcactccagcctgggcagccgagcaagactctgtctctaaagttaaacaaacttgacgaagctccaagcttcctgacagtcaaggcaaaaaggatagttagttctctttgagtcagtcgttttcatcccatcggcctataacaggtagcacagtgtgtctgggcagccagactttctcctgacactaacccttactggggactgaatggctagggaagcattagtgaaagacacagcagctttacctggtgcagtggtctttatagtctttcctgtgagcccttgattaaaagtgatagaactaaacctatgaagcatttcatggggagctaatgtaatgttgtgaaggtgaggagctttctgttcctggaattggtaatttcccagggtcttaggggcttgcccatgcctcctgagccttttcacactgctgtctctaggtaagcatttatctgctaagatggctgagctccaaaagtatcccctttgattgccagtctctcaggccacttaaatctgtgacacttcccatgggctgccttgtattgtgcccgacattcttattagacaagactcatctctccacgcattctagagacactcattggtctataatatgagccagcttctttgatataaagtcctagagagcagggctgttgatttcttaaaatttttaagaattgtaataaaatattaatcacaaaatttaccattttaaccattttaagtgtacaatttagtggcattaagtgtgttattcacattgctgtgcaactaccaccactattcatttccagaattaatttcttgtaaaattatgtttctgtacactagtgctttgtatttaatagctgttccataaatgccataacatggaagatgctggggttgcaacagtagtcaggattcagggattgaatgatacggatcttacagacttagacattgaaatttaaggtttcgtttcgtctacacttcccttttaaaacccttgagtaccttactcaaggtaggatctgtagtacttcatataaaaactgtcaaaattggaatattgctgtcttctggatgtaaataatttgatcaaggccaggttcccacagggaccagatggggtgggctcaggatccaggcagtggcaccagtctttcagttgcattgggcctgcagaatgagatgggcgcttctgggccagaagggttgacattcatccaggtgatccagattctagtttcaactgtgtgacctgggtcgaggctgctccccgatgggcctggtttctctgagatccctttcttgcagtcacctccaggcctttccttcctgggcttccccatacctggccaggactgtgtatggcccaccctgcacactgcatacttcgaagtggagcctccatgaatgtccccttttgttctctccatttgttgctttgtgacagtgacacaatttcctctccttttttaagtgctggtctggaggaaaatgcaggtacttaaggggatgggtgttaatggcttcccattttgggtattatcttatttcctagagagtatggggttaatttgtctttagggcttcccctgacaccaaccccaattctgtagaggaagtgggcatgtcagactggtatgttatgggaaaaactgaaactgaccaaaattacccaatgaggaagctctgatctaacccttgctgaagaaatatcaactaacagtgctatctctgtctaacacgccctcgcttcctgggctggcagcttggcaggcagacgggaaggtaacccgttcttcagccaggctttgctctggcctgcctccgattccccagcctggaatgccccctcctcctttcctcctctcccagatagagatttaaagagaagcagccttgtccatgcccatcacagaaagagaaggaatagtttggggaaacagcctctgctttgtgactaaggagggttgagaaatgtctgtgattgcctgaaggtgcccctgggtggagagaagctttagaagaaagaaggggtggaaggaaagggggggtgatagagaactcttttgtccccacagttatgctaatgactctgtcatgtggggctattcatcctgttttgtggcaaggaagctggggttcagatgaagagtcctctaatgtcgcacacctgtacgaacgctaccactaggatttgcatactggtgtttctgatgccagagcactcctttcaccaccaccagctacaaatcaagggttgacctgaatgagtctgctttgatagtatccagaaacttacatctcttaaaaacaaatgcagagtttgtcttcccaactcccagcaggctggatcaacacaggattacttcacagggtcacacctggcctaatatcttaaccaccgactctcaaagattccaggcagaaaagtgatatgcagtgttgatcagaacagggccaaccacgatcacgttattggcatattggaaacctcccagaggagaggggaaggtgtttgagccccagccttagaggtgtcatttggttagtctggaatggatccttggaattcttactgttttctttaaaagctcctcatgtgattctgatgtgcagcaagtttggaaactcttatcacaagtgacagaatggagattaggcagaagtatcagaaagcagatttatctttgattgaggaaactctttgaaacaagtagagctgttcaaaaatggaatttagagaaatagcgagcctctcaggcttggaagtattcaaacctaggccacatgactatcaattgggtggagagagacaaactagataaattcgaatactatgtttagtgggattttcgaactagttaccctaagggcctttcctttctatggatgaatacttttcagctgcagtcccactgctgtgtgtacatctgctatcacctgcttggctttctcctttgactttgggcctggtgctccctcccactgatggcactgtgggtgaaagttggcaagattctgaaaattgcattcatctccttctcaatccaggaaaatcatctttgtatggtggctgcttcttgtttctgacttctgcttcccttggctaccaacacagcagtgcctaccagggctgggtgggctccactggtgtgtttaggaaactgtggcattaagtgattattaattatcccttcctgagtggccctaataagctgagtggacacatcatcatgccctggtgccatctgttctcaagttttgagagttcaaagagctctgatgtgaaagaggggaagtttgggccaagctactggcctggacatttttcactgtttcatatccacagctgtttcatatcttctctcttagtctcctcatgtgatggagaggaaaataaggtcccagggtcatccaagaaaccacagggcaggctgggagtgcccatccacactaagaggggcccacaggacaggcgagggtggctgtcctgacggcctggcagtggggccagacagacctctgtggaatcccatctctgcccctcattacccaagtgatctataaaacggaggtgcagaagttttacgaagacaatggagaacaggtcaggaaagccggaagtgcctgacaggtgagaaatgcttgaggaatgcttagccgctgtaaccatcaccccattactgttttcatctgtcattgaacatgtggaagatggttatctatggggcaaaaggcaacgtggataaagggtgactgtttaactcgattcttcaagggttgaggatgagaagtgtctgactggatttccaacatgtcttgaaacagtttaaacatcgaagataaactaagattggctgtcgtagaatttgcttttttgtgtgcataacctcatgcttctggacatgatgataggaccatttaatgaggtggaacaggctcagctcctcagtgcaggaactcctgtgccctttgcaaacacctgaagccttccatagagggtggaggtggggcgggggcaccaagaagcttctgggcctctcttctctttgggaaagtagtgaggtgagagtgtctttgtcaggtgtcaccctcatgacaatgttcagagacatgtctgctgccccagacctgctcagtcacctctgtgtgcctcactctccactgcgtgctgttcatgtctgcattgggaggtgactggaatagaagatggccttttaatggatatggacagcctgcattccctgcaatgctgtttgacctgtatagaccctgctgtatccaggcaggcagggggcagtcatctagcagagtggacaagagcacagaccagccaaacttctctatcaagccaaacgtggcccctcgtgtctgtgtgacttcccctctctgtagaatagagatgctggcacttcctacctcagagggctgttctaaggatgaaatgaactaatgggagcaaacccggagaataggatctggcacaaagcaggagccacgtgagggcttgccattattacagttgcccatgaggacatctcaggcttttcctggatgtggcctcgcattggcttctggtctgggtagccccagactttgcacattagccctgagatgtgaaagttgtaatgtagcattcctgggccagtcagtgtctcattggatctggagtgggaagcctccagggtggtcagagttacccttgaactagggtcactggagatggctagagatttgtctgacacttcactgaaaagaaaggggccttgtctagtgtcaggctgaagctgcaccctttttcctcctggggagcctcaaatgtccttgttggggaggcccaggcctcctcaggagcaccttggttcccagatattgtaggaaccagagatcagagacccagcttgtgggatggagggtggggggctagtgccccacagccctggaggttgtggtagattccaggagttggaaacaagctgggcaatatagcaagaccctgtctcaaaaataacaattaaaagattaaaaaaaaaaaacaacaaaaaacgagtgagagttatctgatgcttctcattctcctggtattaaatctgggaaaagttcatgtgaatttatgtgggaaacaggatcagtgaaagaactagggagagttgcctccgcatgagcacagaggctgcattatcatttacatagagcctctccattgtgccaggcaccgtgccagcctccaggtatgcaaaggtgaacaagcagacattgttctagcctttggtacttatgatttggaccctaataaatatttagttccaaattgtggatagtgttgcgaagggaaaagctcaagttcttagaataacagggaggcctggctgttgtgatctggaggatgagaagaggcctctacagagagaggcctgaaggagtggtagcagatcgtcagggcatgtacctggagggcctgtgtgtgtgagctccaaggcagggatgggcaagttggggaagttggggaactgaaccagggagagaatctacacaaagagtccagaccttaccataagattaggaggtggggccgggtgtggtggctcgctcctttaatcccagcactttgggaggccgaggcaggtggatagcttgagtccaggagtttgagaccagcctagacaacatggtgaaaccctgtctctgctaaaaatacaaaaattagctgggtgtggtggtgcaccgctgtaatcccagctactcgggaggctgaggcactagaattgcttgaacccgggaggcagaggttgcagtgagtcgagattgcgccactctactccagcctgggtgacagggtgagactcagcctcaaaacaacaacaacaacaacaacaacaacaacaacaacaaaattagccagacatggtggcacgtgcctgaaagtcccagctgctcaggaggctgaggtgggaggatcacctgaggctggctgagatctcatcactgcactccagcctggacaactggagcgataccctgtcaaaaaaaaaaaagataaaaagattaggaggtggctagaggcccgatcatgtggggccctgaaaggattttgagctttgttccaatggaaagccctgaaagccggggatcagcggagtctggctgggtgtggaaagtggatggaagaggtaaaagcggaactggggattgtaggcgtccgggaaaaaggtgatggctacctggcctagggtgaggggcaatgggattgctgtgactggccatgtcaggtgctgggggaacaagagatgagggtaatgaaccctggctccagtgatgttgtcacaggccttccgactcaaccattctgaaaagaactctcctctgtcctaataggcctttcctcaggtatgcaccagttctccaaaaattaggtctatttttataattttaattttttggttttttttttttaagacaaagtcctgtcaaatcggttcctactaatggtctttaataataactttctgtacataacagattttgttcttttgaagagctgagtggtgttccatgacgtacacctatgccataatttatttaaccagtggtttctgctcttgtcttcctcctttttcaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacaggtactgcatctgggggatggctctagctgctgcgttactcaggggtgatttagttggctttgctcagggacccaaataactcaaaagcctcagaaaccaaccctggctaagggaagcatccagggaattgaatggaaggctgtgtgacggatggacaggaagcttgggaaaagctggcagtcctggcagttaagggagggcacctttgtcagccctactgtggcatcactgttggccatttgttttctacctgtgtgctgagaaaggctgcttggctcagtttggcattttatggtcccactgagattgcacgcagtgatggtgatgaactacaacaaacgtacctcacgtggccacaactgtaggccgtgggagccgctctgtggctcacctgtgcatgctctaactgggacgccggacgccgtgtaggcatgtgggagggacagtgtagtgcagattgacctagatttttttcttgagccccatgtaaaaagtactagaaatccaaatagacttggacaaagtatggagcgtcacagtgcatatatatatatttttttgagacagtttcactcttgttgcccaggctggcgtgcaatgatgcgatctcggctcaccgcaacctccgcctcctgggttcaagtgattctcctgcctcaccctctggagtagctgggattacaggcatgtgccaccaagcccggctaattttgtatttttagtagagatggggtttctcatgttggtcaggttggtctcgaactcctgacctcaggtgatccgcccgcttcagcctcccaaagtgctaggattacagctaccgcgcccgctgccacagtgcatattaaggaattaaaggctcagaagtcctgcaatacaaacctattaagctttgtttaatcatcttatttggatacagagtacttttttttgagatggagtctcgctctgtcacccaggctagagcgcagtggcgtgatctccattagccagaatggtctatatcttttgacctcgtacccgcccacctcggcctcccaaagtgctgggattacaggcgtggctaccgcacccagcccagaatccttattttatggtacaccacccagcaagtgatttaatcaggcaggggaaaaaggatcacggtggagattcaagttggaaaggtccagtggattagggctaggtcactgaaggccttgaatgcaagcctaaaacatttaatctctgcagtagcattggggagtaaatgcaaggttttgaggggtgtcttggtaatgttacatcattggcagtataggtagagtggagggggagcgaggcccagctggtagagcacaagacatggctctggtgggtgggcaaaaagagtattcaagggtggggcccggctgttgagcccagctgcctgggaatggcaacatcccagagaaggggaccgaacaaagttgtgtcagagcttttatttaatcctcataataggtgcctccattttagagatgaggtgcttgtgaggcccatgacgggtggtgggtggggggtaggtactcacatctagaggacaggagagagaacccaaggggcagctgccagggcagaggaagaaccaggaggcacagtgtccaagaatctaagggggacgagatctccaggaagctggcaggtcgctggtgaggcatctacaggggcgttgttgggaggggagtaggggcagggcgtgggtcagggcttgttaatgccacgcgcctgtgctgtttccagcacatgtgtgtccttgaggctcatctccctaagtgcctctagggacctggttcgtctgagactgtatcgttcccaaaataagtaagtgtttgctgaagccttgggacccagcctggacccagtgctgagggtatgaccttgcttaggattgtttcctgagtgtgtttcttggcccttcaaagagcccctcgaggtgaggggcctcttatctcttccatgtcctctagattggcatgtttacctaccactccctctgactggaaaccacacccacttctgagatttttatttgacattcagataaatgtacacactccggaaggccagggccttgtctttatttcacccagcactaacactaagtaagtaccctaaatcttttctaaatacatatgggctaaggactcttttgggcacctcaatgtattaactcatttacttttcaaaaacctttatggtaagtacaaattttatccacaatttttagatgaggaatttgaggttcaaatgtcaaacaagttgtccaaaatcctacagccagtgggaggccgagttaggaatcaagcttgtgtaagccaaagttcaggcatcggtactgcacgtgatgtgttatatgtgttcatgtatgtgttagcctgtgcacttggcgctggagcacactgcaaatgctcaactaaaatttttttggaacggagttgggactgattgtttggactgtattataggcaggtgaattaagtttgttggggagaactaattatggggcaagctttcaaaattctcattgctttcctgaagctggaggctccaagacctcccatgcaccttgaagcttgcactgtttgcagcacatactggaatgtcttactcactgaaacaaaggaagtggcccctggaataatggagaccagattgcaggaaacccacacctaatccctccctccgcatttgcagggggtccataggttagctcctcacctccatactctctgggactcagcctttgcttttgtaaagtaaagaggttggacctagcagttctagtctgttctgcacatctactagaactattgtgctagtctattcacacaaacacttctgagatcctgtaatgggagataaacccttggtgttcattggatggtgtcttagttcatttttgtgttgctgtaaagtgggacatatgtatatatgacaactcagcaattccacttccaactatatgccctgaacagactcctgtatgaatccaaggagacatggctgaataatgttcattacagtgttgcttaatcgcacctataatcccagctactcaggaggccgaggcagagagaatcaatcacctgaacctgggagatggaggttgcagtgagccgaagttgcgccactgcactccagcctgggtgacagcatgagactctgtctcaaaaaacaaacaaaaatagataaatttaaaaaaaataaagtggtcagcatcagggctctcaagttttgctttgtcagttgggggtatgagttatggaatatggcagtgaaaataggtgactcctaagttgatacagactatcaaaaatgaaaattctctattgtcagcaccccagtgaagtgctgcgaggaaaggccgaggtgaagttgtgttagcgattccccccatgtggtcgcacacagcctgggtgcctgccgctgctgctgggggtgaagctgcatccctctcccacagaaggctcgaggccttttctccaggggcacctgttcagtgccacctttctcagaacattcgtttctcagcccgttcatggctagtattcttttcaaacctgagaaaccaaaccccagatctagagggagccaatttttaaatccatagctttctaacttttctgggctatatcttcacagcaagaaacacatgcatataaatatttatatgaaaggaaataaatttggggaccagaatttattcttaaacatgatgaagttgggtttgtcttctattctttaagaaagttgctagtcagaacctgctaaatgtttttcactttgcagtttgaaagccactgccttaaatgatccttggcccagtttgattctagatgagcatttcctttcttgctggcacgaaatatgtagtttcaggacagtgtggggtgagaggtgagaatcagaattataggttcaaatgggtttgaattcaagctgtgtgcttcagagcgatttatgatgtgatcctctatttcctcatttgtgaaaaggggaaacttcagggggatcggttttctgagaattaagggagaatcagatatgtgactttctcacatgtgttacaaacactcctgcagccacaaaccaccactgcaaaaggcactctcattgccaaatttactaagaaaaggtgtgtaagactcccaggttttaattttggaagattggcatcaagggagcaggtgtgagggttcatccccatcaccaggggccctgcattttggagtgaagaccaggccccagctcttataccagctccaattatctaattgtaatcaaagtcctattagaaaatgtggagaaaccagaaagtttcaggccatttatttgtggtggaggcctccccatcacggcttatgggctcttgtgtgagaaggcagggaatgtcagtagccactgaaccccgtaggggtgaaatgttcaaggtaaatcgtgaagtacctgtgcttcataggttgtgtggcctacacagtgtgaagaaacacagttggcataattaaaagtgcaatagacataaacggtccaggaatgtcttactcaatgactgaatttggtgtcagccagaatacattaaaaatggtctctatttgtcgttttgcttctttcccaaacagttttaagaagttgaaagaattctatagtggtcatctatattttacttggtttgctttatcaaccccccaatccttctatccatcagtccagcttgttataattgatgcattacaaaacataaattgctgagaaagtatagtaaatactaatactgaactctagttactatgtatgctgaagttttagggttcagacgtatacttacatagtaactagagttcaatatttgctgtattttcttgtgatgtaagatctagatgaagtgaaataaatcttaagagtattatctgataaaaaaataaatagaaggccgggcatggtgtctcatgcctgcaatcccagcactttgggaggctgaggcgggcagatcacaaggtcaggagatcgagatcatcctggctaacacggtgaaaccctgtctctactaaaaatacaaaaaattagccaggcgtggtggcaggcggctgaagcaggaagaatggtgtgaacccgggaggcagagcattccagcctgggccacagagcgagactccatctcaaaaaaaaagagtattatctgatgaattgacaaatacacctgtttaatacaacctccatcagaaaagggaatgcttatacactgttggtgggaatgtaaataagtacatcctctatggaaaacagtatggagatttctcaaagaactaaaaatagaactgccattccatccagcaatctcactattgagtatctacccaaaggaaaagaaatcataccaaaaagatgcctgcacttgtatgtttatcacagcaccattcacaatagcaaagatgtggagtcgatgcccatcaatggacagatgattggataaagaaactgtggtatatatacataatagaatactgttcagtcttaaaatagaatgaaataatgtattttgcagcatcatggatggaactggaggctgttattttaagtgaaacagctccaaaacagacaaataccgcacgttttcacttataagtgggagctaaacagtgtgtccacatggacatagaaagtggaatgatagaccatggagacttggaagggtgagggtaggagggtggggggcatgagggtaggagggtggggggtggtgtggatgatgagaaattacttaacggatgtagtgggtgttggatacactaaaagccctcacttcaccattgtgcagtatatccatgtaacaaaattatgtttgcacctcataaatttaaacaactaaaaaaaacctccatcaagatacagaacattaccatcaccccagaaagttaccttgagccccttcccagtcaatccctgtacctgatccccccagaggcaatcacattctactattttccacatatgtgagttttgcctgttccagaacttcacatataaatcgactcacacagtatttgttttttatgcaagtctttttttatttgtcataatgtgggatttatctgtgttgtgtctatcagtgtctcgttccttttggctgctgattccatggtatgattagaatctgatatgaatattgatggacacccgggcagtttccagtttttggctatttgagtaaagctgctatgaacattattgcacaagcccttttgtggacacgtttttagttccttgtataaacaactaggagtggaattactgggtcattcatagaatttggtatatgtttaatttttagaaactgccagacatttcccccaaattgttgaaccatttatactcccactaataatgtatgagagctctgcctgctccatatcctcaatagcatttgttgtctgtatgtccttgtttctttttttcagtggagagttaattaaagaaagcattcatttgcgtttgctaggaaacacaccatcttgacctctctgtaggcagccctaatctgtgccacaaccctgcgtgtgactgtggtaccagccctaacgcagttctgtcaggggccccaccacacacataggggccacacataggggcctggctttcagaggacagttccattttaaaagggaatgcaggggtcgggcacggtggcttacgcctgtaatcctaacactttgggaggccaaggtgggtggatcacttgaggtcaggaccagcctggccaacatgttgaaaccccatctctactaaaaatataaaaaattagccggttgtggtggcatggacctgtaatcccagctactggggggctgagacacgagaatcgcttgaatctgggaggcagaggttgcagtgagctgagatcatgctgctgcactccagcctgggcgacagagtgagactccgaaaaaaaaaaaaagggaatgcaggaagaattgatagcatttaatgagcacccatggtgtctgtactaggccatttacataaatctgttttactctccacaaaaactttacaagagagtcattctcactttaaaaatgaggcaaccaaggctaaaaaaggattgatggctgccaaggtcacctgtgggcagatggtgacagttgggatgtaagcatagatagtcctgactccacggccataagattcacagtttacattggcttgtactgctgaaccaaagtttctagggaaaatcagatgattatctttttaaatggatcctaaatacgagttggctttgtatcattccaataagaagctcaagtacaacccaactgaaaatgtgccagccgcatgttctaacttagaaatgaagtaactgtggtgcctttatcacccttgtcttggcaagatcgtttggttataactatgccttatgagacagagtgagggtaaggcagtgtcagatcgatcatttgactcttcttcacctcggaattgtgaattatgttcacaggtaagtatacctccatcctctagccagacttaaaccctctagagagcagggaaccatgatgctgatggtgacggtgatgatgatgatgataaaaattgtagacatcgttagtgccaggtactgtgctgaacgctgtgtttgagctatctcatcatttcttacagtcatccagtggtaggtacgctgaacttcactttacagaaaaaggcaatagatttggagcaattaggcaacttgcccaaagtcacagtgagcaagtggcagcattgggattggaacttggccagccaaattgctaatgcctgggcttttaagcacaccaccagtggcacattggtgctgtgctgctagcacaatgtgtggattcttctcttactaacctaggcctagctgttcagctcattcaacagtcctctccgaggcttggtcctctgtgcagcagcagtgtgctaagctgcctcgtgccctttaaagagtgaaagttgtgctggggagataaggcccatgtagacaaaacaattagagatatcgggccatataatgcaagcacatgatgtgataaagggagaccgggctggtgatacgttgcatggaagctggttaaacctgaaggaagcccttatcttggttgctctgcattatattaacaactgtacagcggagacatacatccagagctagcacacagcaagttaattggggtacttacgtagtccaggcgatataaattgaagattgtactgatagatagcctcagtacagcagatggcacttacattgtcaggcgttgtgccaaacgccttacacttccttgcactgaatcttgacaaggtgcgtgtgtgtatgtgtgcgtgtatatgtgtgtgttttcctgtgttcttgttctgggttgtggagggaggtgctgactagaaggaggttatcgttacccttttaaaacagatgatgaaatctgagtgtcagatttctaataaattgcccaaagccacatggctaatgcatgttagagtgggatttgaacccaggtctgcctgcctaaaaagctgaacatgctcagagcttacacaatattgaaacataatcatgttttaaccctttgaagagtggtttcacatctgtggggctaattacacctctctgtgactggcacgtattttgagcttaagaaacacttcctgggtaaaaagagcaccagagtggtgcattccaagaggtgtcctaggagctttagggtgccagtcatgtgttttacgtgttccacacccctcccttcagttggagcagctctgtttttctctattttacgttgtggcatttggcccaccaattttatttggaaataagcattctgttgcttaaaatggtttgaaaacaaatgatgtagaagatcagatcactccattcctagtctgtaccagacaccagcgttaactgtgattcagtgcctttaatgacacggagtattgaatacttctgtatggctgagctcttgaatggtggccggcattgcattgtaatggagtaattggaatcctggggtttaaaaagaggctgccaggtgtggtagtgatcatggcgattccgggtacatggaaaatacgtgccttgagacctgtgtcttgctacattacctgcttaggacttggagatgtatcttttcggtcctcgtttcatttggagtatatgccatacattctcagagcagtccactgttgtgtgctagcaggtgcttgaaaactaaaggaaaaaaacaagatcccctcaacccagagtcaccccatagaggatgattggaatgttcagtgcagttacctggggccactggaaatgatattgtagggcagaaagggcaggtccctttaggggcattaagttataaatatagggctggttcaggaactgaatgtgaaagtatgcgtttgtgactttgacccacctccaagtttacggctgcatgcctcaggcattgagtgacaaggaagagccagaggctctaaggttggatcaaatacagtccagtgttctgatttgcctgagcctctcccagttttggcattgaaagtcccatgtcataggaaacccctccatcctgggcaaactgggatggttggccaccctacatggccctggagctcatgccctcactgctgctcagctcaactgtggcagcagcccttgagctgcttccttgtgctatcccagccctccacagtgccactagagccactagagcccttttggaaacagatctgaccttcttaagaacgaaagaaagtccttggcaatggtatttgctgtgcgtttatagccatgtcacgtgagccctatgttgtagctactctggacatgccattttttggcacccacaaattaatgccaacttatagttataccaaacctctgtcctgccttactggacaccagagcatgccacaaacctccatggccttgacagggagaaagggaacaagtaccttgataggatctattaacggaggaataatttactgtgtttcttctttgttgttgttgtcatttgtttgttttttttttgagacagagtctggctctattgcccaggctggggtacagtggcgagatctcagttcactgcaacctccacttcctgggttctagtgattctcttgcctcagcctcccaagtaactgggattacagggctacgccaccatgcccggcaaatttttgtattattagtagagacagggtttcaccatgttgaccaggctggtctcaaactccagacctcaagtaatctgcccgccttggcctcccaaagtgctgggaatacaagcatgagccaccacacccagcctgtgtgtttctatatgttcacatacaacatagtccatgtttcacgtaagcatcacaaccgctgggagatgtcagcattatgaatcctgttctacaggtgaggtgacatgctcagagagccctgtgatgtgcccacaccacacaggtagtgaagctgctgagctggaattcaaaatgaggcctgcctacctgtctaaggtccagtgcctaaccactgctctggcatgggcacgtaaccatgcgtgggcgttacgagagggcccgtctcaggattgccgagtcacagtgctaggcctgcctcagattccggacttggaaggaatgcagtcattggctatggtggttgtggcttcctatgtgtgtggaggagggctgcagggaggaggggtgtcagggaatgtgtgttccagaggagtcctgtaagcaaagcaagagaggacctccttcctgggaacaggttcatcagcaatactttattatttgtgttttcccttcagtccatcagaaaatcctgcacaccacccgttcttggtggagctgtggcctctgagtccagctgggctggcctcggatgatgacccaccaggggcagcctcgccacctcggtcccctgtggtcactgattcagcggatcgcgtgtatcctggacttgagagtgctgatgaggcatttcatctttgatatccctttcatccctcatgacagccaccacgttgtgtttcctagaatttggctgagttcccactaccagggaaggctcagagctggagtgtctggaaaagccacccatggccatgaggcaggcaggctaaccccagatgagggcgatgttgctgtagctagcccgcagctgtagctagtggtggggccacctctagtcactgggcaggaaatggaaaattagtgcccctaaggaggaatgctgccgtcactggagccaattccagtgacttttcttggacaggtttctgcaatcccttctgctttcgttggcctggaagagtcaagtgaggctgtgggacagggtctgcctagagcccggagagagagtacctagtacttactgagtgtgtcctgagttcttggtcctgcaccacacttgtgtgtctaatttttcccctcacagcaacccaatgagatgcaatgttcccattttagagatgaagcagctgaggctcagaggctcaggaacttgcctctgctaaatagtggccggggttctggagcaggtgatgtgggctccagagccagtctccgtgtgtcacatcgcctgacacacttctggttgtgtggtctctggtggatgatgtctaccgttttccctcttgggaccctagggactgtgggtggtgttctcagggagctggtcagatgtgacttttctcagggcctaagtgctggaggtgctgagtgcacctgggtgtaaaacaaacattcttgggttattgagtcagagcatctccctgacctctgacccattccgcttcacttcagtgctgttctcccaccaggaaaggggttgagtgttgacaaacatgccaataagtgaaccccccaggaaattgccttgtatccttgtatcctttgagaaggttgtggcagggcagcagaagactggcggtgctgctcgcagttggggcagtcacctgcggatgcgccttgcctgctccgccagcccctgccctgctgcaggttccgcgcctcttcagcactttcattctgtgccacacaatggggcccttccccatagtcggtggtattatcacccaggatctggatgtttcctgtctacactgctgtttcctggagggtaggaactgcaccttcccagtgacacatgacagtcttcacccatctgtgtctgtggctcctttctggagtctcactcatcctctttcctgctcccccacagcttttctgttgcttcagtggcctgactcttgtcgtacatacatgctctggggtcagcattctcttgcattctgataagcctgagatcctttgagggggcacctgcttgccttattcaccaggcctcaatgtgttggtcctcattccactccatcacatgacccctctggtcttgctgcaggacatggccctcataatatgcaaacattagaaagtaaatttagtactgcaattgcaatatgcaaacataatatgcaaacattagaaagtaaatttaataccgtgcttgcaatttggtgttctgggggtatgaggaacaggatggaggcatgcacccctggcatggggcttgctgaaagcactgaggaggtagtcggctctcaggagggggtgagcacatcgttggatgcgaaactgtcttatattgttgattgaattataaaagtaatgtatatgcgacagaatactacttagccataaaaaggaacaaattaatggcattcgtagcaacctggatgggattggagaccattattctaagtgaagtaactctggaatggaaaaccaaacatcatatgttctcactcataattgggaactaagctatgaggatgcaaaagcataagaataatacaattgactttggagactcagaggaaaggatgggaagggagtgagggattaaaaaaaaaacagccctgtgagtttccagttttaataaagctctgagaattaaaaaaataataatgtaaaggtgtatagcatgaaattagactatatgtaatgtctgtagaggagtgaatcccactggccgccccttacccacagatattcctggagggacttggagttttaagtctcggttggttcctggaagaattttgcccaaaattaatagtggcccttcctttctctgcagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccaggtatgacccttctctcagggcagcccctggtgacaaaaaacttccttggcatgttctttctgtactttctccagccgctcccagcgtgtggataggcagtcacccaagacactcatggatgccagcacagctgtaagggctccctctcagccggagctcaggctgttctggttgtattttatacccaacatgtactcagtattaaaaggagtgactagagaagaagcatgaaatccaagtaagacgctgttcagtgttgtcacatctcgggcctcagggcttggaagaggtcaagccctctgattcgtggtcggctgttccctctcccacacaaggctccctcctgggaaaggaatttctgaccatgagtagaacacgctggggagatatttttagactcattatttgtctttggggtggccttgaggtaaacctgctttccttgttatcatgctggggttggagaagggaggctgcatccctagggctgtgggcatttgagctttaccgaagttgtcacgtggctccagtataacgtcaggagggacacagagggtagcggcccttccactgccactcctatgcctgcaccaagctgaggtattaaagagattgggtcctgtattcaggcactctagctgtgtgattctgggcaagtgatagacctcagtttattcatctgtaaaaagggatgatagtgtacggattgtggtgtagattagaggagatgatacctgttaagtatttggcatagtgctggtgcataatctagtactcttcgtgtttttttcacaggggtttttgtctgtttatctaattgcttcttgtgctgtcactttctgtggctagtaattgcattgttccctgttgtgggggatgtggttgccttttcttcccgttgcctcgatctcctgccttgggccacatcccccagatgataaatgtttaagaaccaagtaaactagataagacaaaacaaaacaaacaaaataacatctaaagtttggctgtgattatgtaaaagacttgtaacgtgatggtgacttgttaggtggatttttaagttttacaagaacaacaccctccctgttgcttgtatcctgacaacatgcaggggccaggcaccttgcagtccctgcagcgtcatccctagagcctggcaaggacaatgaagtgcgtctctgccaattgagaaaaaaaatccattttaaacattcaagatgtgagtgaagttcttcttgaaaaaagcttaaaattgctcagaccacctagttagagggtatcaagaaaacctactctccatgcaatatataagaaaaacagtatagtccggattaaaaaaaaaaacaactatgagacccaccttgaagagcattaaaactgttgagatattagaaagattttaagtaagtgaaaaatgctatttaaaaatgaaaaggaaagaaagctagaagaaaatataggtatctttgatcctaaggaataggaagactgctgtgtacctaaaagcagcagaaaacacttggaaaaaaggctgaaaggaagttcattgtggctattttagtggtggaattactggtgctatttttcccatattttcccccttttttggtacttggtatcagtattttacttaaaggaaaacaaatggattgtaaatatacactttggttaagaacaaatcttggaatcccaaacttgcaaaggtttttgaagaattgtgaacctgggcaatgggggtccttcggtaaagtctgtcttccggcacattaacttctcctgaagagcagtggattgcaaacctgaatggcagccactttaagattttaaacgtatatctcgtggaaagggaagtgagcagattttcagaccagtaaggaaaaggaaaccattttaacttcataaaatgatgccctttgagcctttttatgacaggaacgtgttagctctttctctgcatcttacccatagatcctcctcaaagagaacgagattgtcttccaattcaaggaagcagaaggtctcctcttcccacttgagaaaagatgtaggttctttgaacccagccctagccagtggaacttcttgcagcaatggaactgtctcctatcttccctgtgcaatatgataggcactgaccctgtggcatcgagcccttgaagtgtggctggtgtgacggaggaactgaatttttaaggtcttttttcttttcttttcttttttttttttttttttgagacagtctcactctgtcacccaagcgtgacacccaagagtgcggtggcaccatcccggctctctgcaatttctgccccccaggttcaagcgattctccttcctcagcctcccgagtagctgggactacaggtgtgcaccaccaggcccggctaattttttgaatttttagtagagacagctaattttttgaatcaccatgttggctttgagcttctgacctcaagtgatctgcccgtcttcgcctcccgaagtgctgggattacaggcaggagccactgcgccggcctgttttaaaaattctaattaattgacatagccacagatggccagtggctactatattgggcagggcagtatttaatgcttcttcacggtctatttttctctaccttcctatgttaggagcgcaactggaaagaaagcagtgatcagagctgggggaggagaaaccattttgcttttcccccttctaacccccacctccagtctttgatgattggccttatctctttgcacaacttctgcatctccctttttttttttttttttttttgggataaaaactatttgtactaaagatcattttgactagagtgccaggaagaaggtgctgggaatttgtttaatatacgtatcatataattcatctctagtcaccttcccgacagaacagaatttgctgaatatatccctattttcatgttaaaatacttgaactctgttcaagggagttggctcacctgcactggtgatccccatggcaagagagccttgtcctccccagcctttgctcttgaaaatgttttggtttggaggtcgaaggttcagcctcagctgttgttaactttgcatgggatcagacagagggacagacagaatggatgtgggaagtttagttagatctggccatcttccagattggggtggccttgtcttcctgggtccctcctgctgaccataccctaggcatcaggagatccaacaggtctgtcagtttccctctcccaacctctcagttcctttataaatgtaagaactttctgtggtttggcatagtggttctcaacctactgctccaggatcacctggagggcggaaggcttgctaacagatggctgggccccacccccagagtttctgctatagtcggtctgtgggggcgggcctagaccctagaatgtacatttctaacatgttcccaggttaagggagtgaggttgctgttccaggagcacactttgaaaagccatggtttagtcgaatcttcttgcaccttcctggataggaaaaggatagttgacctcttatccaccttggcttttagattttgccacgtagtcaacctggcccttggaatctgcccagcctctttggcctctgcttactttttacacctgaatgcctctagtctcagccttcacctaaagggtcagcagcttctctttgagcgtgtagggtggggcaagaaggacgccaggggattgtgggctttggggctgattgaaagcctggcttattatgaatacagcttttttaaggcttaggagctctgggtcctgcacagtgagtgcgtgcggtcacggttgtgaggctgctcacccacaaaatgtgatttatttctcagcgctcttcatggacttactggatgttctgtttagaaagttagaaaacaaagataacttctttgaattgccctcaggagattagttttctagaatggagaaaaaaatataaaaattacttgtttttgttaagttggttcatagaatgccaacagagaatgctgtccctgcaaaccaccccccaccccatcaccagagacagggatactaaaatacttcttggcagcaagatgggctggcctttggtatgatcgtcaactgggcttccatgtcaatgggtttctgacagggccaccaaagaatgttctgttccccgggcatgaagtgactttctgattaatgttggccatgatttcccctacctcacagggttatcttgacagcagtttagaaaaatggcttaagtagaggacaatatttagtgggcaaaaactaatgttaagcctttatgtattgactcatgtactccttttcataactccatgaggacaggtccagttataattccctttttgtaggtgagcaaatgaagatatcagaggagatatgggttttgcacacattcagctagttacgtgctgagcctgaagtgcatgcccttaatctctatgctgttcgacctctctgctcaccaccctgtgtcatgtatccttagctgtttgaccacattgccgaatgcctggctaacttcatggataagctacaaatcaaagacaagaagctcccactgggttttaccttctcgttcccctgccaccagactaaactagacgaggtaagatgggctcctcagacacttgttgcttcactcttggggctgggagggctgagagggacttctgagccacctgctgtggtggtggtggtagcactggaggattgtggagatgaagttctgcctttctgggtgactgtgtatgtcgatgggggggctggtgaagaaatctggggggttgggagtgccctttatcaccctctctcccacacacattgcacagtatccttatcccctccacagaaacaggaatgagaaatcaggaactccccagtctaaagtgttatgataaagacccttggaagaaagatacttggagagttaatgatgtaaggacacaagtacagtcatgtattgcataacaatggggatatgttctgagaaatgctttattaggtgatttcacttatgtataaacatcatagagtgcacttacacaaacctagatggtatagactactacacacctaggctgtatgggacagcctgttaactcctaggccacaaatctgtatagcatgttactgtactgaatgctataggcaattgtaacacagtgatatctgtgtatctaactaggcaataggaacttttcagctctattataatcttgttaccaccgcagtatacacaatctgtcactgactgaaacattgttatgcggcacatgactgtgtcttatagtgccagttgtcctgagtttctttttcctaggctagccaggaagtaacacacaaattcaatcatgactttaccccagtggcagaggtctctgctaatgacggaggtttgaggggtgtggtgtgagtttcagttttagtgggaaatcaatattcacttcttggtccctttccagagtttcctggtctcatggaccaagggattcaagtccagtggagtggaaggcagagacgttgtggctctgatccggaaggccatccagaggagaggggtgagtggggtggcaggagcttggggtctgtgggcttttctgggtccaccctgaagactccctgagtgtccttgactcatcattgtttgcttacgtggagcttaaggagagttctcttttccctgacacatgtactcaataattttgtatgcgatctgctgctttgggggtttttagattatcaaatggataaataatcttagccttggcacaagaaaagctctttagttcttaacctgaagaagacttgaatgtgatttccaagtaagaaagttggaatgatgttgacatgggagtggaatggctcagagagagaatgaattaaaagtcttatcacaggaggagttatggggagggaggggggagagagagagaaggaggaggaggaggaggaggagtgatatatagctggtgttaggaaagtcgccctctgtgatgatgaaggtcagagccctcccatttgtctccacaggactttgatatcgacattgtggctgtggtgaatgacacagttgggaccatgatgacctgtggttatgatgaccacaactgtgagattggtctcattgtgggtgagtgaacaccgtgcatgaagggcccgtgctggccaagggatgggggtgtgggctggaaagggagaaggggcccatgggctgggtgttcctttgtagttcatattagaagataatggtccagtcactttggagagccgagcagggactcatggagttgggggtggcagaagattagaccatgtattgtgatgcccccagagtctgcagtgagaaatcccagccatcctggccgggcagtctcgggacagtagtataagagggaagaggggtgggaaggggccggagcaggcgtgtgcatagccgtcccttgttttggcaggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtgagtaggcccttcctgtgcgagtgggcttggcgggggcctggagctgagtctggggctggtcggggccagggggttgtttctttacagtcttacatccccaaagcttgccaaggtggccactggtcataggaatgtctgtgactataaattgctgagaggatctaaaacagagagcaagcggatataccagattatagctaataatgtgtttccttcacaggagtcattttggaaggttctattctgagtgtaagtgggtggccctgctctttctttccaccttctatttgtaaattgtccatgggaactgtgagccacctaaggaaagttgtgttgaggtggccaagattggggtctctgaaagctcctttcatagctccaactccatcaccacccagaggacaggctgacagctggctgctcattgctgctccctggggtcccagggcctcctgctgcagctgcaggcagacccatggcccctggagacattggctgaggagcttccttggcctccttcacttggaccttggcccaactatgtcctgggatggattggaggaggggcgtctagcattttggatcctgaatattgtattctccagcctggcctgcctttgtttttagttgcttttatctcttacaaaaccttatttcaccctcacaaacatttgccaaatgtgcgtgtgaaagatcttgaaacagggattgcttcaaggtctgaagcagttgcaaaatattttgagcaatacagatcatctctggtcttgtgactgttgtagaaaagcttttcgtgcagatctctacttggacaggaaaattgaaccctataaatcaagtcagtggtgggtaacccaggagagtccttgctttcgtttttttttttttttttttgagacagagtctctctctgttgcccaggctggtgtgcaatggcgcaatcttggctcaccgcaatctctgcctcccgggttcaagcgattctcctacctcagcttcctgagtagctgggattacaggcgcctgccaccacgcccagctaatttttgtatttttattagagacagggtttcaccatgctggccagactggtctcgaactcccgacctcaggcggtccgccctcctcggcctcccaaagtgctgggattacaggcgtgagccaccgcgcccggcctgagagtccttgctttgtcaaagcatggtttatttatctaagtcacaagcttgtttcacatgttgaaatgagtcctttacttgaaatttctgaggatcatactggttgtgtctgccatggctgatgagaggtttatgagctgaaaagtcactcagtgcctgcctccatgaatgaggcacacccaagtcattccgaggaactaaaggccctttcaaatgtcaaaagacaaatttgccagccagaccatgacagcacacccccggcttatcctttgacacccaccaaattgtcatccatggtagccctgaagtcactacagacaatttttgtcccctctaatatatttccaagtaagtatcttccaaatgttgactggaacaaagtgtttttaaaaactagaataaaaacttagcaacacggagttccttactgttgaagccaggctcccatccacgctggtttccttctcctgaagctctgcctgtgtgggtgcactaacatttaaaatgcgcgctgtcatcttcacaattttgccagctctcagttagccctgatgctgctgtactcggccttgggtcttgagcaggctgcttcctggaggcctgggtttcctctcggaaaggtaaccttggaatcccttccacatctcagtcctgggcctcctcctcgctggggctcatcctagttagtggcagcaggcccatgtgcctcctctaagacacaggttctttctcaaacacccagaaatgggccttttgtcaaaaagaattatcaccagggcttggtttcctctcagttctagtcagaaagaccaattatgaaagaaaacagtgccacctagtgttaaaattaaatcaccggaccgcactgctggtttgggggccgtcccctgcctttctaaaacatcttgtcacctgcctgcttagaagcctgtttcactcccagacccctgagacctgtcatttagagctcggagcccagtgcagattcctctatcccaacctgcctttataatgttgccccatcatcccctgccccaggtggttttcacaccattttctctggagcccatgaacggcttgcaggggtggacagtatgagctgatgagtttctaggcctgtgctacatatctaatcagatcgccttttttctcttgtaaataaatattgggctatgtaagatattaattttaaaaatgatttcctggctagagaagaattttaaagattaccaccctacgcataactttacctaaaatacaggctgttccagaatgttccatactccctgtgtgtttcatttggctgcttaagtttcatttattcttctccataggtcaaggcccatcagcctgcagggacaacccaagccagcccctctgagccgtcacctctccacgtatcttactcctgggccgtgctgcacacattaacccttagttgtgaagttgcacgtgtgcgcatcttgcttcaacagggaagctatgagtacatgggcagtggggactttatgtttttggtttgtgtcttccggcaggtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaagggtgagcttctggccagccccctctatttgctggatcaccacacgagttgacgggtagttggggaatgaggagggggctgtaccttttgactcttcaagtatagactgcaagagggtctcacatgacgtggaccatggcgggcctgtggcttcacttcacttaccagtctccactcttgtcgatttcgattgtgattgctaccagtgactcatggtactgggaacggtggttggcctccatatgcagggacttgggctgttgcactgggtttaaagctggaggaccccagagggcccccgaaagacttagctgcatctgcctccttttccttctcctgaagctctgacatctgattccctattggcaattctcaaaaaggactctgtcatgacccctgcttcataatagaaagctaggtctttgaattggccagagatatagctacccaattaattctaataagcagagctggggcctgcattttcacagcccagcaggggcaagagtgaggatggcttgatttttgttgttgttaacaatatcccaagagtcaggcgggcctcgtttactgttcttgagatttccacttgtagattgaagaagtcctggtgtttcagggaccagatggtggagaggaggtgtctttggagccaaatggagcagtggaacagtgccaatgactttgttttaaggggaaactcttgaaggaatggggcctacttgttgctataccccaaggtgatgcaagtaccccaaggtgatgcaagatttagttcccttgagaagggtgctaaggttatagcactagccccttaccaaccatctttagacacaagctaaagcagtgccaagtccatggtgaaatgcaatagactcctactgctttagagagagaaaccaggtgggcatcaccgcagggttcacatgttgagagtggctgacagcagagacactgtctgtctcccctaacacaagcagatgtaacacaaactctcacacacacaacttggtggtaaagcaccaagaacagggccttgtttttacatagcacatgcataagaaatacttgtgtttctcaactccgtgtgtctctgtgtgtgtgtgtgtgtgtgtgtgtgcgcacgcacatgcgtgtgcgtgtgtgtgtggtgtctgggagaggagcctcagggtggctgtgctatattttgcacccccttcctcctcctcctgcccctgcacaggtggactaagcaatgaagagggattctgtccccactgggtggtgaatttgctggaactaaagggcttccttgccaccccccgacacacacactggccacagtgggtcagacacaggcccacatgctgtctttctgtttcccagggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccagtgagtcagtgtgcagggcctggagatgcggagttcctggagtacctggggctgagtgactcctcatgccagctccattttgcatttcaggggtggtgtggagggaccatagagctgagggtcttggtggaatgaaagttcccacctgggcaagggggaatgggaggaagtcatatctggtgtgggtggaggtgatttctgaaggctactgatgactcgggctctccgcagagctcctctggctgctggacactctctttgccaccctcttgtatgcgttattgttcctgtctttactcttagaattcttggtgattcctgcaggtgctatgtcctctgccagggaccaccccagcccagtgagggttaccagcttctctggctgaccttggtattaaattgatcctgccctgtccacattttgatccctcaggtcataggtaccagaatattcacatgtcagctgagacctggaagatgtctctttattgtgcctacttatttccccatcattttcacctaataagaatgccaggtcaatgtgcctttgttttcttaacttgtcggtgcaggaggcctcagccctgagattccctcttcctacccagtgttgcaaaaactcgagtgtgcacgtgaatcacatggggatcttgctaagaggcagattctgatcagaaggtctggggtgagtctgagatcccgcatctctaacagcccccagtaggctgcagcctactcctgcacttggagtaggaaggccctggagaccatggctccaagtggccactacccagagagttcctggctgaacacgttgtctttagctgtgcagacacctttgggatcattggcagaaactggcaaaagagaggctaaagtccagaagagcatctctagcttttaattttgggtctttcccagacagcagctagtgaaatgagtgatagaacaagacagataggtggcatcagaaccacctaataccacagggctgctccagcaaagaggctgatggtaccatgttgggcaagggagcagtggccagggggccttcttcagtgaggaagaggaggtcttgtgtggctgcatgtaggggacagtggcttattaaaaggtcttttcctttcattggcgggggtgaaccaatcctgggtggtcatagttgatatggttcttgtagtggttcctaacttgggacagtggagagaggatgtttagggcagcacccactcctgcaggtgccttttggcatttggattaaggcggtgggcaactgtctaactatttgcaccattgaccctaaccatggacacctgtctcttacccgccctggggaactgcagttttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacaggtacacggcagggttgccacctggctcacatggtgggcctttgtcctggtgttgataccctgggagggatcccttagcattagcattggacatttgaaccagaacacgtttcttcagccgtattactagggagttctagtctttgataaactcaaacaaggtgctcctctgcaaacagtagtaatggtcaacacttattgaatgcttactgtgtgtcaaagcactttatgtgtatgagctcatttaatctttgttaactgttaaaaaatattagcagttaattttatgtattcacctatgtttgacagaaaactgaggcgcagagaagttaagacacctgcctaaattcacacaactagaaaatgtcggagctgggattcaaacccaggaattcaggttctagaatctgctcttgcaatcaccacattggtctgagtcagggttggcaaactatggcccatgggctgaatctggcccaccacctgtttttgtacataaggttttattacacagccatgcccatgcgtctgcacgttgcttatggttgttttgcactgtcttggcaaagttgagtggtggcagcaaagactgcatgacccacagggcctaaaacgtttgctgtctgggcctttacagaaaaagatttctgacccctgctgtaagtcttgtaacctcagaaatggtggtcttattccaattcagagaagacagtcgatgagcaggccagtgtagcacagttgttacaggttccagagacagactgggatttggtccctgctctaccctgtcctggtcgtatggccccgggcaagtgatttaactatcagccagatcccaatcatccttaagagaggaatgcagtgtctccctcacagggctgcctaagggttgaacgaggactgtgtgtgaagcatgtggcacactgtaattgtccaacaagggagggttttctcagtttaaaagatttcccttcagcttccttcagggagctggactcttctgttccttctgtattctagaatgtaatataaagtggcatttgatggaacaggaatggtgtatttggatcgttttaagtgtactgtctccacattccccatgttctgccccaacttatcacttccctgggcttattttccagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgaggtgagcagggcggcgccttcaggagggggcccctggtggacgtcacctcttgccttcgaggacagtgctttctctgctcatctgtgaccctggggagggctagctggacccagggctgcagcctggtcttgactcaggtttgtgcctgagcctgcatttcttctgggtggaaagaaacattgatgttgtgcgcaggccctactgggggcagcctgccctgcccagggcccctccctcagtgtcctaacttctccctgcagctctttgaccacattgtccagtgcatcgcggacttcctcgagtacatgggcatgaagggcgtgtccctgcctctgggttttaccttctccttcccctgccagcagaacagcctggacgaggtaacagcaccttcctggagggctctcctgtgggctttattgactctaaacaaaaccagccaggtatggagcaggggagaaagttgagctaagactaaggaaaggagggcgtgagttaccagtagtggggaggggctccttgatgggaatgagtaagttgaggctggtggaggttaagtaggttagctcagctgtgacagcctttgggacaacgatgatgatgctactcaatgttaacaactgccgggtgtggtgactcatacctgtaatctcagcactttgggaggctgaggcaggaggattacttgaggccaggatttcaagactagcctaggcaacataggaagaccccatctctattgaacttatatatatatatatagcatttttaagcacttactgtgtgccaggtactatgttaggtttcttacctgcattatctcgtttaaccctcacagcaaccatataagagatatgtttgaatacccattctacagaaaggaagataagccccacagaggtgctgggtgtcttgctccaggtcataatagcttgggactggccaagccaagatttggattctgggttcctgatgcctgagcctgtgctgtcagttatgctgtggggctcctgaggcccttgttatgggctcagggcattttcatgccatatcctgttgtttggatgccctggctcttctctggtctcatcttgcttctcactcctcttcaggttaccttgggtgaatgaagtaggtgcatgaggatctggcactcccagatgttctggacatgagtgccccgagaagtggaggagaactgagtaggcagtgctggatctgctgatgactggtagccctaagcattaggtatctggagactgtttttaagcagttgtgtctctgtctcagtcatgtaggagtgcacgtgcacgctgccggtgtgtggtatgttgcacatgccactgctaggtataaaaggcatggctcctacctttagatgcttacaaacaagctgggctgatgaagcaagctcagaaaaggaagagctgctgtttggaatgtggccctcgtgggatggatactgaagcccccaggacaggtagtgagacagatgttaatccgagtgcatacctgggggatgtcaggaggacttggaacaagtcagaagaatgagttgatgggaaagaaaggtgagcaggctgcccattgtggagagggtcatgtaggtgggagcaagtgacagaaagagctgggccagcgcagaagagcctaccctagtgacaaggaaagagcagcatttcccacagggtccctgcaacagtggccctcaccttggcttcactgagttttgtagatgcctccttctcctccttatctgagagaattccccatgtgcactagtataattaaggttttaggaagttctgcaataaaaactcagcttagtctggcatttctcaacacctattaacattcatgtagtgttaaccagactagcgttgctttatgcctcatgtggacaaattcttatgtactatttaatggaccattacttattataacaaagatattagaaacaaacttgctgaatagtgagatagtagttaaataaattatgacccacttattagctagtatcagccactagttatttgtaataaattttaatcacatgaaaaattactggtgatatgactaaaaagttttaaaactacttttctttagaaatggtaatctctttataaaaaaacataaaatacaattaatgggatgataaaagcataaccctccagtgtatatccttcttctagacttcctaccaaaatattttcaagtagatactatcttaacttttcatgccaacaggttatatatttatttatatatttgccagggaaaccagaatgtgtgttaactgtttctgtctgaattgtgagattccaggccattggattaggttttattctgtgttccaggtttctctgaggagcacgtgttaggtctagagccgtaaaaattaagagcaaataaagcagaagtcatttcttcctgtgggctctggcaagaccctcctgtgatggggaaatcccaccagtgcagaggcccctggggttagagaccccagggctctgtggcccccagctgtgtttcccagctgttgggcctccacttgcctcatcagtaaggatcacctgaaattatgttatttgaacatcccgtaaacacaaacttgcgtcaaacatgtgaagctaacttgtagagagctgggtggagatcagcacacactggtcagccagctctctgagggtatgtgctttgtttttctgaatctcctggggtctgaacacagtgtgacacctccaggttgatgtgaatgaaatgccaagctgatgggcatgaatccctgagcaaggcctggagaaatcatgcaagtgggtgggttatgagcacacagctcatttatggaagccgagctcttgggtaaggagtctgaagccctgaggcttgtttcctggtgggctgtggcagcagagagggcatcagggaataaaacccaaagcatttctcccaggttcaaagccgtcaagcatctgctcccagaggaccacattgaaggcaaggggccactgaggatgctgaggaggagcctggagttgttttcctcactgaaagacatggggtggtggtgaagcctagctgtcacccagctgtgggcaaagcacttgttcgccagatgctggagtttgaaaattaggagacatacactgacccttctgatgtaaaggatagggacagagcaaactgctttgcccagtgagcgaaccaagcacataggaagaagttgcacagcagggtcagctgcgtggtgcttatgagcccattcactggggtcggagggcctcggagtgcatcctgcttctctcttccaagctgtaggccttgagcaagtcactccagagcctcagtttcttataaagtggccataaacatgatagatgttccacaagggtgctgtgagggttaaataatgtaatgcatgatctatgcttagcccagtacctgctacacagtaggtgctcaataaatccaagtaagtaccttaggaacagtttaatttgcgggtgagatgattggtgactctgggggatccgtctgacctgtgaggttgagagctagaagcacagctggacccccagaactgacctgggagctcttccctgatgtcctttccatgcttgtgtgtgatttttagagcatcctcctcaagtggacaaaaggcttcaaggcatctggctgcgagggcgaggacgtggtgaccctgctgaaggaagcgatccaccggcgagaggtaggagacacatggcacgaggtctgatgtgtcagctcctcaatgattggcctggtctgtgtgttcagaaagtgaaggcaacagtaagtgtggctgcatgggttgggaggaagattaactcaagcgtcgttcagcagtttagtgtgcactgtgtgtcaagcaatgctctcagcactggcggttcaggagtgaccacaacaaagctttgttctataaagtccatgacctagtggcaggtgctgttaagagctgtgaaacacacacacacacacacacacacacacacacacacacacagtaaaggaataaaagaatggccactccataagcaaaacagccatgagggctgctggttgcacatttttatggttatttcttgattatatgctaaacaaggggtgtattattcatgccttccctttttagaccatatagagtttaaaaaaaaaaaagaaagaaaaggagtgaagtggggtgaggagagcagatggagcaagtgtgctggaaaggggcactgttaaatagcacaacttgggagggtctcaccaaagaggtgacatttaagcacagacctgaatggaatgagagggtcagccatggtgtatgatatatattttatatacctgtaaatctcccatgcaattgtctgaaaggagaatattggggttcacctgtgaactgggcatctgcttcttccctctcaggagtttgacctggatgtggttgctgtggtgaacgacacagtcggaactatgatgacctgtggctttgaagaccctcactgtgaagttggcctcattgttggtaaggacccagactgtcctttccacatggggatgcacagccttgggtgtggaggggttggtgctgagtgaggccctggtatcctgtgattggcaggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggtaggcacccaactggggccctgttaagtgtatcccaggactggatggcaacaagtgatcagagcttccacaatggcatctcccaggacgccggttctcgtgagatgttaataaaggaggttttcttggaaagggtttcttgtcgaatgcacctggaaagttctgagttagtaaatgtaagaagcatctcccacccaaaagcctaggagaacaggtgggagaatactagaccctaggtctggcactctaaggagaaacaagtagaaagttgaagcacctgctgctgacaggctgaagagcatctcttgggtgatgcagacaggagcaaatcctctccctcctccatcttccagcgccgagcaccacctactgtcagaattgagcaaggggccagccccagtgtcacaaggtcctgtgcatggtaggggagcggggtctgagctaagagacaatagcttaagatctaacacacttctcattaagatgttgtctgtagtgtttcctaactagattaatcaaacaccctagtcctgcagaatacgctttgcaaaacatgtgtctagaatagaagttacagactaaaatgcctctaggggccaggcaggcaacattaatgaaggaagcaggctgggtcaagataagatggggtggtgatgggctattggttgaaactagggacctcgtttttttttcaaggcaggattcaggaccaaaagaccctcaagccactgcataataacgtttagttccagtggccaggatgggggccctacagctggcagtagttacttgagtaatgatggttaggtccaagagaatgtatactgaatgcctagtgaggttaaagattaagactcagcattctcccctgctccgagaagtccagtggggttatggtgtgttccttctcgagttgcttcttgaaatttcgaaataagccttggaaaggaaatgagttcctttccctgtgggttcctttccaaggcttatttccccaggagccccacgggcctcgggcactgtggtcagtgttgctgaaggttgtgaattagcatgcaaagacaccagggatcctgcccaagtgaatcaagtagcaattcctttcccatcaggggagtctgcctgtctgccactgctgatgcactgggggtgactaagctggcctgtcctgtctcaacacatccctccaccttcctacttaacctccatgaatgttacttgcattgcaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagaggtgagagcttagggctcagggtagcaggggggccatgtccttttttctcactggcagacaaactgaaggatttccataactcagggcatgactcatacaaaagtcagtttagtggcaaacacattcatgtctatagtgtttactaaaagcacattatgggcagttgtcattttaagggcaaacagagcattctcatgaaagtttgtgctaagcctggcctgaggtcatgcaaagtgatattgttgggttttagaccatgtatcaaaggtagaaagatacctgctcatagcatgtaaattgaaacgcacagaggaagataacctattaaagcatccacacttggcttgaaagcccttcctaactgctggctgcagtaatcaggcagccaggattgagtaaaggttggaacgtcaggcaatgcagacacatgccacacagtggctcattagagcaaagcctccctcctacagtcaaatggtggaaaatctccaaattagaacagtgaatttcagagccctttaaaaattaatgctgtgccattactctcagggcagagaagaacaggaactagacaactgatgtgagtagacccctcgggcatctgcaccagtgaatagaaagatatattctagcttataggtctgttatgttcagcgaggtgattccaggcttctaaaatagctttctttatataggagggtttattttctttctataactttatttacacttccttcgtaaatagcatataaatacagttcagaccacccagagcagcagagcagaaataaagcacgagtctaatgctgcttggttagttcctgccctgcaaacccatgaacagcagcgagaaaatggacatgaaagagctttgtaactgaccactgtgataaacagtgaatttgctttgttttgagtatctactttgtagtagtaatggtctatctggagtagggagagtagaatgaggagctgtttgtattcctgtcaccgtcaggaagagtcaatgcagtgcagtaggttgagcagtggtctgaatttaggaatgggaaccacctcgaggggccagctcctggagagctagacccccacagagcctcccctgtaaggactcaggccctggtgtggtaggctaccagccttcttggtgcatgactgaacacttgctgtctccctcccaccccagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcagtgagtgcctgatcccagccccccctgcctaccttctttctgtctttgttctttcccttttctttctctctttcctttgttactttatagtgaattatcagccattccaaatagtgtatataatacatggattatagtttaaagattcataatcagaagtaggcctgtgtttcaccccccaccgtgggaagccccctccgagcccctccacaactgtgtcatcattctcccatgccaggggtaagtgttgtgctgaatcagtcccttgcttttcttttccacccccatatatgtaggtatgcatccatattgtttagttttacttatttttgaacttgccacaaatagaatcacatggtatctcttctgtggctggcttttctcacacagtgtttgttttgagacgcatccgcattgaagtatacagttggtagttcattaattttcagagctgtatagcgtacctttgagtatgttgttttttctatcgttgaggtgatatttaggttacttctagattttgaccattacaaacagtgctactgtgaacattctggcaaatgtaatgctagaactctggagcaagattttttttcaacattctagagcaggggttgacaggcaacagccacaggctgttattgtacatatagtttcatgaggattgggagggggcagaagcccagccaccaaccctgggacatggcatcctcagctttgtagatggggagggtgtcctgaccctgctgtattggggcagatcacaactctctctttctctggtccatataggaaggatctgtgatcactgtgatatcctagcagtgactctgtaagtctgcttcttttgcctccgatgacattttggagcacatgtggctctgatatgaggctatgcgccaggaaaatagaaaatcacattcatgagtcctggtcctggtctccccctccagagttgtgctcctctgttaggcacacttgtggcttccatggttgttgaacttctcttttactgactattagttttaagaacacagtttgccaggatctcagacgtttgtcccagaattgaatcctagctctcctaatggctgatatgatgtggaaattgggcatagtactagtgtctccaagccacggttttctggtacttaataatatatagtaaatgtttaatacattatagctgtcatccttctcctcttcttaattatttctgtgtttccagcatcgcttcttagctttcatttctaagtgcaaatacaaaccaatcatgactaagatggtttttcctgtgtcttcctcccaccttttccagctttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaatgtgattcatgagtgtttttaagagagtagtcatcttccggtcgtatcagtacttcctggccagcccgatgagtaatttatgggtgtcttgattttgagtgtgtgtgtttgagaggcatgtggcttttccagaaactcagtcccagtggaattagaaggcagcttttcctggactgccttggaccccttagatttcaagccactgaagagctatggctagtcctgcggtctactgtttaaatagcttggctgaaattagcaccaccctgagggcctctggctggtcttggttggcaaatgtgattcatattcaggatatatagctctcgtgaacatccaaaaagcacttgcctctgtcctctccctaccaagcttttccttctccccagtaagcagaacacaggtctggggagtaaattcatcaaaagtccctagtgatacccattaacattcacatggccctgtttgacaataaccgagggaagaagatgaccatggctaagaggataatggagatagccaatgggtgagggaaagtttaaaattagaccctattttttctgatatcaaactggtgagattatgggagcattctcctacactgttggtggaagtatgattggtatagcc

SEQ ID NO: 16678 - DNA, 84525 bp, Human
ttaagaaacccacccaaggccataagttaatgaatggcagtattgggaattgaatatgtctctctagagtcgaatcagcttatctgtgtgttctgcccaagacgtggtgttaaaatttcctctcatgccagtgggccaaacccatcactgtggccttggctgacacatgttggcatagaaatgcgtggcacaagtagggaattcatggttgctggcattcagcaaaacaagtggtagaatttctggtgtggtgtttttcttttctctttgcaggggagccagttcgttgtgtgttccaggatgaactgtcactgatagccatcttgagcaagggacaggctttttcttttctttcattcttttttaaaacagctggctgtatatgccatgtcaatatctttttttaaaaaaatgaaattgactctccttaataatgtgttatgtctctggtgactatgaagtgggtccttgccccacggcctacttgtggttaacagacctggagtgtaaacggtaatattcaaaagttatatttcgttaaggccaaatgtggcattttgaggattactttgtgtattttatgagactgtagcttgttgatttaggccttccaaaaatcctgaaattggtctgagcagagcagattccagatacaaatcagatagtggctgcttgggtagtgttggggactccatctgccttacttggagtcacctgtacttctaagagttgcatacacaggtcttcacccttgtacctggcccacctttctcactttatttcttgtctcatctcctgaggtctagccttctgtgttagaacccactgtgcattgaatttactttgcattttaccagccttgcctccgctctgttcccttcctctccccctccctttatttatttattttttatatgtttatggtgactggcacatggtggctctgagtaaatatttgcagcatatgtactgtgaggagagtatggtgaagcacaggatgcatagctttaaaaaggtgcttgggctgggcacgatggctcatgcttgtaatcccggcactttgggaggccaaggcagttcgactgcttgagcccaggagttcaagaccaccctgggcaatatggcaaaaccccatgttccccccctcccccccaaaaaaaactacaaaattagccaggtgtggtggcatgcacctgtggtcccagctactttggaggctgaggtgggaggatcacttgagcctggaaagtgggggttgtagggagccaagatcatgccactacactccagcctgggtgacacagcaagaccctatctttaaaaaatgaaaaacattttttaaaagagtgcttgataaacaagagtaatggttgtctttccagtccttgcctctgcagtgacatagtttactgcatttgcagtccagtttgctgggtggagtgagctcttgactgtagtgtggttcaggtcttagtgtcctaagtttctattgaatgaatgaagcacttttaaccccgtgtgcatcttgccacttgttctttgcctggcttttctccctcccttggagcttctcaaggaacctggcctggggatgttacctgatgtttacacccaggttacaacaaagggcaaaagtaatccgctactggagtgtgttcaccatggaaccaactggggggcacgacatctgcagccaccagggcctgttgagcaggagcaggggagccggtgagggagctttctgacgtctccagcctgcttccacttctttcagggtcttttggatgcccccacttgagacagagactgctgtcaaaggggagcaaacagcctgcacagtcgccccccgctccaggctgctggcacacagagacctggcggagggcccactgcgtggctctttgggttttagaatgccttgggcaagcatgctttttaaaaggagtttttgatattccttctggcaaaaatgactgacgcacttgtatttctccctccacagagtgatcagcagctggactgtgccttggacctaatgaggcgcctgcctccccagcaaatcgagaaaaacctcagcgacctgatcgacctggtacgtgcctccttcatatggttccatttgagactgcggctaagagttagttgcttttgtgtagctttttccatgcagaattcacaacacaggaaaccttttctctccctggcagaccatgccactggactatgagattcctccaggcagagagaagatggatttcatatggtggtctgtcattcagaaccatctgtgttgttgaagcccaagttaggagttctaaagttaatgacagtctgctccctccccagctgccttgtcttcagtttctagaagcttgcatttagacgtggtgaggaagaggccatacccatcccgcaggcattcagcagtgcacgcaggccagacgctatcagtctctgctatggtgtgagtttctccagccaacacagtacaagcgtctacctgtaagatgcttccgtggcttcatttctagtttgaaaaggtataacaagcaaaagttggcttgttaaagggcccgtcacatctagtttttaaatattctattcattttcatagatttttatgctcagaatgattggtctcaagatgttgcctcaaattcactagcaccatattatttgaagagtgctcaaaatattcaaaaacatctataaagccataggaaatattggaaagaaataaaatcaggtcctaagaggccagccgaatcaccctgatcacttggcagtgagttctggtgctgggtttggaacgtgagtccctgagtctggtcctctgttttttccactgtgtcctgtgtcttcttggatgtaattatccattgccaagcatggctcatcagtgaggtatctttttagagtgggttgggaacttgttcatatgctgtagtgatttatttaattccattgtatgcattcagaacatttttactaggaaaaatatatgactgctaggagaggcacggatgtcattcacagaaaactttatacagcagcccgaaaggtctgtagtgcgactatttgtatatttatagggatgcaaactcccagctgagaggcaagtgtgtgacacagagcggagcctgtggagggagttgggaacctgctgtatctcattcatagtaattcaggaagtgggaagaaagaggtttcttgaggtcactggctgctcagagagacaactgcacatgcttgtgatgtaagcggagagaaggcaggtatcaaaaagagagggtcctgccagacagtcgacatttcaggggggtagtaacatagttgtgatgcaaatgaacccactgtgtgctcaggatcaggggtccccggccaggagccagcgagtgaggaagatcattgaagtgggcatggtgggatctggaggcacaggcccctgtgggaagagcagctgccctcgttactcctggtgcttgttgccctgttggaagcctctgttgctcattttcacatttttctagaggagccatatatttggggttttatgtaaaatttcctggtttgtttgtgtgtggtggtttttttttttttttttttttttttttttggtgacagagtctcattctgtcacccgggctgtagtgcagtggggtgatcttggttctctgcaatctccgcctccccggttcaagcaatcctcctgcctcagcctccccagtagctgggattacaggcgcccacgaccgtgcccagctaattttgtgttttcattagagatgggatttcaccatgttggtcaagcttgtctcaaactcttgacctcaagtgatctgcctgtctcggcctcccaaagtgctgggattacaggcgtgagccacagtgcccagcagaatatcctgatttttaaacattgggctgcacgttagattggccgggtccagttttgtgtagaacctgggcctgagcatgtgaaatgtgagctgggggcggtcgggcagtgtgggctggaggggttagaggagatgtcctttgttgagaaatactgaagtataaagttggataggtaggaggtatccttgaaagtgaggagaccttggacttgatgtggtgagaatggtcaccatcagcccactgacggctgaacttgtatgcagtgcctcatgcgcagccatatttaaactctcatcagtcctatgaggtaggactacagaatgtggtctgggaagtgctttaatggctttgcatttttcttggtcagaaatctatgattgatcctacgtggaagaggtgggcaaaagttgaaggtgtgatctgcctttaatttggtcagctgcaggggcttgtttttcctctaaactcagcatgaaagcatgcttggctgagtttaaatttagtttgccaatttagttattactgtattttagaaataagccaaacatagaagtaggaaatgatgagcaaatttttctcattggacccttcctggtgtttaataggctattttgttcttatggcaactgaagtgttttactacagctgtgtcttttctccgggactccctcatcactctctctttcagggatgtgcatgtagctgcttttatgaaaacctggtcaactggctcccttgctgcccgtgcgggttttccctgggctcaacagggaaattgcagcattgatggtgaatgaaggagagtatcaagagctgtctttcgccatagccagataatgagagagatcacctctgaggcttagttgcaggatggtacttggacacaggttgaagtgccaggccgtatctaccactgatatatggtgtactgtgtgacattctatagattactgtcagagcatacttttttttttttttttttttttttttttgagacagggtcttgctctgtcacccaggctagagtgtagtggtgcaatcaaagctcaatgcagcctcctaaactcctgggctcaaatgatcttctgcctcagccttgcaagtagctaagacaacaggcgcccaccaccacatctggccaattttttaaaatgttttattttgcatagagactggttctccctatgttgcccaggctggtctcgaactgctgacctcaggcaatcctacttttctgtttttaactttgtcttctgtagaatgtatgctagagctggtggaggtgggctgaggttgaggtggacagctgacgtgttgaatacctgccgtgtgcccaggactaagctggggacttctgtttgtgttgtttattgtttcttcaaagtcatacaacacccctgtaaggtacatatggccacctcacctcctttagatgatttagactctatggggaagaagccaggatagggatgtggcttgggagcgccgggaggtctggtttctcctgcttgccaggttcctttgggttagtcacactgaaagcaacagagtaaatgtggtgtgtctatgtgctgtgtcagttttgcctgttgggagagaaactgttaattaaattcattagtaatctaaaatgttaacacataggtatattatggagaataatgttaaattcacataatttaaaagcaagaactagacacggggcaaaaaaacccttctcggaaccaggccatttatgattagtggttctctttcctccactgcctcgggacggcctgagaggcaccagctcccttcaccggctgtgtggaggccacctggggccttgtctacctcagaggctgaacaagaggccagagtggattcccatcgtccagagtgggttggggaaacggtgttctcattaattttttaattgaagtatgaggaatgtcaaaatggaaatggagcatgacttttcaacaaattaggatctggtaatgcatgcctcattaaaactatattgacatgcattggccaggcgcggcggcccatgcctgtaatcccagcactttgggaggccaaggcaggtggataacttgaggccaggagttcgagaccagcctggccaacatggcgaaaacccatctctactgaaaaaaaactatattgacatgcttcagaagccactttctgattgatggcctggctttgaactcctcgctacgtgcgatgctcatataaggggcagtgcgctggctttgtactggatcctgtgactgatcctggaggtttcttctttgaatgttttattttcatcactgccagtgttctctgggaatgacagtttttcttttttcctgtttaactgaacttacgaaatgcttttattctgtaaggattggtctgtgctgagtatactgttgtagcattgaagttcacatgcagttttagtttcttcccaaagcggtagtttcagaaaattcacactattatgcacctgtctaaaggcaaaggatccaggcctttgtctcgtgtaatctgggatcagtcagatgttttgaaagtagctaatgcactgctgctccatgcaaacagcagtcattcctccctgctcacctgcccaagataatgaagggggggagattgttgttttcaagaaaagtctccagttttaagatggacgagaatgttaggatttgccagcattccccatgaagggaatggcctcgcttaagatgtcagggccagggaactgtgggggaatggatccagtccaccatggtctgattacagagtggtattgaagagaaatgtgagggatgcttggcagccaggccaaggcagcccaatttatcatgccaggtcagctttcttttttcttcccagcatcagagagtttttgctgccttgggattatgaggcctgctctgattggtgggaaatgaccttcctttgcagatggccaaaacatcattttattacatattaatcccattgtgctagagtgaatccagctgaaatccgttgttaagctgtttcaaaaatacccacacatccatgagggccaagaatcatatgatgtgaagatgttcccttggcttcataaacttggcccttctatggccttactctgcacactggcagcaagagcagaaatgtctcagctggggtgtattttgagccctgagctgaggaaggagtttgtttctgcatattggcacccagcaggccttccatcctttgcctttttaagagcaaaccaaaaatagccgtgaatctgtttaactaggcaagaaagtctctgcttgcaaacattggtcacttcatgtttttagttccttcacttctttctttcttacagttgtcctaaggctcagctcttgggtgtccccagactttactctatcaaggggaagacatcagggctgggaaagtatccaggccagtgaggtaaaggtggaagagacatcctgattttttaccggggagttgataacttcataggttaactgttttcagcatattcttctttttaagtagccagagcagccctctagaaatagagccagctgggcacaggtattcacactgccagcctcagcggtagccatgctttgaaattatccctgtcacccccgcatcgccacccccatcggggcagcatgatgtctgcagggagtgtgatttgacagatgagaaggctgagtgcttgggggacgtgtccacattcgagccttagtgaacgagtgagtggacacccgctgcttacgtttccaaaaacctgctctccgtgaagcagcccatggagccagctcacacacatttgtaattgactggtgacgttaaggatgatactattagtcaatagttcattaatacgattgattagcagaatatctgatgtctgctaagcagtgctgctcagttttcagtctttaatagtcaaagcaatgaaatctggaaatcatttttccagggacagctgtgtggagtgaagcaaaactcagttttgtcccccaggtgatgaagctgcactgggcctgggacccaagacgactacccctgcctttggggatcttgaaggccagataggatctgctttatctgtgttaatagagtaagcaggcttacattttcttcttccctagcttcccctttagccttgtcattcaaacaatctcagaccagcatttttcgtcctttatttcaaagacaacatttaaaatgtcttcacttaagctgggcctggtggccattcccagcactttgggaggccaaggtgggagaattgcttgagctcaggagtttgagaccagcctgggcaacatagggagactccatctctactaaaaattaaaaaatgttttgggcatggtggcatgcgcctgtggtcccagttacccaggaagctggggtgggaggatcacttgagcccaggaggtcaaagctgcagtgagctatgatcaccccactacactccagtttgggtgagagaatgagaccctgttttgtttttaagtttttgcctttctaaaagggtctcagctgaagtaagtgaaaaggtaatggattcagtcgacatttattgagcacctcctggaagtcaggcactgtgtttaattctgggaagaagtgcagcctttattccttgccttctcctccacgggtcaaaatgcaaggattcttcagcttgatccccgaaaagaatgaccctagttggattctctcaggccattggtcattgaccagtgaataagctctgaggatgagtagcaagagctgcagaactgagttattctttctgcaaacatttattaaatgcaccatccatgcaccagacactattctaggtgccggggttttcgtggagaaccagatgaaaagcctcgctctatggagctgacattttatggggaattaatttctggaaggaggacctggctgtggtcagctttgcacgctgtacatctgttgaacaggataactggcagctgtgcttatttgtttttacttactcataaaggtgttagaggctctttaatggtcgtgcccagctatcagtaaatgtttgtccacttctgcaagccattgctcgccaccttttaaccggtttctcagtgacttgtgccttggcgcttctcattctttccccaaagtactcatgtcaatagaggaagaaagaagagcaaatacacatttttggggttttaggggaaaatccacaggtgcctgcctcaaggagagcattgtatgttttgtcttatttaaaaattgttttctctctggaaatgtggcattcatctgaagttacaactacttgggaggctgaggtggaaggatcgcttgaacccagagtttaagaccagcctgggcaacataactagaccccatctcgtaagaaaaaaattaaaaaataaattgtattccaatccataacatgcccacatgcaagacattttaacattaaaaaaatgctttttccaccagagttccccgtgggtttatgttaagggtggggaaacttggcttcctctctcctacccatcctagggtctgcctggaagttttctcctctgagccgaatgttatctctggagcaggagccgcggaatggatggaatcactggtaatatgcaccagcccctacatagtctctgttgtgactgatgtttctgagcgtattctgagctttcctatagacaacactgctatagttcccgttttacaaggagaaaaaacattccagccaaaagcctccagcagtattttaataaactccattccttggaaaattgtggtgagtcttttcacgtgagccttttgctctgtgaatgggcggcagctgtggggactgaggcagggagagcaggaggcatgctctggacggtgggtgccaagctggcgtttcctgcccatcctggcctctccggaggatggcggcccttcatgaccccggcctgttatcaacctgaggacctgccacctagtagtgcagcctctgatttgtgtccaggtggcagccaggcagcccttcaccaggaagaaatggcatgatttgcttagaaagaggaagtggggcttcctggggtgctcttacctgaccagctccctcatagatttggccagaagtgatttcagattctgatgagttctgttacatgcagcataatggttcctcattttatccaattaagaatgcgattaattgccttctgtaaaggcaatccagacaattacggtggaatgaatgaaagagaggagtgcaagagaaaggaaatgaaccaaagagattagtagggccattggctttattttgtgtgtgtgttccttggggagcaaagactgattccaggagactgcaacgatgtatccaccagtcctgagctgtcctagaacagtaatggttgattttccattaggggaaggggcttgaatttctccaaagccaactattttgaaaattgatgctctcccatcatctttaagatagccacgcagtaagctttggttatttttcagagaatacaaatttcaaaacagaaagtattttttgtttggtctcagattaacaatttgactcttccctctttcattccctataaaatacttttcaattacatggaaaaaaatttttttcatctttttaaattaaacatagaaaatagagatgggggtctcaccatgttgcccaggttggtctcaaacttctgaactcaagcagtccttccacactcaagcagtccttccaccttggcctcccaaagttctgggattataggtgtgagccactgtgcctggccaaaataagtaacttttaatggatctccatcagatgtcagcaagtactgacagatgggtctcattattaatacgcttcatccaggaccttatctgtcttcatagccattctgtgaagtgagtgggaggaaactgaggaatggaggagggcagtgagtctctgacctgataggtgatgcgtgctgtggggttgcggggaagaggtgtcaagcccacctcttgattccagtcagtattttccactgaattacagccttacaaatgaaaatattatagtatgccatttcttaaatgtcctgccaaagctaaataatcttttaaaagtgaaaatgtaaaggaaatttataatgagggcctgggaagaatggtcaccatggaagtacctaagggaaaaggacttgaacttctcttcctgccactgctggtgtggagctctgggcaggcgatgttcctccagagcttgaccagcagaggagccgccgctcccttcaaccggctgggctgtggggaacccgggctcagttggaacagtggggcagaggcaaagcttcctattgcagccccccaccaccccccacccatacacactttgcattgtgtgtgtttggggggaaagtgctattttgaaagcatcctgcccagacacaagtagtatatcactatactttcagttaaaacaaatgtaaaaattttggaaaaagcagtgcactgcaagaaccaacgggatggttcagtaagggagcttatttctaggtggcatctccttttgctgttacaaatgggctcttgtccctccatctcccctggcatcctatctgttctaactgatttatgctggagcacaggctgattttggtacatttaatttaaaggcagtcacctaagaggcaagcaggcagtgcgtgaagacagctgcagagctccaggctgagtggcggaagcaaatcagtcagaattctcagaaacagactcagtaatggaagaacttagaacaatcacaagtggtattcctatttgggagaaaaataattgttcaataaatgtgttgaaacagctaatacttttgaaggaaaacacactaaaactctattgcaacagcatgtagtcatattgcgtatttctcatggactgaagaattaactattaaacgaacatgaaagacccagagagcaaacatcagtatttgatcttgagatggaagaggcctttagaaggtgcataagccagtgccgaaatgatagctttgactgcatgcaaatttaacttagaagtttacacaaaattaaaaagcaaggaacacactctgaaaagcatttgtaccttttggcaaaacgcttctctctttaaatctgagaacacctgctgaggctattagagttgtccccattggacagatgaagaagcagggcctccagcagtttatccagggtcaccaagtatgatggtggagctaagctttgaacccagacaacctgactccggggctcttaactaccacatggcattgcctccatcaataggagaagtaggaatactttgttagaagaaagagctggctacataggcaattcacagaggaagaaacacaaacgcctaatatgtgaaactttggtcctcactagtagttagaagtgcaaaataaaccgagatgggatggctggaaaagcctccttcatggatgactgttccttctgcttggtgggtggattcgtttcttgttggactgtgacctgcacatttcgtgactttctaatgaagtggatcccctcaccttggcattgagtctcttgagggataaagggcagcgattgactgggagaaatccagagtctggataatcagactccattatccattaagagcatcatcacccatgttggcatattaaaggctctgagaagtcccacagttaataaaaaaagaactgaacctgttatcccaactcacgttcaaggaatgtgctttgggaaacattgttttcctgggaaggatcataacctacacactaagtggcctggattctacacccttttttgacaatggccctaagtgtgatattagccaaaccttttattttcataagtgtttggtaaaatggggtagaaggaaacatagcttttttggaattatttatctatttgtgcaaatagagaactgcttcaggaaacttcctgctgcttcaataggagggacaaaggtagatgaaaaggaagcactatgtccattaagaaggtgccttggcaaatcttactggaagtcaggagacctgggctgtggctttgagtctgccactaatttgctttgggaattgcaggtctttgggtctcgggcccccactctgcgaagtgcaggcctgatggtctctcagtctctcagaactggaggtctgttgcctagaactaaaagaacatcaccatggatacccttctgttgatgtcaccactttcaggctccccttttgctggcagaagagacctcagtttctctcaggcctatgagctgccccatctggtaaataggtggagagaacagagccggcaggggcctccagcagatactccagcccacagtctttgtccctgggtggctcactagagccagaagagaaggctcactaggacttgaatcctggcctggtcaccttccagctttgagaccttggacaaggcacttcatctcccacagtttccgaaagccgaattcatgagacggttgtgaggatttggggtgcgtgtaaactgcagatgtgagtggaagacaggcacttaattgatgctggctgttgcctttactgcctttgttggcttcctagggccgattggctcactcctgggttccaccagcctagaggctgtgccctgatgccctgggcagccttttgggctgagttttcacaggtgaaccaagtcccagccttggctcccacagtggggcattttataacccagtgcacgtttgcaaggacttggcttatttaactgaggaaggagattaagaggccctccattgaggccttgtagatagtcatgagaacttgtcaaggtaaggatccctgaatgggaagctgaaaatgccacggccccccacccaaaggcgagtcatggaggtcagaaggtgagcctccagactttggctggctggtttccattctgcagagataagggtcatctgacaccagctgcacagtccgccctggtgagggtctctccccctcctcttcctgattgcttgctaggcacttttcttcctgcttctgctccctgaatgaggagctgaccccggttatcattgggaaagtcttcggaagccctgggagagaaagctagacaagagcgtggctggatggtctaaggcggcaggaaggagtcttaggttgatctcagtgtccaaggacaagccagccttgcagcctcccaggtcatcagacccctcaatcctcagccttccagaggtgccaggtcacctgtgaaacctgggtcctcaggatcctttctgtcggtttcccagcttccttgccatttaccctcttccttatcagcactgctcacctcttgctcctctttcctctgaatctcttgtccccttcttgaacctacatctctagtctccccccaggtacccttttccccagcttgagagccccccagtctatgtgtgagggtcctacacaacctcccagtgatgggcctctgttctgtatctctgggcctctcctgggactgctttctggtggggaggctattttagcagctcacctgctgctacctattcatgaccctgatgcagaaaatgcttgtgaggtgccactagccaagaagcagaccaaggctggaagtggagtcctcatttgttttgcagacttccttggaaacagattggccatttagtgccccctaccacacctttatatgccaggccagagaagcctgttttggtgtatttgggaattcaaattctacaaaattcttggttaggtgtttctaggctgttagtctgaggatgcctgaaatgcttggttaggagcattgaagttgatagtggagtgccttgaaatcgaaaggcacaatcctgttcagctcttgtctttaccacgtcttagctgtgtgaccactgagcctcagtttcctcatctgtgagatgggcatgacactaacttcaagaatgagagatggggggtgtaaagcttctagcatagtacctggcttgtagtagctgtctgcatggagttctgaggtcatgtcaaacttgcgcaaaatactctgctgttctcccgggttttaagagatgactatcgtgtgccaggtactgttccagaccctttgcttatttaaactgcacaccacaaggttgatcttttatgcccattttacagatgaggaaaccaagtgaggtttcatgagttggtccaagcctcacagctaattagtaaggagcagagttgggatctacccgtctgcaaagcctgtcttctccgtcacgctgtttgtgcccaaagctgccccaggagtagctttctccttgtcactgcaggtcaccagaggatggctgactctgaatgcagctgtcttcacaattcttagcaccggcaagaagttactcagtctccgtagtgggtagcttcccccttcccacgttgaaagggcgttctgttctggcctcctgtggttaaaggtgcactgctgatggagacggaagcatccgtggtaacaagcacaagaccccaacatcccagctgccagctgccaagcagtagtgccggggggaggggtgcgttgggttccagtgcacccagaggctttgcattgcttacataaagaagcttcagagctttagaagggatgcgtgggggaggaatagtcccgccctcctccttttttgggtcattggccctcactgggccggacacttcttattcactaatcagacggtttgcggttgccctttgccacatctgtggctgccttcctgggcctgtcgagctcacaattaaggttcattagagaccctgtcagtcatagcacgcacagagcctgcctgagagaggccttgccaaggggctggccagccccatgcccccaccaaaatgagtccctttgcaaatgactgccaaccaaattctagaggctttgtgtacaggagagggggtgtgagcagcgcttgtgaagctccagactctcgggtcctaatgggcccattgccttttatgtaattgaaaccttcaggcgagctctcgaattgatgttccagatggtggcggcgggagtgctgtcagatggacgctttggagggatcatctgacagccggcccctccgaaaagagatttggagccaaatgcagaagagatttaatgatcgttaatctccctctccctctttctggaatatattgggactcttaattactattgactggaagctaaaacaacactcctagttcagaacaaaactcttcaggagatttgccccaggctgaaaggattatccttcatacaaggggatttttttttttttttttttttttgcctctttctagctatgtgttgaacatcagttgggagtagaggagatatgtacatcaggtgttttaaagaggcttaatacttcttcgcccgcattgttttcctgtctcattgaccttcctagtcccaaacgctgcctgtaggggcagccaaatctccacgttttatctaacgcactgaaagcactgctgtgtgctgtaactgtactcttagcactggagggccctctggcttccgagcacctgcgggatgccatgatgctcacctctatccccagaccctaacacagtgcctggccacatgtcgatatggccacaaataaatatgagataatgaaccaaaaaccctgctatccccaaattctgaggggagtccacattagacattctaggctgtgtgatctgagacccagagatgagaagggacggatgcctcttggagctgagctatgactcaggagacctcagcccctgggactcaagggctggtggtcccggcaggtggcagtatatggacagagtctttaaggtcacggagtcatgagttagctggggctgggagcatgcatcctgaatatctaggtgaccctcggtaagctaccagactccaggcctcagtttcctcatctgtgtaatggagagaattctggatttgcctcactctaaaagaggacaattgtgaatattaaaggaagtcatgtagggaaaatacttggtgcaaatcatccaaagaaggtggtggaatccctgacaggagcggctggaatccactgctttcccatgattgctgagctgtccttttaaggaggagggtgcgtgccccttgtcaaaagcagcctgcgtttccctgtttggccagataggtgggtgaatgctgcttgatcgggctctgaaatgtcctgccttcttccaggtgggagagggactgtgaggtgagctcagatcttgcaatgacaagcgagcatttttcccattacctctttttttttttttttttttttaacatggagttttgctctgtcacccaggctggagtacagtggcgtgatctcgtctcactgcagcctccacctcccgagttcaagtgattctccagcctcagcgtctggaatagctggaactactggcctgtaccaccgtgcctggctaagttttgtatttttagtagagatgcggttttaccaatttggccaggctggtttcaaactcctgacctcaagtgatctgcctgcctcggcctcccaaagtgctgagattacaggcatgagccactgcgcccagccatattttttttttttttttttttttttttgagatggagtctcagtctgtctcccaggctggagtgcagttgtacgatcttggctcactgcaacttctgcctgcccaattcaagcgattctcctgcttcagcctcccgagtagctgggactacaggtgtgtaccactatagccagctaatttttgtatatttagtagagacgagatttcaccatgttggccaggctagtctcaaactcccgacctcaagtgatgccaccgtgcccggcctactactgttacctcttgtacttcaacctcttgagtcttgatgctgcaggcgttaagtagggcatgtgacagggaggaactgcggctggagtccaggagggaggcaggcagaaggggcactgggtgcagctcaggctgctgaaggccagtggagatgtagttccacctgcccaaagcggggtcacttttttacagagtgccatccaccttatccagcctgttgggtgaaggtatgtcccaatcctcattttagagcagttcaatgaatgtttattgctactgctcctccctgcattactggagtgttataatagcctgtagacaggccttcctgcctgtcatcccctgcctgctctgcatacagagtagtcttgccaaaatgcacttcggataatgtcccttaatgactccacattgtcgggatcaagcccggagaacacatctaggtggaagagctcttgatctggccctgccccttcctcctgtctccttgtcttgcacactcccaggcctgtgccctgtcttgttgcatctttgtacatgccgtttccttgactgggacacatgtccacaccaactctgctccctctaactgctcatcttcccatctccgctggagcctcacttccctcaccctgccccccagcatgccccttgcttctcctgtctcttggacttgctccatcctaggagctttggctcttggagggcagggatcttttcttttgttcacctttgtatccccactgtcaagcctgaagcggacattcagtgagtgcatgcctacttgagcccccatgaatgcaaggccctgcctaagctgaagcaccagggtcagagtgacaacagaatagttgtgtctttaaagagctcatagccacggtgggagccagataacccaggatggatagaatgcaaggcttctttttttttgttttgttttagagatggagttttgttcttgttgcccaggctggagtgtgatggcacaatcttggctcactgcaacctctgcctccctggttcaagcaattctcctgcctcagcctcccaagtagctgggattacaggtgcctgccaccacccccagctaattttttgtatttttagtagagatggagtttcaccatgttggccatgctggtctcgaactcctgacctcaggtgatctacccgcctcggccttccaaagtgctgggattacagaggtgagccaccgctcccagccagaatgcaaggcttctgatgtgaggaacatgggcactgcagagcaccacagaggacaccgtggcccacccttggcaggcaaatcccagggaaagcttagagtgggcagagcctgagatacagctggtgggtggtgggaaggtactagctgggcagggactgagcaggagcagctgggtttctgcctgattagatagagcgtgtgaattggtgtctagtgagctttgagttttgattcaggccacatgggtcccttaccagaaagcaggtgatgggcgcacactctggttttgctgaggatcagctgttagctcccactcagactttctagatgggtaagggacagagatcagcaggttccctgcaattttaagatcgtaactgagaaatgtgcccttgtaagcctgttgatccaagagcctgcctgcctctagaaaagcccacatcagtcctttcctaggaggcagtggccttgttgcctctgttgagacaaagttctttattgacctcacagggagctgggactttctgaatcagaccattcaggtgttctctcagttcctgttgattccttcgcagccctggtgggaacagctgctgctcttgagggaacctaaagtaaactcctggcttgccattttcctgaactcgtagattttggcagaggagaagggtggagagtccaggcctttgttcctgatcctgtcacccttatgagttaagatttggcaacccttctcataactgctgggggcatagggtatcctcaaaagtagagttaaattactggtttaaagagtctgtgctccaaactccagtgaacttcatgatacagaaagcaaagaattgaagggtattagctgtttggggaaaaccactgctcccaccacctggaagccaaataagcagatgtcccctctgggtggagcagggggccaacatcactttcttatgttattataggtcgtcagcctatgtgtaggccatttcagtctcattggaaatacctggaaaaatgcctggacttggaaaaatgcaaacaaaaaacacagcacgtagctctaaaggggttgtttagtcctcccctgaattctgtttctgccttaaaacaccagaagagctttggctgtgtgccatctgcaggaagcaccctaggaaggagaggatccaccctggcttctcccaggctaggtggtccttcgtttttcacctttttaaaaggctcacctgaggctgctgaaaaggtggcaaaagacaggactgcatgcttcattcccagcaagagtgtcaggcaaaattcgaactccttgatcacccattggtttccacattctttccattccggagaccaaggggagatttgccgatgctgatgctccctgggctttgcaaagctttccctaattaaagtcctcccggctgtgtgcatagctcttctgctgcaaatctttgcccttttgtgtttgtgtttaaaattccatctttccaaaatgtttgcccactcagcaagtctccttgaaagccctcacttttgtttgggggaagttttttttttttcctttttggtttttattctgcctatgtgtaggaaatttaagtctcttaggaattgcttgtgaaaatgctctctggtctttttttaaaccatgatgagtgtctctcaccatggcattggaagctggcaagggatgcccctggtgtccgtgctgttagctgccacttgagcttttagatggagctactggagtatcattttggttccattctaaggaaaatgaacaaaagagcttttccctcctgttcaatgtgcaacagtgctacaaggtgagagaagtatgttagcgaggaatctgaaccaggtcaggatcggggcaaggtggtaggaggctgagctctccagtggtgaaaaagatggctcttgtcacctagagccaggaggcataattcaagtgaagtgcatataggcccgttccttggccttgtcctcataggattttttttcctacaagatctatccaggtccttcatttggggaaccttatggactcctgttgttgttggaagccggagaacagtgtttggagagcttccattgaggatggtctgaagactctcactttaagttagatcctgccctctggttgatgagaaatgtgagacgtaaaagtgaattggagagagatcccacttccccacgtgccagaaaaggcagacaacaactccctcctcagagctgttagaaagccaacatctcgcggttggcaggcactggccctggatgaggaattcctgggtcgccccccttagaacatgtctggttttggaaacaggttaaaaatacttgaggagggcatggcacgctcagtctgcttccctgatgtttgaaataggccaggaatgtgggccgggaagcccagaggagcctgcgtgtcccgcagggttttgtagttggagcctggggtttctcctctccatcatcaccccctttaactgccagtgaccacatgccagattcatgaagggcacactgaaattgacgaagacctgtgccatgggtagcgggaaaaactgggctccctttagtaagcaggatggtgttgaggtctcggaggcaggcaaggggtgggctcggaatctctcctggaagagaaaagagaagggaatttggattctgtatacaaatatagaaattccctaagagtttaaatttgaacatggcattcaggggagaagattatgggttccaagccttttccttcttccccttcttgtgaataactcactcagctgcttgcatctgtgtcctaaggctgtgaaccgaagagctgggcagtccacagttggtttgagcctcagagtaccttgcttagtaaaggtttgttttaggagggatgacacaaacttttgagtaactctcaagtcttgaactatgaaacttcgtaggatgtcaacactaaaatgaaccttaccgattatctcatctagtggttttcaaacatttggaaaattggtacagccctttttttaagcaaaatcttagaacttgaataaaccaggtagaaggtggtaggcccagacttcctctcccactcttgacaccctgagctcctccctctgtactcacagccctcaaagtgctcctctctcagagaaccatccattgcagagaccagggagccgtggcccatgccccatgtagcaccgtttcatggcagaaccagctctgacttccaggccagtggcaagtccctgcagtaccttggtttattttgatgtaggaaaagctctgggtagtaagagtgaagagtcaaacagctacgactgagagtgaggagaaagacaacactgcccatggttcctgacacccagggtcactttttaccaacctaactctgggtcacatgacgtactcgtattctgaaactgttggtttcctggatgtctacctgtgatgtcttggatccatgtggttctctctgcctaaaatatcctctcttgattcaccttcttaacaacagctttctggagatataattcacataacataacatttacacttttaaagtgtacggtccaatggtttttagcacacgcaagagttgtgcagctagctgggcatggtggctcatgcctgtaatcccagcacttcgggagggcaagacaggcggatcacttgagtccaggagttcaagaccagcctgaccaacatggtgaaaccctgtctctactaaaaaataaaaaaattagccaagcatggtggcaagcacctgtagtcccagctactcgggaggctgaggcaggagacttgcttgaacctgggaggcggaggttgcggtactcgagatcgctccattgcactgcagcctgggtgacaaaaaaaaaaaaaagagttgtgcagctatcagcattcggcatcccacgctgtctgcctttgacagacagagatgctctctgtctgcaccttagtccttgggctgctttgcgacctgccctaactgccagccctgcctcactttctgtaactcagctcagatgtggccccctggagatgtcccctccagtctcccctgcttggtcgtttctatgggtgactcagtgaaattacagcaaaacctgatgagacatccctccagtggaaggaatccagtgtgaaacattgtggccagacagcctgggtgacttttgtgctgagaacagcgaagcaacccgacttgttgagtctgccttagcacccgctcccccactcagacacgtaaacatggcacaaacactcccacttgaagggaaacagaagtattactggaatcatggtaggtcattgaggtttagaagcttgtggtcgtgaggatttttggagaatctgttggaggaagccagacctccgccctctgactcagtggctccgtgctctgagctggtcagcctctgctgtggcttcaaaggtcattcgcctcccaaggggctatcaggacccctggggcgaggagtacagggctcagcacctcgcctggctcatcgggagactgagcaggtgtggcaggatgactgtggctcacctccgtgtgtgggccctggaggtcacggagttcctcatcatggagcagatcctctcggacttgagggtgtttcacaggctttcagattctaaagtatcccctgcgttgccattgcccatggttgcctggccgtgtgactccttattgtcactttctgcctcaggtgtctcgtttctgctaaacagaacatgtgagatttccctggcatccccaccagtgtcgacgtgcagatgaatatcaacccacagaccccgatgctgttggtctgtccctctgggcgatcatgagccccccagatcagtggtaaagaacagcccttcctatgctgccccatctggctcctcccgcattcgggtggcgcgcgccctcaggcttccccctgcattcttattttgtaacttccatggtagcccattcatagttttcaccctaaactctaggtttagacgtggacatttggcacacatgtggtttataaagcctgaggccaggcctaacccttagtatccagtgatgatgaaatggatgcatttcccatttccctccctgaaattaggtcttgatgctgtaccctagtaggtggctggtatgagaggttccgttcgcgttgaccttgtgtgaaaaaccaatcttgccaagtacttctctctgccaccatccagctggtgactctttcagctgaattattttgcctgctaggttactcaccaggtgtcattctagagtccgcacggccttagggtgggatcgcatggctttcattgaattacctgctgtgtgaccatagccaagttgcttaacctacctgtgcctctttttttcacctgtaaacagtaatgtgggataataacacccctgccttctgcagggttgctgtgatgataaaatgaggatgtgtgttacatgccttttaaatggtaagacctaaacatctttgctgttattccaatcataactttgatagttcagtaagtcctcacttaatgttgtccataggttcttgggaattatgacctacagcaggcccttgaataatgtttcattaaaatgttgacgagaacaaaaatttggtttcactatgtatcttttcacttaaacgagaggacagagatcctctgtgaaattacagtgtctttggagaaaaatcaacttatatatgagttatgtttgtgtatttttacctggtcttttcccaaaaagatttcaggtgacagaagaatacaagccaatacgataatctttttttttttaattttttgagacagagtcctctctgtcacccaggctggagtgtagtggcgccatctcggctcactgcaccctccgcctcccaggttcaagcgattctcctcccttagtctcctgagtagctgggattacaggtgctcgccacagtgcctaatttctttttttttttttttttgtatttttattagaggtggggtttcaccgtgttggtcaggctggtctcgaactcctggcctcaagtgatcctcctgcctcggcctcccaaagtgctgggattacaggcatgagccactgcgtctggccaataatccttaataaaaatgtggactgagaaagctggaccgaggactgaggaccgtccgggaagagaacagcagctaccccgtgcttgccttcatgctgggaaggctgcgggtctggctttaggaggagcctgtgtagggtacgaggggcagcggcagctccacagcaggcggcagcccacgcccagtgggtgcacaccttcatccaactcagggctggcagtcaggaagatgaaatgccatccacgtcaagtttcggtctgtctcccactcaccgaagaatagtccctcctttaagggaggtgctgaagagtgctgagaacttgcttcccaccaaggcaggcttgggcttcaaaagatcagaacctgacccaagtggccctagttttccaccatcccacaccatcccaccaacgcttcagaagtcctgccagcatcaagccgggcatgaggccgtccagacagctcatcactgccctggggagacacatgcatgtcacaaacctgtgaggctcaagaccgcatcctgcacagggtgcaggagtagaggcggggcaacggcctctgccgtcgcggctttgggaggttgcagtggaagaggcaggcgtggccgaatcagaccctgaaggatgacttaggtggaacacggggaagaaaggtggtctggatagacatgcaggatgctgggtgtggggcaagcctgagtcaggggagcctccctgtgctccttagcctgaggccatcgcctggctgtaggcggcagcttctcctgccggctggctggccggctgcaggcagttctcagcactaagtccaagatgacttccattctggtgactcgaaggtggttttgtatgttgtgcttcatctctcagggacgagtccttaattaaaagcagccgggagcttagagagaccctggcttctctgcacacaggtgatgggttgtgtgcctggccaggaaatggttcatttaattaggctccgagggcctggttcatccccttcagggaagcttaaggttacatgtggacaacaggagccttgtgtgtgcctgtggttgacccaaatgtagtgattttcatttctcctttccatttgtcttctttgttctgccccttcctgaccctttctttaggaaaccgttgtggccccttccaggctgtgagattccagagggcaaagctttggggtttggagtatgaatggctgaaagcgagcccaggaggcctgcttttgtttattatttatctctggatggtcagggcacctgtctgagaaaagaaagagatggaggggacttaccgtttcctgaaaaagctctttgttgttaatggcatgtggaagactcatttctaagtagaataaatcatttgttggtcaaaaatggcttcctaatgttggccctctcggccagcctcagttgtattaaaccctaggtaaccaaccacaacccccgccttgagtcatgtgcctcatatgagcaggtacagatgctgctgcaccctcgaaggggttacgtgacgaaaaatccactggaagtagaaaatgcttttaatccccctaacctgccaagcgtcgtggcttaggctggctgaccctaaatgtgctcagaacacacctacagtttggtgaaagcacctggcgcgcggtggctgtagagtgtcatcgctcacctttttgatcacagggcttgtggggagctgtgggagctgctgtctccctgcgtcatgagggaggatcagaccgtgcatcgctagcccaggaaaagatcaaaattcaaactacagcttctactgaatactatcgcagaatcaaaaaaatcttaagtcagaaacatctgtgttactccgccagatgtgctgtatgtaccattatctcaaatctatgttgcgtggcttgctcactttttttgtttgtttgttttgttttgttttgtattttgagacagagtcttgctctgtcacccaggctgaagtgctgtggcgcgatctctgctcactgcaacctccgcctcctggattcaagcaattctgcctcagcctcccaagtagctgattacaggcctgcgccaccacgcccggctaatttttgtatttttagtagaaacagcgtttcactatgttggccaggttggtctcaaactcctgacctcaggtgatccgcccacctcagcctcccagagtgctgggattacaggcgtgagccactgtgcccagccatcgcttgcgttttaatgttgccaaaattgggaaattgcttcttacacttaatgtgtacacttagcgatgttataattactggtgcatcttacaacttacagccttcacaggaagaaagcaggctgtgcttgcacttaaagaatatggcccttggccaggcgcggtggctcatgcctgtaatcccagcactttgagagggcaaggaggacggatcacctgagaccaacctggccaacatggtgaaaccccatctctataaacatataaaaattagctgggcatggtggtgcacacttataatcccagctactcgtgaggctgaggcaggagaatcacttgaacctgggaggcagaggttgcagtgagccgagatcgcgccactgcactccagcctgggcaacagagcgagacttcgtctcaaaaacaaaacaaaacaaaaaaatatggccctcagcgccaagtgacttcttaaagaggagagaggctggacctggaagtgtcctcttgtgtgtggccctggcaggcggggggccagtttctcactaggctctgctgggcagtaggcactgagcccctgcccacacgccaggagtccccgaggcccagagtggaaaggtcacatgtcggatctgctgtgggctgtgggctgtggtgaggggcaggagagcccagccctgcagcccttcccaggcgaccccaggcaccttgggtctgccgtgaccgggcacttgggggaaaaagctttggtcctcacagtcccataattcccccaattctattattttttcctcccctgtcccctgagcctgactggggatgggggcagctcgccttgttgacccggtggggcctggtctttggaagagctgggtcagtctcaaattgagattctcattcctctccacctcgtgttggctgggacagccggggccagcagcttccccgtgcctgggttttctcatccacaggttggggggtgccctcaatcctgcctccgaataggtgcgccataccctagctcacgtggctattatcctaaggagatatgttttgatgcttcctggggtgagcgggagcccctggggtccccctctggttactcaggggtaccacttgcctgagtctctgggagcacagctgcttcccgtccaaaaacaagcttggccacccgggtgtgactttcaggcccggcgcgaagctgccacctgtgcaggtgccttctcattgcagaggtggccatgctcagagagccattaggcaaaatgggtcggaagctccagcctcggctacatgaagctgtgcttccgtggctcagtgttcctaatgacaaactggggtccctgtaacgaagctgcccttggggagttggggagcaggcttgtgttttctctacactaagtagtggtggtggggtggggattcctgcatctctcataggctggtggaggccatgtgtccatctggacagaccggtgaagggagccccactgaagggatcctgacctggaggccatctccctaggcgaggacagccagcttgcaggccctcactgggaggcctttcccagcatgtgctcttgtacctttttgaattctgacctatgtgaatgtattacctattatacataagtaaacactttttttcttgagtcaggttcttactctgtcacccaggctggagtactgtggtgcaaacacggctcactgcagcctcgacttcccgggttcaaacaatcctcccaccctagcctcctgagtagctgggactacaggaacatgccaccatgcctggctatttttattattattattttagtagggacggagtcttgccctgttgcccaggctggtctcgaactcttgatctcaagcgagccaccgcagctggcctttttttttttttttttttaattcttaagaaaagcagtgtgccagggcctgccctcacacttggagtgacccaggaggtgctgcgtgctgcctcactgggtctcactccagccgcgctttgctcctctctgttcttgcacttgcctcagtggcctctgcagcagagcctcatgccagctcttccctcttcttgggatgcccctgttatttttccctgcagtcttggagggccggctccttggtcattattcacatgtcatctctgtgccacctcctagactgctgacttgcccccacagcaacccccttctgtcgtctcctgcaggttcgcttcctgcctctttttttttttttttttttaccttgagacagagtctctctgtgtcgcacaggctacagtgcagtgacacagtcttggctcacggcaacctctatctcccagattcaagtgattctcctgcttcggcctcctgagtagctgggattataggcatgcaccaccacacctggctaatttttgtatatttttagtagagatggggttttgccacattggccaggctggtcttgaactcctgaactcaagtgatccaccctcctcagcctcccaaagtgctggttacaggcgtgagccaccatgcctggcctacccttgcctcttggagatgcctctgtggctggactttgctgtcagagcagggccgcccatgtccatctcttcccgtgctgagcccttgcacctgacacgggcctggagcgggcattcggggtttatggaacagtgtgaatttctccttgacatggatgttgtaacccccagttccagagacttaggaaggttacactcagccagcaagtgactgaccgaggatttgaacctgttcggtttcgaggttggtgtttttacagaatgccacactgtatattttgtttctgacacgagtgtatgtgccacttgaaatgctcttttatctttttaagaaagttttgggccttctggaaaaataaaaggaacaaattgtcacagagccctctgctggacgtcggcagctgcagcattctggcgtggcagtttcctctgagtgcacccaagtacgcagaatctgtttttgattcctatcttgctggtggtgggctctcggccaacaggcagatcaaaagatggaatgtgttcatttggccattttttaaaaaaccgaggtacaagggtgcacttcttaaagacaagggcgccgtgggttagactccgtgggtctgagctgctctggcttttgtgctttttttaagggttcatctcaagtttctttttctggttgaacaatttttttcaacattaataactaatggagaagaggaagaggcaaagtagaaccatatggcggcacaaacacgaacctcacttgtggccggaaacttctgatttgtatctcttcgtgtgatcagctgttgggttggatgatttaagaaaaaaaaaaagtgttcagtttgggaaaagcagtttctttttgaacctagctgtgctgtatataactgcatgtccttcctcagacattggcccgtagctgcgtggctccggtcaagttatttctctaaggccctgtttccccttctttaaaacaaggactggagtgcgtgtctgtgtgaagagccattgtcaggatcatagggaagggcagggagagctgctagcatagtgcctgccacgcagggcagggctattacgatcacctggtccttccacggattattattcaggtgtcacctgaggccgttgccaatggcatcctagtctctcccttaccttctaccttctggggttttttcttttccctgccctagttcactttacccactccccacccgtctttccagtggcctcctgggtaccaccgagcccggcaaaagtatcggtggtgaaggacttgtggctcctgctccctggggtgggcacactcctgtggcagcagaggaactggtggagccctgaactcccaccagaaagacggcaggcactgtcctgaccagtgtagtgtttattattccaagtcactgggaattatgtttaaatccccccaacagcctggattggtctgacacctttggtgttatctgaaccttccctccaaggccgttaggcagttcagatgggtggtttagacagaaaccatccggctgccgcgtgtcagcaccgctcctcctcctcagaggccctccctggctttggaggcgacagagccagtgccacatgcaccccaaagtgaactctcggctttgtttggacctgtcgtttcatttaaatcactgtacaaacccatggtctgtgacacttaatgtgatttcttccactgctctaagcactcgacatgagtagggggcgggggccggggttcagatgagtgtagggactggttagattacagagatacactgccttcattctggttctgtaatatggcctcagaccacaggattaatatccacttacatggaatcagcatgcattgactgatccctgctgcagcgggcgtgatgctgcgctgaggctggagggcctgtcttggcctctgtaggtgtggagtcaattcacaatgaaaaatgctaagtggtgaggaaggagtaaggtgaaagtcattggcagtattagaacagccatccccaaagcatttaggattcagttgatattagtgttactgcaggaattctgaagaatttgacatcttgataaagaagttggagtttgggccaggccctgaaggatcagtaagatttaagagagcagtggggattggctgtcagatttagcaaataaaaatacatggcctggccaggcgcagtggctcacacctgtaatcctagcactttgggtggccgaggtgggtggatcatgaggttaggagatagagaccatcctggctaacgtggtgaaaccccatctttactaaaaatagaaaaattagctgggcgtggtggcacacacctgtaatcccagctactcgggaggctgaggcaggagaatggcatgaacctgggaggcggagcttgcagtgagccgagatcgcgccactgcactccagcctgggtgacagagctggactccatctcattgagaaaaaaaaaacacacgacccatgtaacctttaggaagtagtcatactaaaatgttattcattgtgtatctgaaattcagactgaactggcctccctctgttttatccagcaaccctcaatggggaagatgtttaagtgggggaatgcacgtgcatgttcagggagtggtgaatgggaccgtgtggttgtttgaggagtttcgggcagaggtggagggacggcgtgggtatgagacgggatcagtgatggtgccaggtcgtgactaatgcacctttgggcagctgctgtggtccaagtctgtgggcacaccatgtattattccacatttctcattccccatgacaacgaaaatgttattattccagagcagattatctttgatcaaaagaaacagcgctgatggaaatatggccaaaactatggcccagcttaagagttgatccaaaaggcaaaaatggtgcctgcttgggtggagtccgttggccatatcaagtcccagaggcttttcactgtaggacaagcactgccagtttttgagttccagtttaaatgtatgtttttctggggttggttagtacctggcatactggctttcagaagtcccatcacagatcttcaagggcggtctgtctccgtgcagctcatctactgtgtttgacaaatgaacagtcttgggctttgcctaaggttccgtggccagctcacagcagagcagaggctagaacccaggtctcttagttctcactctttccaccaatgctgtggctccttgaggtcatatgttaataaaaaatgccagggctttcatgacagctccggttctctttgttcagtgctttcccaccataccatggttcatatctgagagtgctgggttggaaccacacaggaaacttgtcatcagcatccattcagatttagttctggacaagtgcttttgctaaagattcctattacctgccaatttattaattttaaagtaaagttgattggagtttgggaggctccgtgttgtaaaactcctcctttcctccctctttccctcctttctttccttcctcccaaatatattaagcatttgctgtgtgtcaggcacagccacaggcactgagaatcctgcagtgagtaagatcgaagtccttgccccagtaaaacttacattctagtgagggatacagataactgatcaatgaaaaaatactccacctggtgttaagtgctaggaagagattactcagatgctttcgattcatagatgaatctcttggataggagtagagtcaagcctcttttataccaaaccctattttcttgtgagctttcctacgttgaggggacttagctgcaagcagtgtgcctggcaggagaagggaaacagctggctccaggtggaactggggtgaagcaccggatcctcacaggtacgtttgtaccctgtgtctgaagcagcacagtgaattcaggtatgatccaggctattgttgccatctgagagtaacaggtgacagatgatattgtctaaaggaagggaaaggaacctgaacgtgtcaggcagtaacatacgtgcatttccctgtgccaggctctgccctgaacacggaatgcattgtgtcatgtgggtcctcaaaatcacatgggcatgggcacccagatgggttggttttattatccccattttacaggtacggaaaccaagtcttagtagagaagtaaaatgacttacccaggccataaggctacttgtacgcagcggagtcaggaggtctaacttcagaccctgtttgctcagtctctactgtaattgaggaaaaattgagctgatggtgtcaggactccaaccagagagaatgggttccaggcaaaagttgaggcccaacagataagccaaggcagcatcccagcattataaacagagatgcttagggacaggcatgatgtgttaggtgaggtggcttcattggctgtggcagcacagcaaggcctctttcaggtcccagatggcctcgggtggaagctgttagaccttccttcctcagccaggacttccttccagttgaagggctctgtggccacagctaagcagggctggggctaggagagggctgtttgccaccagagggtgcctttagcatgcactgtccttccccttagctggacattaaaccaaagttagagtaggaggagtagggactttggactcatctggccctggttttgttttctgtctccactgcttgcttcttgtgtggcccttgggtaactttatggctcccggcctcaactctaatctgtaaaatggggctttgcatacccactttgcagaatgcgtgtgagctttcaagtcaacaatatgctctaccatagtgcgtggtgcatggcaggcacatggaaatggtaaggtgcatgatattatcaccaaaaccaactttgaaagtagcccccatttttattatgtttgttaggaaagggcagatacacatggagaaagaattctgaaaacaagcacaggtacaggccaggcctgggggctcacacctgtaagcccagcacattgttcacaggggttggtggtgtatgtctatctctttgggtactgtcccctgtataagaaacagatcatctcaccaaggccagaatttctgtgagttatgaggcagggttacagtcctttagttgtgctgggcgttgctttccaagctgagttctaaagcaccctggaggggcagcagaggagcccgtggaggctgggtggtccctgtggtggtgggactccctgtccctgcctgtctcttggatggtggcaagggccttctggaagaacacaggaaccactgtcgctgtcagcccgtctgctgagctgctctgctggtgtctttgccatacgatggaatttttccactgggaagggttattggtgcaactggcaggcgctttcctggtaaacgatatggtggagcccccataaacccaggcccatgaaacaaataagtcagcacattgaaaatatagcgtggaagtgactcaggcctgaaggaatccatttctgaaagtgctgccatccctttctgggatattttggtagaaattgatgtttgagttgggaggaggaggccagtggcctggttacttgcagagccttgtgtcagagtcgcaacattggcccagagtttgagtcctgccagcccccgaccgcggggtcatctttcttggtgaggcggccccctggcaggccagccggaggtgagcccactggggctctgtgctgtgggggagccggggtgaagctctctttgcagcagatagagttgactctacaagccaactggtaacacttggctaggggcctggaaagtactggagactccacccagcataggagcctgtgggagttcccggcacggacgagtttttctactccgagttctttagattcctgtgtatttgaaatgtttaccttcttctcgggacttcagcttgtactttgcccaccagagaccaataccaagcacatacacacttaaatttactaggccaccctggtgaccaggtaattaaagctgcacacagtttttggaaggaagactgtattagaaatcacgctccactgtaattcaagaatgggtttctttatagagggacacagttggtgtcagacacatgtggaaaagaaaagaacaggcccataattttgtctcagtgcccagggccagatgttaaaggtactgaccacaatatggctgcagtattgttagccacctgagtttggtgtgctgttttaacctctgtttcgaccttgtcctttctctctgccaggtccccagtctatgtgaggatctcctgtcttctgttgaccagccactgaaaattgccagagacaaggtggtgggaaaggattaccttttgtgtgactacaacagagatggggactcctataggtgagctcatgccccggggatgcagcaggcacagcaggcacacgcgggctgccgtaggtgcctgctgcagagcacggggaccttggacttgggcagctggcagcccattcagctttccttccgtttgttccctgccctcctctcctttcttctcttgtcctccccattcttctcatcgttccatctgttattccaatcatgcagcagacgtttgaagagtgccacccacaagcatgagagatagagcagcggaccaaaggccccctgccttcatggatcttccagtctaacgggagagggatgttgttcaaaaacaactgttctattataattgcattcagtcctgcggagggcagtgtacagggtgcgcatatgatggggatcctgagggctgggagggtctctgtggtaagggatctacgaacgcagctctgtcagatacacaactctcctctctctttccgtcacctcgcccaaggctgtaaataactaagttgacattagtccctgccctgggtgtctgatcaccaggtctagcataggagacacattgggtaactgataactgtatgatgtgattcatacagccagtgcaaagtctgttcagggtgggacggtagcacagaagaggccatggtcaactccaggaggacttcctgaaggaggtgatgtctgagctgggttttaagggcatgtaggagttatacctctattttttaagagtgggaatccttaaactggcccagtgtttccatgatgaattgcagtagtcactgccttggagaatggtagaggaacacagcctgctttaggtttatttggagaccacagaaccagggttgtcttgaagcttcaccctgatgctctctttggagatggggcaaggcttctgggaagtcaaagcaggaaaaatgatcaggagtcagccagtgtgggcttcaaaccagcacagctccctgtgtcaatgggactttgacaaatcacttattgtcgctggtcttttagttttgtcatctgtaaaacggaaatagtagtgtttctttactcaacagaatgcttcctgaagaaaataaagaggacagtgggagggagggagaggacgggcaggcagggaaggctctcccacaagtgggaactggaggatgaaaaggtccaggtctggggaagagcctgctgggtgctgaggccctgggtgatgagctcaccaggatggagctggcagaaggccagaggtggagaaggcagtgaggggagggcagtgggggcggagatgagggaggaggcatggccagggcaggtctggcagggtcttgaaggccaggctgagggtaataaaagttagcacagggttatttattggggggataaaagaagtaacacacgtgaaatgttgaatggcacagacattgtcatatacttaaaaagtttaatactgacttataagagactagacaacagttttataatcatgtccctttcctggctttaaatggaaattaggtagagaatatattttgccctccttcagaccacagactagagttgaaatggtgagaagtggtgagatttgaggtcacttttaaaagtagagccagcggcctctgcaggtaggtggggatggaagaagaggaggtggggtgtgaagggtgattacaaggcttcggacctgagccactgttgattgaggtgaggaggactcggggaggagcaggcatagggacactttaagcttgagaggcccattagatcaaagtggagataccaggtaggctgtggatgtaccatgtggagttccaggagagaggtttaggctggggatgtggctgcagatgtcccagcatatagatggtgatacagccctgaggccgatcaaattcatccttgaagggctcattctgtgcctggaactgctggtcacagcatggcgtccaggtgctgtccttgggagcatcttgctctgtcgcccaggctgtagtgcagtgatgcgaacatggccccctgcacaagaccataggcatgtatcaccatgcccagctaattttttttttttttttttttgagacagagtctcactctgttgtccaggttggagtgcagtggcacgatctcagctcactgcaacctctgtctcctgggttcaagcagattctcctgcctcagcctcccaagtagctgggattacgggtgtacgccatcgctcccagctagtctttgtattttcagtgcagacagggtttcaccacgttggccaggctggtcttgaactcctgacctcaaatgatcctcctgccttggcttcccaaaatgtcaggattataggcatgagccactgcgcccagccccagctaatttttttgactttttctctctccttttttttttttttttgtagagatgggggcctcattttgttgcccaggctggcctcgaactcctaggttcaagcagtcctcccacttcagcttcccaaattgctaggattacaggtgtgagccacattgcccagccagggagccactgatgaagtgggtggaccagcccttagagagagaagtccagtgaagatggtgagtggtctgacagaccagggagcaggcagggagaagtattctcgcccggcatgcagttcagggaacgcttcctggaggaggtgttccttgaactggtcttgcttaatcaacatcattattatatttattatttccacctaaaaactccagttgactgtgtaaggcagctgttctgcaggagctggtggaaggacgggatcatgtctaggtccgtggctaggccaggctctgcgggagacttggtacctgcagcccttccaggtcacccctttgtcccccacctgcattcctgaggccctaccaccagctctgggggatctcaggcctttagagaggagcctggggtgtggaggcagaaagtatgtctttctttctcctcttctcgatatgaaacttcaaggtcttctgattctgtccacagatttccatcctgactgtgtttgatggtttgcttaaataagatccttatggtgtgaccgttgccagcagcaccgtttgaaacctgttagctgaaacaaaaagccttctcggagggaaatgaaagtcctgacttttgaaatctaggcattcctgtccatctgtcttttttcaaatggcctccatttaagctcttaagtgtgttctgagtgccccttccactaagaatattctggttaatgttatgatatttccctcagctacaattaccctggcttcaggactaacagcttgaaatgctatcgtctgtgagccagtagaaatgtgagttacaggcttcttgcaaattgcaggcccccagtctgcccgaaagatgggctcttgtgtctaatcagggtgccttgaaatgaacgccacttgggtcgggtcttcccagcctacaggaaggcgatggctgtcatcgaactgtgggaacggtcctgcgtatgagtgtgctgcagagtctcaaagggccacccaggggaaggagggaattcagctccacaccctcagattcttatccactcccccggccagcagaagaaccaagccttgtttatagataaatcatggcgacagcatcttttcacctggatctttgtctctgagatctgatgagaggcttttgttgatttggtgtttttgttttttagtgcttaggtgaggctgaggcaggagaatctgcttgaacccaggagacacaggttgcagtgagctgagatcatgccactgcactccaacctgggcaacagagtgagactctgtctcaaaaaaaaaaaaaaaaaaaaaaaaaattagctgggcatggtggtacatgcctatggtcctgtacagtggaccatgttcacatcactgcactccagcctgggcgacagagcaagatgctcccaagaaggacagcacctgggcgccatgcccgtgaccagcatgaaaaagccagaaagctgctccatctcttggtttggagaagtggaacaccagcagaattcccctttcttcctctcccgggctgtgaggcttcggtccaccagcagcatctgcttggcactaactcagggctgggtactggggacaagggcaggcagcacaggctctctgctgtcaaagacctcttgcagtcgagggtgagggaagaagggcaaggatatgacaggcatgaggatcaacatctgtgtgagagggaggagggagtggttggttctgttgtggtgggggggcgggggtgcaagaattcatgcttttttattttatttatttacaactgtgattggacaagaagaattcattcatttttttttgtttgtttccccgagatggagtcttgctctgtcacccaggctggagtgcagtggcgcgatctcagctcactgcagcctccgccttctgggttcaagtgattctcctgcctcagcctcctgagtagctgggattacaggtgcatgccaccacacccagctaattttttgtatgtttagtagagatggggtttcaccatgttggccaggcttgtctcaaactcctgaccttgtgatcctcccgcctcggcctcccaaggtgctgggattgcaggtgtgagctaccgcgcctggccaaattcattcttaaaaacatttttttttttaatgagcgtgtagttgagtgccaggcactgttctaggtgctgagcaacccgaagagaagatgacagaaaaggctcttgccccctcctagctgaggttctagagtgagctatctgcattcaaattgattcccattaaataaaattaagaattgagtctcttggtcataccggtcacattgtaagtatgcaagtagctacacatggctagtgacttgttttggacagcacagatttagaacatctccatcgtctcaggaagttctgttgggcagccccgtttcagagggaggagcgacaggctacaagaactgacaggtcagcccgcgcttggcttctcaggagaactgaggcatcgattgtgggcggcacgcctgtcttcccagccatctggggtcccagcttgttgacagtttgcttcccatggtgtgcgatggcccagtgtgaccatgaaagctggctgctgctcatggggcagcagggggtgtctcaccccattcttgcaaagtctctaccaaaactgcggtgagcagcagaaagtggtcagcttggaaacaaggatttccaaggctccttctgctttgaggtgatcaggagtgtaattcctgcctggagactctttggggacaccaagcacagcaactcttcccctacataccgtttgtgaaccagcctctgagaaagctgcctgcgggtggctggtggaagaggccgcccagcttattctggttccatactccatgatctactgacgtaggtgcctggtggagcatcacttaccaagaagaaagatgtctgcgtgcagaattctttaaaactggggtttggaagatgatgagcatactttttttttccttaacatgcattccacatcacaatgatgtggtcaggaggggatgcggaaaaggcattgtgggtctctgacagtggaaacagcgaggcgtttagaccaagagtgtgaaggactttttctgaattccatgttgtcttctctgtcttttcattcctctctcacctttttaattctgctactttctctgaacactcggccctctgaaccccacctgcaggaattaatgagtagatctttcccttataaccccctttccagttctcagtgtgattaaatgctttcctgatgtggcaaaatacatttcaagaaatacagcaagtcttttgggctgcaaaaagactggttctcattacttagcagtcttcatatgtgtgcatagctcttggatgttggaaaagctatcctgtgttcacgtggagaacctgattgctcaggttttctaatgtaatcagcatttccctgtggagctgtatctcttgcccgcctctgtaactgacagctctcttcttaacgcttactatgtaagaaggtcttaaagtttatgtagagcctccagcaaatcagggaggagagaggggcatctgttgaactataaggtggtgaacacatggccaggcgcggtggctcacacctataatcccagcactttgggaggctgaggcagggagattacttgaggccaggagtttgagaccagcctggccgacacggccaaactccgcctctactaaaaatacaaaaattagctgggcctggtggcttgcacctgcaattccagctactcaggaggctgaggcacgagaatcgcctgaacccaggaggcggaggttgtggtgagccaagatcacgccactgcactccagcctgggcgacagagctagactctgtcttaaaaaaaaaaaaaaaagaaagaaaaaaaaataggtggtgaacacaaaactgagaaagcgggtaagaaagaactagcatttgttgaacactgacagtctggcaagctctgggctgggcgcttgatctgcttgtctcatttctcatgacgaccctgtgtgcggagcaagtagcagccgcattttacgcaggagaaaagtgaggctcagggagttgggacacttgctgagcattcacagccagtgagaggtggagcacgggcgtgtgccccagtctgcccgcatcagagcccttgttctccaaacctccagaaagccctgtttgttgccaggacccagaaaaatctttgctggagttagcggctttgcctccgagatttcagatagccagggctcaggctccctgctcgctggccgtgtcttcatggaacgattcatggtatatacttttccttccttccctccaggtcaccatggagtaacaagtatgaccctcccttggaggatggggccatgccgtcagctcggctgagaaagctggaggtggaagccaacaatgcctttgaccagtatcgagacctgtgagtcattttctcctgttgcactttagcgcttgtgagttttgagaggtaaatcctaagtggcagtgttctatctggaatctgttacctggccaagcattctcccttgaatctgttacccggccaagcattctcccttgaatctgttacctggctcacctaactaaaattgggagcctcccatagcaggatgcagggcactcgtttggtggttgggttggttatgagatgactcggtcatagaatgctaccagacttcactatgtgctgttcccctgcatcgtgattcataataacagcaggtgccactggtacagtgcctactgtgtataagaaacagtgccaggtatttctacatagcatctcaaatcctcacaaacatagctagtttagtcctcgtttctcagattaagaaattaagacacagattaaagtatttgtccacagcaaggggtagagccaggaattaaagtcagacctgtttatctccaaaggcccgtatggatttttttgccataccacacgctcacttctgacctggagctcaggggcctctgcctccagctgctctcaggccaagataagtgcagtccttacagagcaggagcagagcagcaaacatcttcctgaatcctgagttgtttgtggcctcggcaccttccttaaaaagcgttttgctagatctgttgagatttcttcctgctccgtctaatcctgcctcccagcaccacagcaccaacatgtcacttaattgttcaggcttacaaggaagggctccagagaaagttagccataatcaacagaatctcatttataattaagctctatactgaaaatacagcaaaactgtaaaataggcaatactaattcaagttggcagacttttttctgtcaagaaccagatcctaaacgttttaggctttgcaggccacataaggtctctgttgctgcttcttggtttgttttctgttgaacctttaaaatgtaaaattcacctcttgagctttgaggtgggtggggcttggcccccagtctgtagttctattatatacgaatattttatatacattatctttactccttaacaagaacctctggggaagatggttttgttcctccttttacaaatgagaccaaggttccaagaggttaaatgactcacacaagaccacaggacatggaggtgaaaagctaggatttgaacccatatttatctgaaattcccacaaattgttgattttcacagttaaaataggcttcagtcttttaaaggttcttacatctagaactttgtcctattgtagaatagttccttccccagtgatactgaaaagctgactcattgctctatggtagtttacttgtaattgttttttactatcttcttttacctgcccatttggtaagaagccaatccagctattaaacaagaatgcccaagtagaattggtttaatattaaagtgataatactggtaataaaataacgatggtgatgataacagttaccagtggccatgcaagtgggcctccaggtattctctgtctcattcggtcttcacaagaacccatgagagagggttatccccctcttacaaacgagctgacagatcagaaaggtgatataacttacccaggttcacagagctagtaagtggtggaactgggatatcaaaccatccttacccagctccagagtccaacatcgatttatttactcagcagacatttgagtgcctcccatgagccgggtgcttgctgagtaccagggatgcacctcgtacgtggtagatgaggcccctgccctcaccacactccattgtggaaaaacaaacagtggaccagtgaacaagtcattgctgctagtgataacagggagcagctgacttgttatgtagagtggcccatgaggcctcttgaggagacacttgactgaggtctgacattgaggaagccagccaggcaggggggctggttgtgccagggtctctgaggcaggggcaaactcacctgtctaaggccctgagactggtgccccttaatgtgcacacacagctgtcaaccagcaagtgcacaccctcagcctcttttaaattggaagtcaatttgaaagagatttgggcaaaattggccccttttatatgtaagcttcttgggagccatctcaggatactccaggaatacagcctgccctttcagctaagtttgaaggtggaagtggaaagttcccccttgaaagtgtttgctagattttcccccagcttggggagctaacgtgccatgcgtgtcatcccctaagcctgaggaagttgcctggcctcaccccttctgttctatgaggaggctgtactctggcttattactgggctgcatgttgagatatggaggtgggggtgattctgattctttatgagacttaagtgttcatgttgttactcccttaataaagtgaatcagatgtgttgccttacttcgccatttagggccagccttggggaagagcccagtttcatcttggacttctgcttcccttgttctcccttcccatctcatcgttcacatatgtaatgatacatggtgtatggttctgcaggggcttttatggcctgttatcatgagaatttccctactatcattaaaactcttcagaataatcactgaatccttacagtgactataggacaagtgggagttattccatttggcagctgatgaagctgaggctcagataagtactcaagctggttaacacagctagaaaaccacaggagccgggagtcatagctaaggcctcactcttcacgctgcctctggtgaagcctttcccttccctgggaaatgtgtatttgtaaggtggcttttgatttctgtgtgcctttgacttgcctacacactcctctctgaaggtaaactgactcgggggagttgaaagaggggtgacgacagcatcctgcccccagttgggggtcgaactggataacccagaccccgagggtctgcaacagtgtgtagtgggatccaggctggtgccgttctgttcccagcacctcgggaggaaggaggagagtggccccgcaggagaggcaggaggcccttccttaccttgcatgtgcaggggcagtggggccaggctcttcctgggtgacagggaccgcagaccaccaaagggacagcagttggagctgccatccgggataccagaggcatgaattttgactcacccagtgccatcggagtgtgctgaagagctctctctcctgggaccacatgcgaggaacgttttcccagctgaaccacatgtgacgaaccaacccatttatagtctaaaaattatgagaacaagtctcttttttttcttttttaaaaacatcttggtacattgtggtacattgctcatctccagaagttcccattcccagagtgccccgcgaggctgttggtggccacataagtgaccacagcaggccctggaatgcaagctcttttccccgtggctttggagcagaggggagtcagctgggtggccttgtctcctgaggggcattggccagggtcacactcggttttctagggaccaggctgttccatggggtggagaggcagtaggccatccctttctcttcatcttttatctagcccttccccatacaaacactttctcacagaaagacttgtttgttgtcccctgagcaaggccacagctctcccacctatcttctgttcaggttggcagatgggttcaggcaagggtcattctgagaggagacctccacccaatgctcccgtctgctggcttggtcaccctgagctgctgcctgaggggccaggaaagtggctggtgtccccggcctgtgagagatggccagagcctcagccagacccaccctgccaggagaaaaggggagtggccggagaagccaccccttgagagcaggctgggctcgcccttgtgcccaggagggctgcacaggtgcagctgccactttcagaccacacacttcaagctagagcttggcctgcgcccctggtggttgggggttggaagagcagactgtgttgacagggtctttaattcacgattccaggtgcttctgaattgttggatcctgatgaatcgcaatcaggactatgtttggcttgagctccagcctcatgaccaccaaccccatcgaatgactgagagctgccaggctcctgccacgttggagctcagaatcctcccgtggggacactgtgctgcagccagcctccagggagccgcttgttttatggcctaaaaagtctctttatgctgagaaggtcacactggactttgctcacacagagatttgacccaagaaaaggaataaagaggccttggataccctgtcttgcccctgttcctgcccccgccgtaccctgctggctcatgccagaagactggacttgctgtctgtgggcatgtttgttgtcggctgacgtagcacccacaggcactggccgtgtgtgtgccacagtcaggaacgaggtgcctgccccccacccattaacccattagctttgtccttactccttgaggccctgcttgaaaagattaatggtgctttgggaggctgaggcaggaggattgcttgaggccgggagctcgagaccagcctgggcgacatagcaagaccctgtacctccaaaaaataaaatataaacattagtcaggcatagaggcacacacacacataggcctagctactcagctgaggtaggaggattgcttgagcccaggagttcaaggttacagtgagctatagtcatgccatcatacactcagcctgggtgacagagtgagtccttgtctctggaaaaaaaaaaaagaaaactaaaaaataaaaaatatgtgaaaggagacattggtaaagagataggcttgagggtccagagacctagagcatgatccaggcagcccacgggccacaccagcctcctcagatagcagaacttaccgtctccccagaggctccctctgccaccggagagaaaaatcttcttcactggatcctgagggaaagacgtagattctgtcttcaggctctgggctttgatccctggctctgtaaaggctctgactttgtagggagttggatttaatcataagcacatggaatcaatgtcagaatgatggagctgggccaggggacgggttgaccagcaggcctttctggcttgtaactccttggagatgtggcagcccctctcccctgtggattgaaagggctagcagttgggagcgtgactccttaaggtgggcaaaaggcgagtaggggtgcagggggctgagccgtgtgtcctcacggctccctctgaagtccactagctcctggcttgccctgcctctgctgggtccctgcggcattctcacgtccaggtcccttccatgctgatgattcccttctctgccatcctcaggggcagaaagagatcatagtagtactttccctaggagagtaactgtcactacccaaacagccttgtttttagatgaaaagagccagtttgcgcaaatgcttaggagatgacaagcacattttgctggtgtgctggggccaggtgagggtattatctgctcgcaagtcaccttcattttcatcacttcccctcccagccagcccacccacctggtccccaacatctaggctattctctctaccaagccccaagatggttttctgcctgtaattgatgggcctgactcatccaggggatgtcacgagaactgagcactgaggcagaggggaagacagccgagcgggccgactcctgggcagctggctcggaggatcatttgacactctttctcagcagagccgactctgctttcttaggtccaagcctaggctagctcatcagtcacaaaacctcatcttttgacctaagtgatctttcttgggagagacttagaagtggagactttgctgtaggtcaggcaccagcagctgtcagaggaacatcttgctggtgtgagcgaccagtgggctgccatgaaccccaagattaacactttgatttttcaggttcctggagaagataggaaaccttccctgctcgagctttcacatcaagtctggccctggcctgtgtcggccccgggttctgcctgggaccagatgttctgaccaaagggctggcactgccttcttccaaagatgattactcccatctgcgccagacatctcgcccaatgctctgaagtccttggctcttggcttggagcagataataccttcaaacatgcggttgcaatttattggccttataagttaattttagtgggtgtgcaattgattgaaatcaaagcctaatgaaggccagagtctggggagtggaggagcagggtgggagggtattttgtgttcttccttgcttcagttctgagataatcttcaaaagctttaattagcttttccaatcagccctccttgtctggaagaagtttatagagtgaaacaaggctggcgtcctcatggcagtcccagggcccaagggcctctccaggagtggagcagccaggagctgggtggatgggccccaccccccggcctgggctccccagcacctgtcccctctctgggccatttcagaactgcagttgttcctgctccttcccgccatttgatgtttgaggaacattggcccaggaagggcaggatgtccatgttcacatgtgagaaatgtttgcacctgatttccggggtccttgaaactgcaggttcccagccccagacccctcagggcaccccttcctcgggacgtgagtgtggaggaactgcaggcggtagggggagattttccagggaaagagtgcagaagtgtgagcgggcagctgaggtgctggggggcttcccaggcagaaggcaccaccacctcccaccaaaagcctctgaccctcacccatggcgtctgaggcccagccacggaatggagaggaccttggctttaaagagctttggactggattctctctttgtcttttcttgctgactgactgggcgagtgagttaacctctctgagcctccgtttccttacccatgctgtgggctgaggcgtcactcagtgacacactgtgcgtcagacccctgctgcactcacgccttgcgtccagccagcaccttccaggctgctgggtgacagggctcttctaattgtgcagcaggtatctgtacgtgcatcttacattctgtacctgcatcttacattctgtgcgtttatgatcacagatacgggaccatttgggtggcggacctgatggggtagcaggcttcgtgatcatgcgagaaggccgtagtttcgggatggggctcttccaccacctcccacagcaaggcctccaggaaatctctgtctcaaaaatggaattaatgattcctgctcaatccacatcatcagggtgtagtgaggctgaacagagatgctggtagtgcccgtctgcagtgactggagagagaatccttgggatcggtcaccaggtccttaatgagaacctgccggggatggtgtcatgtgcccagggtcagtggcaaatgtgtcaggcccagtccctccctcatggggcccatgtttcaacacaggaacaagtcagcagatgaacacagtacttgcacagtttgataaacgctgcaaaggaatgagagctgggtcctgcggtggggaagagcaaagggtgtggatgttagggaaggctctgaggaaggaactgtgggtcggttacaggggggttgcccttgagtggaaagggctaacagagctggcctgagactgctgtccctcggaggcatgcttgccagcttggcccgcggctggcagctgggaacttgggtttcaggagggctcttaccactccctgataagagtgacttccgacgtctgaactgtgtgcaaacagtgtggccttccttctcctttccttgtgggcatctgaaatttcaccatgtgctaggtagagggtgcttagtagtacagccctgggcactgagtccctggcttgcttcaccagtagacagtacttcacacatgccgtcaagcccatccctgggggagtgtatcacgtcctgtgtgacgtcatggagcaggacgttgaaagctggtgcctggtttctcaggaccccagccccagcgccttctccctcagcctcctttgctctgttcccttcaataacccttggccccgagggcaactttgtgccacattccgtgagtccttgtagcgaattatggagcctcgggtggtctggggatcccgggcacagccctgtactgtgatgggagaggacaaggacagtgccctgagcagtgggaaccgcctgggccacgccctgaagggattcccagtggtcgtgagcagtgagtggaggccggaacaggacagggcagtggggagaggcgcacaggcctgtggggtgcgggctctgggtgtcattctgggagccttgggaaaggtctggaaggttccaagggtaggacagctctgatgtgcatccaaagaagttcctcggaagtagtgtggaggctggattggagaggccaggagcaggaagggcctgacagctcagctagagtggagggctgcttcctttgctctggctgagtgaactctgcagttccaggtgccccgggggctttttccaccgctggaaacggccaggcctgcggactcagagccccactgggaggtgggcagagtaaggggagtaacggagaatgcttaagaacatcctggagctgcagggacggtttggttggggacatcccccttcactccctgtcccttcagcgaggtctgtgttctcatttccttgcctagaggtaggacctttccccagatgtaaaggcctccagagggatcccgtgacgggcaccgcttgccactcatcttgcactcgggacagcagggtggagccaggccgtctctggcttctggcatgtccacagtgtaattagcacttgggtttgaacatgtttgtgtcttcagccatgtgcgcacagggcctctgagaacccgccctgcctgctgtgggacaccggcttgccactgcctggggcttgtgagaaagtgccagaagcacttaatggggaaacccaagcccacctctattgtgttgttttcacagagcagagagaaaggtctggagaaacctcacagctttggaggggtacagctgagcctgcttcctgctctcgcagtgcgtttcagctctttcgtgaccactgctcctagtgggggtgtctgctacagttatcaagtccctaaagagtggatctagacaggcttgcatgttgccccctgtcctggggtcccctttcatctggcatcccaaggctgcaggccagtgtctggttgcttggcatgtgcagtctgattttcatctgctgaaagaaagttaaatggaaaacaggagtgtgcagaaaacaagtttgcttatgaacatgatccccacgtcagcatcagggactctgatgcctctagaattcttgggttcctctaaccagatggcacacagtcactctttggtttgggccgttgcacatgttggagtgaaactctgctgctggaagcagggaccagctccctcccttggtcaagctcccccatcctgccagagaccctgcactcccctcactgagatgtttccgaggcttctgtgatggaaaactgctttgtgcaagtatcaagaataggtgcggtggggcacagtggctcacacctgtaatctcagtgtctgggggctgaggtgggagcatcacttgagcccagaaggtggaggctgcagtgaactatggtcccaccaccacacttctgcctgggtgacagagagagaccccatgtctaattaaaaaaaaaaaaaaaaaggcattcttgcagtgacccagccagcagccccagctgcctcagtgaggcagagaaccctccaaaatccccagtacagggtgctcggggcatgtcccggattcctggtcacccagcgggttccttttttaactcggactctctccaccgttttttttttttttttttccaagaaaaaaaatggagacgggggctctcactctgttgcccaggctggtctcaaactcctggcctcaagtgatcctcccatcttggcctcccaaagtgctggggattacaggcatgagccactgcacttggcctgactttctcctctttggggcagctgtgtgttcagtggtgtggctttatacgggcatctaacctactggctgaccctgttctgtccgcctgcgctccatcccaccacagctggcacgtctcaggatggccaggcagcctggcatggggcagaatatgggcactggggccagccaagcctgacatctactcccagatccctgcttctcagcctgtgacttgggcacgttccttatctctctgggttacagttttcttaactgtaaaaaaaagatatgcaaagcccctgacacagaatgagttctcaacaatggcagctttggatgagagtgatgacttggaagcccagaaagccctgactgttgacggctcatgaggtagctccatggggccagcagtgttttcacaagtagtccagagggcagaagacagtcgcagtggtgccaagtgtggacagtttggccagatcccaaaaccagatcccagagccagatagccggcccctgcagcggcaccattgtttccagagaggccttcattatttctttaagtaaaaaaataaaagcctcgtaaaagcgagacactaaagcgcggcagccacagtccagatgtgccttctaagtgcagctggcattaaagtcgcacatgcctaagctgattggtatgttgactcgggggattgttgcacctgtgtgtactggaaggaatttccgctgaatacctgtcccgtgtccatgggcagcctctgggccgtgttccctaaaccatggtgaaaacagctggtctcaacacacaaacaagggtggttgagtttcagcatcagctctggacatggcccgcccaaagccaagcattgatctttctccattttgtgtggagcctgtgccagtgggtacggaaccgctcccagtaagcggcactttgtgtttctgacggacacttccagggcagctcacaacacgtcgaggttgccttctcctcccctctgttcagaaagtaagagcctgatgaaaaccagcagccaccacttgttgagtgcttgctctgccaggtgccatggcaagtgcttgcccgttcatttttttcttgtgatcttccttatatctcctcatgcttgtttgccagatgcatcttgagtgcaggctggtataaccagtgtaaggaagagaacccacactctccagcccctcgtgtgccgtctgcagctctctggactttgcaacattgtgcccactgggcagcacccacgcccatccattggacaggggatgcgctcagcttctttttgaagttggctagatggcagccagcagagcaaaaaggaacgttggtctacaccacgaggaagggagccaggttttggatgcccctctgagcagaatggacagttttctctttttcctgaggtggagttggattgttcccacctgtgaagaccaggtgcctgttttgttgtaaggatgttaaggatgatcagaaaaacaaactactgctgatagctggggattttagtttcttttttaccctaggagggaacaaaaaggcattgttttagggccagaacctcagctgccggggaatggctctgcctctgggttttattctcttcctctttgccataaaatcagtcatggagcttgggagtttctgtttgtttgttgttgttgtttcttttgagatggagtctcgctctttttgctcaggctggagtgcagtggcgccatctcaatgcactataacctctgcctcccgggttcaagcaattctcctgtctcagcctcctgagtaactgggattacaagcacctgccaccatgcctggctaatttttgtatttttagtagaaatgggattcaccatgctggccaggctggtttcgaactcctgacctcaggtgatctgccggcctcggcttcccaaagtgccgggattataggcatgagccaccgcacccggccaggagtttgtttgaactcatgcctgtatgaccttgtctttgtcatgaccaagcaccagtacagcaaaaagtgtccctcatgaccatttattttatatatatatatatatatatatatatatatatatatatatatatatatatatatatatatatattttaagacacggtctcactatgttgcccaggctggtcttgaactcctggagtcaagtgatccccccaccttggcctcccagagtgctgggattataggcgtgagccaccatgcctgacctaagaccacttatttgtcccaagtcttgctgctactccttggtgagatcccagaagcagaacacaccatacatgtgacgggagaacatagggtaggagaagaaagactctcgtggaatcttacatgttggagctgtttgagggcccaggttcctagcttagcaccagatcatagaggaattctgcttttttcagttacatcaacacttcaaattttttagcctgagctcttcagccggcattccagccagccccacctcctgtgttcccttctacttctgcctcatcaaggctgtgggcgtttccatcttttctttttctttttttttttttgagacggagtttcactcttgttactcaggctggagtgcaatggcatgatctcggctcaccgcaacctctgcctcccgggttcaagcgattctcctgcctcagcctcccaagtcgctgggattacaggcatgcaccaccacgcccgactaattttgtgtgtttttttaatagagacggggcttctccatgtgggtcaggctggtctcgaactcctgacctcaggtgatctgcccgtctcggcctccctaaatgctgggattacaggcgtgagccaccatgcccggcctggtttccatctttatactgactccaacatgaaaaaagtgcccagaccagagccctccttcctggtggaccatcagtttctccacagaagccttcactagggctgcccgtgctctttctggaaatccacgcgatctggaactcagtgacatcctcatttgcacagtctcctgctttcacgtatattcctgtgcataaagacttcgggggaagagtggcttggatagaatacagatcacaacagcttcgggatcccaaaagagacgttgaaatgttgaagccatgtctatgagagtgatctgtcacagatttgagtggaaagtgatattcttgggtccagtctaccaagttctcaagtccaggatgtgagaggtattttcatggcaacacataagaaaaaatattcagctgtacacggtgacttatgcctataatcccagcactttgggaggccgaggtgggaagattacttgagcccaggagttcaagacctgcctgagcatagcgagaccctgtctctacaaaaaaatttaaaattacccaggtgtggtggcatgcacctgtagtcccagctactcaggaggctgaggtgggaggatcagttgagcccagaatgtcgaggctgcaatgagccatggtcatgccattgcactccaacctgggcaagagaacgagaccctgtctcaaaaaaagagagaaaaaaaaaaagaaaaaatactccatttgagatgactgcaagttcagtatgtgtagcatggattaggtgtgattgctaatgaaagctaatttggtcttgagtgctggagggaggagtagcctgtttgccaagagatgtgctggtccctgctatgcattggttaacacttagttggggcattgttttctgttcttttatgaaggacattgacaagctggagtatgttcagaaggataaacaaggtattgagtcgtatgaggaattacaaggaggagaaggccagaaaagagaaatcttggtgtaagccagttttaaatgtttgaaaggactatgcaaggaaagggcatgaagtccttgtttttttgtgattctggaaggcagtagtgagaagtcttcactcaagtccagagagaactgtctcagttgttcagaacagaaatgtttgcctcaggaatgtaatgagttcactgtcactggaggtgtgtaagcagcagtttgacagagactaagatgttaggaacctgccctgtggtgctcagtctgcctcatacaggccctgatgcaaccaccaaatcctggaatgtcagagctgggaggaccctctacgctggcctctgatccagctctttgattttacaaataagaaaaaagtcttttgcactgtgttggtgccaaatattgcctttcccttggctttattcagtgaagttgactgcaagagaaagccctgttccagcacctatggagctcaccttaataatgcccctaacttggctgctgcctgtgcctcagcgtcacaggtatctcaggccagaggtccaagtcctgtgagtgtggcccagcccactaatagccagaaggacatgtctcagtgaaccctagaaccacagagtctgtttcttggctcatgctggaaagccctgctcccagcaggtctgtcctggccttggttcttgtggcatgtggcatgtactcattatctgttgggagcctttgtattcgagccacgaatccagctcttctcccaggaggtgatgtgaaaggaaggagtaaagagcagcttcaaagccccttcttcccctcccgttttccctgttagatttgcagccccgtgttggccaggcctgggaattgggtcattcatagttacagctcagattccccgagcacgtttccaccccacgcacacctcagcttcagacactccataaagcttttggagctgaaacattttcttttctttttacttttgtgaattaggtcattttgagtgtgaagtattatgtttttccttttttctccttccccccagaagtcctgtggttgaaaagttacggacatagaatctatatccgtgactatgacattattcaactggaagagtgattttcagggagaaacgacctaaaactctgagaagaagagaattactgacacattaggcttttagctgatccacgtttagggaccaaggtgacgatagacaaaaacccaaccagatgtttaattgtaattggctgtgctgataaacggcttgagaccagcctgggcaacatagcaagaccctgtctctaaaaaaaaaaaaaaaaaaaaaaaattttttttttaattagccatgcatggtggtgcatgcctgtggtcccagctgcttgggaggctggggaaggaggatcacttgaacccaggaagtcgaggctgcagtgagcggtgatcgcaccaccacactccagcctgggcatcaaagcaagaccctgtctcaaaaaacaaaacaagatgttaatctgtgttaggaaagtcttaaaaggcgccgggaccgttggtaaaactgatggcactcagttgaaagagttagctcttcagtggacgcaagcaaacaggtgactccagcactttgctcccagtcattcccaagttggtctgtcatttcaccccctcctcatcttcctggagcttctgaggcccccccacttcatggttcaacacttgtccaagttgacttctctgcagtctttgcaagctagtccctgtgttgtcctggccactggggagctctgatttgagcatgtcattcagcctcttgactgtggggattgatttcagccctgtgctgcccgtgctgtctggctttccatttaggaaagaagcctaggaaaagctcatgcatttctctttgggcctccacggttttttttttctttcttttttcttttttttatagaggctggcctcgaactcctgggctcaagcagtcctcccacctcagcctcccaaagtgctaggattacaggtgtgagccactgcgcctggtcctaggcctgcatgtttaaaagaggttcttgaccagacgtggtggctcacgcctgtaatcccaacactgagtggagaccgaggccaggagttagagaccagcctgggcaacatggtgagacccagtctctactaaaaatacaataattatccaggcatgttggcagacccctggaatcccagctacttgggaagctgaagcaggagaatcacttgaacccgggaagtggaggtcgcagtgagctgaggtcatgccactgcactccagcctgggcgacagagcgagactctgtctcaaaaaaataaaataaagcactccagcctgggcgacagagagactctgtctcaaaaaaaatataataaaaatttcccccttctacctccttgaccagagacctcactgcagggactctctgggattttcctcttgagcccaaatcagctgagctgtggtagtgagtcctgggcccattcctccctccctgcagagttgggagattttgaaattatcaggcatgggcaggggccagggcagggcggattaattcctctgcagcctgctctcagcgcttggccacatttgatcattcactcacatggaagtacaaggcctgagagtgagtcgctggcgatggtagagccaccttattgaaatagcatgttagcatttaaacaatattaatactatttgactcattaaatatacaaagaccagttaaactgcttccatgtatgtgctgttaattctggcgggcgactcctcagatggctttatgtggtttcagacaacgttttagcacattcttaaaatacccacaaaagcctttatgtaaaaactcataaatgcaaaccacataaaaattattttttccttgtttcatgtcattatgatcaaagtacagtaggtaagaaataaattttcaaaaacgtgttgtggtccccctttaattaatgcttcacgcgcagagcaaagccataaaccatgtagcgggggcgctgtctgtgcgccctgcagtcacctccctcctgaaggtgccggagcgccctgatggcactcgcaggagaggctggtgcttctgggcaattctgaaacaggcctttctaaccatgcagtcctctgctccctttgtctcggaatgtcaggttgagacttgtggctgctccagtccctggagatcccttttggtgaatggaatgcaagtccattcttgaattattgtagtgtttgagctgtacctgcagaggccaggtctcagcacgtctgactcacctcagttggaacaccccgattcagagagggaacagattcaaagtgagagattgaccacgccgcctctaactctgtcgccgttgtttctttattaaaagtcagattgatggtaaattaggatactacccgactgaatactatccttgctgttaaaaatgattatggagatcatgcggctccatggaaaaatgctaatgattctgtgccaagtgtaaaaagccaaattcagcatggtactcttgctgtgcttacagttatataaaagtcatgcatctggactggaagggaatttggaaaaatcagatttatgggataagttgatttatggcattgtgggctaattttcagatttccttttttaaaaaacaataatgttcctgcagtaagttttaaaattgtgggtaaaagaatagtaaccccacaaggagtgacaattgagcttgcatttttacctcccctggctccagcatttgaaactttagacctggtcaccgtggcccgccaaggagaagctgcccgtagtgggagccaggccacagggtgggacattggagtggaaacggccagttccaccctataaaactttaatgcggttgttttatttttctggaagaaatgaaacgctcagggatgggactgaggggaagcagccgtgggccacctggtgcttttgaactggtcaccggagggtgtcgacaagggctgtcaggccatcgggatttctcctggttcccctccagggcatcctgacctgcatctccccagtgtcccagcacacagaggagagcaagccttgggcaggcacagcaccgcagctctgcatggatctgtgaaggagcggaaggatgaaatgcccctgggctgcaagccttctttccagaagggctgaaggaaagaacggattattggcccatcctttttgccagcaaagtagggtttttttgtttgtttttcttccccctcttttgatgtggggctgctctccctgtaagccgactgaaagggaaaacggtgtgctagaaccaagccatctgttgccaacaggaagggtattagcaggtctgttatgagttgctcttccgttggtagtattgatgtgcctcgtaagttaacttgcaagaatccaggagaacaagccagaaaggctcacggagcccatgctgccagtcatctgagccctgctaaccctcaggtccagcaggggcagtccatccctctccaggtgttccaggaacattgcagaatggcctgatctctccaactctgtgtgggcccggtccagaccaggagggctctatggaggcagatggggttttgggccctggaccaaaacactcatctgcttacctcgcctcgccccaagaatggggactttggagcagaccggaataaaggaaatgatcttctggagtgggatctctgagtgccagtgttggccggtttcctggacatcacctctgccagcagtgagctctgggcctcacaggtgtgtctgttcatccagtggtccttttcctctcgtaggaaaggatgcctgtgctgcacctggccagagccagacccttccccaccctgcgcagtttgaccagcgatgggctcagcatctgacacctgacacctccatccgacaggtgttccctgagtgacacttggttagccagacagccctgccctcatctgccctcctgtagactcacccgtggacacaccatggtgtactcggtttgagagcttaatcatagtgggtagtgctggagaggggaatgggacaggatgtggtcctgccgcaggggctggccgcagcctgcctgagggagccctgggcagggggccaagggtagcccacctgagtatcggccccctggatgctccgcaggtctgcgggttggagtgagggcagaccagccagggcaccctcattctcctgggaggatgccttgctttcttggtctggtggtctcttagttacattacactccggtgtattcgtgtactgatttttcacaaaagctttttagtttggaatggtatgacttactgtaaaattgcaaaaaaaaaaaaaaaaaaagagtacagagaattcttgtatacccatcacccacattctgtaaatgtgtattttttgttatataatagctttggtgagacataatctacagatacatgttaatttctagtacttaattttacattaaccgtttggcaggtgtctacttttcctaattgtttttgtctctcaacagccgtagaaagtagattaagtccctgaggcccatattcacaccgctggtcccttagtaaatagttgttggacgcatgcatgcatgagcataactcatagctgggcgtgctagagctgtcattgggtctgtctgactcccaagcctgtacccacccagtgcactctgcggcccaccttcccagctgtccagggctgagggcagggtgctcccagaatgcacctgccacaccgtggctttggggcttaataggtgtcagagaggccccagactttctgataaagatgtgctcaccacgagagatgagatttctctctttggggcttaattggggtcggagaggctacagactttcgccacaagaaatgagatttcgcatagtttttgttggttatcaacagcatttgtggttcccatcagctgactccacccctcgcctctgctcacggcagtcccagtgagccacagtagttgacctgggtctgttgggtttgggatcccaggctgattcccatttctcatctaaccttttcgttccctcttccatttgatcgtaattagaaatccctcttccatttgattataattagaaatgtttctgggccaggcgcagtggctcatgcctgtaatcccagcactttgggaggctgaggcgggtggatcacttgaggtcagggttttgagaccagcctggccaacatggcaaaaccccatctctactaaaaatacagaaattagccaagtgcagtggtgcacacctgtgatcccagctactcaggaggttgaggcaggagaatcgtttgaacctgggaggcggaggttgcagtgagccgagatggtgccactgcactccagcctgggagatggtgaggcttcatctcaaaaacagaaaaaaagaaaagatgtttttgcattgcgtcggatttgaggaggaagcactgtctcaagctgagcccttcatttccggctagcgctttgtaggaggttgctccaaaagaccaactggagccctggtctgccaggctcaggagggatcagggtgtagggagtttgttgctgtattttctcatctgccctgtaaaatatcccaaaagacagaaatatcgaacaaccgtggtgactccagtagtcatggcctgcatggattgtcactggatgtcagtcgtgctgcattctttatctgggaggagtgtgacgcccagagaggttcagtaagccaaagaccacacagatagaggaggtggcagagtccaacctcagattcatctttatgacgcctaaacctactacacccccaggaatgctgcaccccctcccccagccacagaacgatcagaacacacccaaggatcggctcccataactgtcgcagggagggccctgaatcccagaatctttgctgagcagcagcctgggacccaggctgatgatctgtcctttagcatctaacaggcacattggcctgtttcctgcaggtattttgaaggtggcgtctcatctgtctacctctgggatctggatcatggctttgctggagtgatcctcataaagaaggctggagatggatcaaagaagatcaaaggctgctgggattccatccacgtggtagaagtgcaggtactgcctcccagcagctggtggcccgggccactaagtacagatggcacaccaaccagtgccgcgctgctctctaacagatgcagtagggggatgctgtgatctctgaacccctaattctgagaaatgcctcaaagccatttggataaagataagtcaagattgcagtagtcattgatgattaagttcccagaagaaatacataattacaaatgtccctttaaaaaccagttgagattttttaagaaagacaatattgtgaggccaggtacggtggctcgggcctgtaatcccagcagtttgggaggctgaggtgggcagatcaccggaggtcaggagttcaagaccagcctggccaatatggcgaaaccgcatctctagcaaaaacacaaaaaacattagccaggcgtggtggcgggcgcccataatcccagctacttgggaggctgaggcaggagaatcgcttgaacctgggaggtggaggctgcagtgacttgagatcgcaccactgcactccagcctgggtgacagagcgagactttgtctccaatttaaaaaaaaaaaaggtaatattgtgataatgacctaggaagggagatgttaggatgaccctgaattcaaggggccacttcaggctctccctcagctcaacagatctctgtcttgtccttccaggagaaatccagcggtcgcaccgcccattacaagttgacctccacggtgatgctgtggctgcagaccaacaaatctggctctggcaccatgaacctcggaggcagccttaccagacaggtagagttacccgctcatagccacttgccagtgcccacaggtgctggcctcagtgctgacctgcagagatgagtgagcaggtgccccatttagggtaagcatgttcagccagctataaatccaccatctaagtagggctttgcattttcaaataaaagctctctgggctgtgcaaggttgcccacagctgctggcactctgctggcctcctgctgagggaggccgggtgctggctgtggctcctccttacccctcagggccccgcacatccccatgcttcagctcatgttgtgctgtgagaagtggtgcttggccctgtgccctgtttgccgtctctgtggccatgcccagcccatcagtcaggccagctctctgggagcagcttacctgagctcagagtgtctgcaccttgctgccctcagagtagtccaaggaccagcatcagcatcaccaaagagcttgtcagaaaggcagaaatatcaggtcccacccagacctagcatatcaggatctctgttttcacaaaattgcccaggtaatgtgtgcacattgaaatttcagaagtgccctactggatacctctctcttatccatcttttgtttgggtatcactagcaacccttctccacgatgttgttcccaggttctgtctaaggcaaacttggacttggactggaaggtactgcctcccctgagcaaacttgcctgcccttctaccttagatgctcccataagcatctgggtgggtttaagaaccttgtataaaggtccatgttcaggaccctttacattcccatcccaagagaaggccttaaacctgtgccagtgcagtgccacaagatgcttggcgtaaagggggaagagaaagcatagaccaagcacaactgggtttcacaaggacccctctttgccttcggagaagtcggtattggcagaaacggcacagccttgagagcctcagcggggcgccactttctgcaaggatgcccttccgttctcggttccagcagtccctgactgtccactgtgagaattccttttaacatcagagatctctttcggtaagataattatgctctcaatagctgtggatagaaaaaatatgaccgaaaggatcgatgcagtaaaattttttttttttttttttgagacggagtctcgctctgtcacccaagctggagtacagtggtgtgatctcggttcactgcaatctctgcctcccgggttcgagcgattctcctgcctcagcctcccgagtagctgggattacaagcgtgcaccaccacgcccagctcattttttgtatttttagtagagatgggatttcaccatgttggccaggctggtcttgaactcctgacctcaagtgatccgcccacctcggtctcccaaagtgttgggattacaggcataagccaccacacccggcccagtgtagtaaatcttttaagtgaatttgcattctactagttacaacaacatctacattcattgaaaaaatagtggcgcaaggtgaatgtcagccgtcatacctgggaccctccctccacctatagaagctccactgcctctcctgtgtcagaggggctggaggccagaagggatgttgcggtcctctttttggcctctgggcagggatgtcacagtcccatcccaggactactcactagtgcacacggggggcacttagcctttttgcgtggaagtggactcctatcttccaggggccattggctagggagaaacagccaaacccccaggcagccagctcccctgcagcctgactctcccacatcctgccacctggggagtgggtggaaaatcctgaatctgtatccagagactgcttcctgtatcacttaccactccaggctgttgataattccacccggtttacagtgacctggacaaatatttaatcctcagccctcctaatagtttaaatcagagctgtcagcccatggccagagtctggttccggcttgccgtgagcagtgtctcctgccaagctaaacccaggcctgatgagtgcctgtcctcagcacaccttggccagggcttcggactttgtttgcgttgccttttgctctgggggctttaatgaggaaattaatgctctgccatcattctaacggccgatcaccacatcattcatttgaggtgcattaaagctggggctgggttccaatgtaagtaactacagaagggggagggattgcaatgaggtagacaaatctaagttaatgatgcacagcttctgagcaaacaggggaagtgagggttgcagagcttggctacgggtcccagaggagccttggaaaaacgcctgtgcttgtttggatgggaggcgaagggttctgggagaagtgagcagctcagtgagcatgaacatgcatggtttgcaggctgtccccttggattagattgtaaccaaggtcaagttattctcatttaacaggtgaggaaactgaagttcaaacttaaataatttgcccatataatttaaccagtaagaagcaaagctgggatgtgaacccagatttgcctggtgagaaaaaaatatgctactttctaccacgccacaactgttttggtcttaattcgtcctctgtgcctgccattcggtgactgctaaatagtcagatggaagtgcatggagcagtcagctcagtgtagacaggactctgtctcagcagccggcatgagcagctgcagtggacctgtagcctcaggagcaagcaggccccgcaagcaggatcaaccctgcagagccgcacacggcgtcaaggctccccaggtgtgtgctgagcagcgctgccctctgggcccctcccgcaggtgtgcctttgtctttcaggatgatctcctgctggaagccacttggccactggggtgtgttcactactagaggctgtcaggagggctttgaggtttctagggagtccaatgatctgattggatctgtgttttcagaaggtggctctgccagtgggcttgggggatgggtggtcagggggaagctgttacagtcatcaaggagagagatgacaagggcctggatcaggcagccctgggagggtcagaggggacagccctgcagcagagaggtcagtgaagaagctagtgtcagtctgaggcatgaggtggcaagggcagaaacagaagggcaggggaagaggggcaggctggggggcattctggcgtggcgtggtcaggggctggacgaccaagatgtgaggtgggggtcagatgagagcccctccctcgagttcctccttacacagtccttacagcaacctgggcctgggtttttcctctggaaacctggcctcatccaggtcacccacgctcacatgcccttgccccacgtgtgtcaggaaggaaggctgcttggttttggagctgtctccccaggcccacagtgccaggccctagccccaagagccatcccagccagcatcagcaccctcagcaaggccccatgggtcctcagctttcccagggtcctgtggcccagcctgcctcaccccggcagcagcggcagctgcccttccctgtgtgtggccccgggcgcacccttgtcttcctgtttcccacggcccatctggagaaggccgccagctttggcttgctggcacctcgcaggggtcccttccgtgggcacatcaggctatgccctgtgcccactcgtgccccagtgtaggcggctggtggtaggccagtggccggggcagagcgccactctcctgggcacgtggcctgccagccagccagaacacagccagaccaggcgatgctgcctccacctagccctgcctccatcattttcggcttttacttctcccacctccaaccaccaaaagatgtttctcagggacgtcaactggaagacaaggtaaacagctaaagtattctggcaaattcccgcagcagtgaggctgtcggagtgaaggtgagccgcaggccggccggatcataccttcctgcccaggcttgtggatgtgtgtgaggaaaggcgggcagaaggtaccctctggtacactgccacgtggccccccatgggagggttgtagagcaagcgaaaaaaggttgcaagccccaagttccaaaatgttgaaaaggaagttgtactgagaggtcacttctcctatgtgacagcagagacgtgggaaagaggcgagattgtaaatctctggaaagagatccaaggtttcccatccggggaagggccctgcagatgttcgtttgatattttctcagcttctaaatatttagaaatgaaggtggaatgttttgttgagtggggagatcaggcaggtcattggctagtgagcagtctctccccactcagcagagacacccccaatatatcttcaggcagtaaatccccagtagaggcacttgcctgtgtatcctagcaggaacatcctctttgacttgcgtttggcagttaggccaggcagtatatttttgtcacagggaagaagcccattgcccttccagatgcagggaacagagggtgggccgggcccagcttggcagttccaggagtgcacgctcgctggggaggcctggctgcagctgcacacccgctcctcgtgtcctgtggggttgcctgggttcaggggtggagatgcttgagcagcgcagcttcaaggggcggctgggtttttgccagatgacctggggtggagtgaccagtgcctggctgagaaggaaagctggcctgagacaggctccccacaaccatcccgtgctgtgaagggcggaaacaggagacgaagggaccggagatccctggcaggaggcggctgaggcagggatggaccctgctcaggttttctgagccctggattgtggtttgtccttcagttttctggtaaaggatgtatgtgaaattgagccagcagagagatctcataaaaggaagcaggtttcagaatcacccagaccttgattcagatcctagctcaggaactttccagctgtgtgacctagacagacctccacctctttgaaactcagtgttgataatgcccattttgaaagataatagttccagcactttgagaggctgaggcaagaagattgtttggccaggggttcaagaccaacctgggcaacagttgcactgccccctaccccttcacccctcccaacaaaacaaaaagttatctgggtagggtggcatctgtggtcctagcttcttgggagtctgagatgggaggatcacttgagcccaggagtttgaggttatagtgagctatgattgcaccattgcattccagcctgggcagcagagcaagaccctgtctctaaaaaacataataaacaaattttattaaaaaaaaaaaatggaaagatcgggtgcagtggctcatgcctgtaatcccagcactttgggaggccaaggcaggtggatcacgaggtcaggagttcgagatcagcctgaccaacacggtgaaaccccatctgtactaaaaatacaaaaattagctgggtgtggtggcatgcacctgtaatctcagctactcaggaggctgaggcaggagaatcacttgaacccgggaggcagaggttgcagtgagccaagatcgcgccattgcactccagcctgggcgacagagcaagactccatctcaaaaaaaaaaaaaggaaagatcattgtagagtagaaacaaaaaactgttttacacacagttttatgctcaataaataataacttttgccaggcgcgatggctcatgcctgtaatcccaacactgggaggccaaggcaggcagatcacttgagctcgagagtttgagaccagcctgggcaacaaagtaagaccccatctctctacaaaaaatacaaaaattagccaggtgaggcagcagtgtgcctgtagtcccagctattcaggaggctgaggtgggaggatggcctgaacctgggaggccgaggttgcagtgagccgtggtgacaacactgtgctccagcctgggcaacacagccagaccctgtctcaaaaataaaaataaaaacaataacttttactgctactaccatatatcttgcaaggagaggctttttgaatatgtacaattctagattcaaaattttcctaaactgggcaaccgtaactttccctgggaagccgtctgaccaccatcttctggcctggctgcacgccgggtcctgacctccaacccacagcacagtgtggtgaccaggaggatgccagaggccagaagagtgctggggatggagctgtgctttgacaatcggtgagagctgccattctggcaagtcccgctctaggccttttgtgtacatttgtttatttagtgcgaggtgaaggcaaagacatggaggcctagacaagcccaggccctttcctctcgggctgcagcacaggagctgcggggcctcagcgccggtgagtggggcccatgccttagggccacgccctgcgggtcgcgctagaagatgccacgtggcagtgggaggtgtaatacatcccctctgggggaaaggctgccagcttccaaacacttgcctgtgttagggccatggggaggaggagaggcgcctgctggggacacacgggccaggctccggcttcagacgccattggaaccacctcgtggaacatctgcagccacaacacatgaaaatgttttccttccggcagccacttttataaggatgtaataatatatgcagtgcacaaatggttctgtttttggtgggttggtattgccaccgagccgaccctgaccaggtgtggaggggagtgagcaggggcgggcaagggggctgtggaaatacggccgggtgcaccgagccctgtgcccctcactccccaagcacctttctccttccctccccagccgctgcgtggccatttacgtgggctcagcttccctgccatgggctgagggggcctgtgttctaggggatcagtctgctcctggggacagtgtcgcacactgcaagacccagccctctcctccacccgacctctcctacctttgttggccaaggggtttcgcctgtttgttttaagatggctcttgattctgaaacacaaagatggtaaccaagaggccaaattgctgatgtgactggacttgcccaggtgacccaggacctttgccgatggccgcggcctctctttgggctgttggtgcccatttaaaatggggcccacagtgagctcaaaaccctcatcccttccctagggtggccgggaatctgccgtccacatggagccggggaggaggagagactctgatttgctggaaggacctcattcatttccatccaacccccaggcttccctgcctgccgagctgactccacccagccctgagcctaggcacagtaaccaccttcacgtctgggagaacacacagtccccgggggccagcatgcaaaagttctttttgaagctgggtggatggagccccctccctcctgagggtgctccccagctcctgttgagcagacagcccaccccgtcgtcttggcaccagggttttgctagtggcagataaagatgatgttccagcagacgctccagtgctgccgaggttggtgtgtttattagacctgaaatgagaactgtgactctcaagctcatgggcactctcactactcctgttttatggagaccccctggggtctgagggtcgagattcctcaggatgacttgccagagcatgccaagacagatgggagcagagaagccggtctttctagcatttctctccctcttttccactagtcctcagtaaaacagccttgccagaaccagatgtcttttttctgcagatatttactgttatgacttgggaggcagcaggttctggactgttgccctcacctagaccccccccccccttgtcagatgccacccgttttctcagacccgtcggtctcccagaccacattgctttgtgagcagatgcctgtcagggacagctctatcagaacagaccgagtccagcccagtgagccgtgatgttctctcactgctcggtcccccctctgccatctacagcgacataggttgggtctgttcccctggcagacagcaggccttcagagccctgccagaatctcttgtgtctcccctagcacacacacatccctccccacccaccaccgccaggcctggatagccctagttctctcccatttcttggtgtcagggtgttcagaccttttaagcagatgaatgctaactcattcaaggcttttaaaacccagtgccttagcagggtacagtggcacacacctgtagttacagctgtgtgggaggattgcaggagttcctgtctagcctgggcaacatagcaagacctccttgtcttttaaaagaaaattaaaaaaaaaaaagtgccctaaactgaatccagccctgcagatgtagctgggccaggacagaacagagggtaaccactgccttcccaagcaagcaatggaaactggcagctgcagtgtcttcatcacgcgatggggtgggaatgctgccccttatctgggcacaaggaatagtgtcatctgtgcaccttaaagttgcacaaaagctttcctagtagcgacatctcatccttgtcaaacttgaaattatctaaaaaccacaagtctcttcataggaactgtttgcaagtcagcagttccccattttgtactgcatgaaatgcacccttgagcctaaatatctggcttgcatttgccctggtacatttaactggcgtggtgaagtaggaggagcaaaggcgtcggaatctaacagtgctgtatgattcttgcttctttaagcttcggtttccttgggtttaaaacagggttcctaggaagctgagatggaaaaaggtggctgccgcctggctccattccaagttgctgctctcgttctgtagctagcccaggtttccgggttccgtattaaccctgtgaccatctcaacccttgacactgtcgataggaagctggtcgttctctcagctgggcctttacttaagtcctggacaaacaagttgaccaagggcaggcagagactgctacagggtgccacataatgtatgcagtgcacaaatggttctatttttggtgggtcggtgttgccagcgagctgaccctgaccaggtgtggaggggagtgggtggggggctgtggaaatgtggccaggtccctacccctatcggcagaggctccatcctgcccttcctctcagccacaggtgcaggatggtagatgggaacttgccagaaggatgcgaccctatttaagtagttgtgttttcttccagcccagcatccccaccaaaacaggaaaagaagtgctctcgtgcagggcttgttcacagtgagcctggctggctcctcatgatctctgagtttaaaatgtgccagcagatgattttaacgatcccatcaaaaattgttgtctggatcagtttcgagctagcgtttccttgcagaggccattcttccttttttgacaaaagttgggtcggccaggtgcagtggctcatacttgtaatcccagcacttcgggaggctgaggcaggtggatcacctgaggtcagaagttcaagaccagcctggccaacatggcaaaaccctgtctctactaaaaataaaaaataaaaataaaaataaaaaaaagccggacgtggtggtgggcacctgtaatcccagctactggggaggctgaggcaggagaatcacttgaacccaggaggcagaggttgcagtgagccaagattgcaccattgcactccagcctgggcgacaagagcgaaactccgtctcaaaaaaaaaaaaaaaaaaaaaagacaaaagtcgggtcagtgctgccgcccccagtgtcaaggatttcaatcacaggtcggttttgcccgaccctggaagcctggtcgtttaaagtggcttggttctctcctgccctctgctcaccccgctcttaaccaggttggttccacctttcacagcctgaaagtcagtctccctgatgaggagatgtagaaataggtgagaagcaacagagcccgtaccctctgagacagtatctccccccagactccaccctgttctcctggttccaaagagaggaacccaccttttgctggtttttcttctgtgggcctggtctcattttgaactctaccctttcttttttttttttttttttttttttttagcttctctcacaaattttattttattttaataaagcttcaaaaattataaataatgtctaagcagatttagaatctcaacaataaatgcttagccttagagtactgcatttttgtattataatttgatggccacttcttgcatggtttctactctaccctttctgatgctgttcttttcttcctctttcttgattatttatttcagcttccacattttatttcaacaacattagtcatcgtagctgcgtattcctgttttcagtgtagtaacgttgagcatttatgttcctagcactcttccaggtaccctgtgcgttatgaggcaggcacatctctcctgaaagaatttatattcttgtcagggaaataaggcttcagataagaaaaaattcgggggaaagtgccgaattccttctaccctaacctgcctccatttcctccctcctccgagttgagatgattgggtcagagccagctcttcctgggcttgggaagaggagatggggcttgagtgctgctgcccccctcataacctcagagtctatattgagactctcttgctcaaactctcctcgcagagtagaacgaacaggccctggtgcgaggaagggtttgacccaggctctgccattgccacctgcatgactagggtgagccactgaatccctctggcctgaagtctccgtcagaggttgtctgtccctccctgcgagactgcagcagatggcaccccaaagccaccatttgggagcgccagggcgcagcagcagcacagaagcttcccctgcagtgtcaggccctgaacctggggtggatggcccagcgtgggcctgggcctgccagtagaggcctgaagacaaaccgagtgagtcttctccagttggctcgggtgagctggtgcctgccaagggctgctgctgtggctctgggcatctgcctgctctaccatgggcagcagcaaaatcttctcccttggaagtgggactctgggcttctgccctctgggctctttatggtctgaaactgaagtcggtttgtgcttcagttcccaggctgcaaaactggccttgtcatacctgcagctggctccacggtgggaacagtaggctctttgcagaccgtggaggtggggtgggctgtctgccgttctcagaaatctctggctttctctgacttggaatgtttctgtcttttgcagatggagaaggatgaaactgtgagtgactgctccccacacatagccaacatcgggcgcctggtagaggtgagtgacctgggctctggctggctcctgcagtgacccacagcagtgacactgcagccccggagccgctgtgctggcctccttctctgctgctttctctcagctccaccgcagccggcagagcgcttcttggattttgccctggcctcatatttttggagcctctgatttggatgccagcaggctccagcttcagggccacctcctgctccacccccagacctgggctcccagaagactgctcaggcgctggctctggggcgcactaggtcttgtctcccctgatcgcctgggtgtgaacagggccctgcgctgggagaggaagcagatcccaggaatgccagtgggccctggtgtggcttcagttgcggctgccttggccctcctgtcaccacgttgtttgggaaggcagggaggtgctctcgggtttcacagaattgttcacaaaattagtggggagcccaaggggtggtgatgtggtttagagcagctcccaggcatgggcagagctggccgccaatccctgggtactggcttcctccctgcctgtggactgtggatgggaaggtgccgggagcacagatggcaggtggggtcttggcagcctggagcgcgctcactgatgccccagagcaggcgtgtgccaccctccagtggccacactggggactgcagggctggcaggtggagggagggcgtgggcctcagggttcctgaccttttgccactgcgctgaccgacctcccttccaggacatggaaaataaaatcagaagtacgctgaacgagatctactttggaaaaacaaaggatatcgtcaatgggctgaggtaatgtaccagaaagcacaagctttagaagcagacagagggatttgaaccctggctctgccagttactagctgtgtggtcttgggcctcggtgtcctcattggtaggctgcagtgcccctcttctgggatgatcattatgttgattttggaaagtaaagtcctgatgtgtcatctgcactctccgtagcagctgtcggtccctatctgcaccatttgttttctggggcatgttcaccctaacagccattggtgcccttgcccccggagcctcctcagccctgcagtttgtcagtccccgctcaaaaatctccccaccctccagcctgggcctaggggagccatgacaccacattccgggcagcccggctgcctctggctggcctgctctccgagacagcagagcgcaacgtgcaggcagggccctcagtccgggccttctcaggcccccagcctccctgacgccacatgcaggcagggccctcagcctgggcgttctcagggggccccagcctctctgacgtcctctgccagggctctgctgccagtggccagtgtcctgcaccatccttcccacctcgtgccctcagctctgcagtgtcagcccaaacaaaagccgggcgctctctggaccctccaggtccacggcggacagagcaggaggcaggcctctgacatgaggccagagcccagctgggggcagtaaacggctgtggagggagcactggccttggagtcaggagagtcaggaggccgggatctcccctaagctctgtcatcccgagctgcatggcctctggcactcctcgcagaggcccttgtccagtcgaggaggcacggtcggctgagatgatgaatctagaacacgctctgcagtccagcagcaccgtgtgagtcgggctgtgctatgcctttagcggccagccctctcacccactgccgtggtgtagctctcacagcccagcccagaggagaggcaggctgcagtcccggggctgccccagctcgtggactggggtgggcgacagatttcagtcacctgctttacagttttaaaacagaggaggagtcctctttggacccttgtcttctgatcccctgcccacctgggggaggcttggtcttcgtgacctgtgacagggttagagcccagtggtccctggcgttaggcctgccactggcagccactgcccgatacaccaaacacactttcccgcccagccaacctgcacagtccccaggcagtggctgggaagtgggggagagaagccgaagagcctgcgggtggtggtggcgagcccctgaataccacgaccaccgccagcgtggacctctgcagcggcgataccactccacaccccagagccgccacggcatccccccttccgcctcgtgggtctccctgaatttcctcctcagctgtggccccctgcgttcctggcttctcgtcgttctcttccctcccactccactcatcttgaacactctctgtagatctattgatgctatccctgacaaccaaaagtttaagcagttgcagagggagctctctcaagtgctgacccagcgccagatctacatccagcctgataattaagccgatccaggtaccctgcctgagagccgcgagaccctccccactaaaacaggactcaccaacccgccgagaccctgccggtccggctgctgctccgcggccatttaaaccaccactaacccccacgtgtgctcccggccggtgcacagccacattcccgtgtagcctcggccccatgtaacacggcacctatcacgtgtgtgtgctttccactctgggtggaggctgggtgtggggaagacggctgattttttggcttttgcttctgaagaagcccaggccaagggacggatgctgcctctccagcagcagccacttgtgtgcaccggcctgactgtccccagggcagggatctgcctgccgtccacccccccatgcttcagaggagcctctgatgctggtgcagggatcccagaagccacataagcctccccgctgctcagcggcacattgcctgtccagggctagctggcttggaaggggtgacctcactctctgatctctgagtctctggggttggagggcagagtcagggctggactccaccctggctggcccagatgctctgctggagctgcctggacgcccagtgccgactcggccacaaccagcataaccttccgcccctaacgagctgcagctgttcctttaaacaggtttcgctaatggaaaggaaaatagtcttgcttgttggtaatggccaagaaccatgacttgagcttgtgacagatccagatgtagggaaggaggcagcatccctggagagtaggagggaaacttgtttgtaaaaagaaggcatttggaaccctgccaactggggctgcagagcccaggtccaggggctgcgcactgaaggcccaccccagaaggggtgcagcagactttccaaggtggaggtggggtcaggcacttagaaaaccaggtggagctgcttttccgaggccgtgggacttaagtgcaccagtctggtctgtgtgtgccaacttaaggcccacgactcgggtcagcctcacagtgtggccatcaggcatttccatcatggcattgagaaaaaaccctttttaagatacaccgtgatggtgcagttccctggccgcccactgggggcgtcctggcgtagaaaccctggcagccaggtctgctcaagatgactcctccctcccacagagtcgagcactgtctccaagcgctgattcgaggttgcttggccgtgaccttcccaagcattgtcccttaaataagccccctgctccttccgccttccaccatttcacttctaacttcctgtgtctaacatgattctagctctggaactttctccttcgtgtgatccagccaagacctggcgggcttggctcttccttcccagaagagccagtgaccacccaggctagaggtcctgtgcgctgctgctttgcccgccgcatctcccgctggccatgttgacctcccgctgtgagcttggcaagaagcccctggggaatcggctgagatttggagcctgggggccgtgggggctgatgcctttggccgccgcagagccagggacagtcctgggaagatactcagaaacgtgtatttccccagcatgaaccaaatgtctgcgtttctcctgggagttttttcagttgtatgcagcttgcttccaggtcttgtcttatggcacctgctgagtattttgagggctcttcctgtgacttgtagggattcggtagccagaactcagtctgggtgctgttgcttctcctgggccctgcttcacttccatttgcccatttttgcttctggggattgatttttctgattcttccttcccatggctggtgtgaatcaaacgtgagagtccggctgagtgcactctccgtagcactcttcttgagcagccctctacccactctttccactgcttctaaactgttataaaacctacatttaggaagtctttgcctaaccaatatgttgggtaaatttgacaaaatgattaaagaattgctaggggggcattcctctgagcctcagtttcctcatctgtaaattgggttgatagcttttttcttttttaagccttgacttcgctttttgttgttgtcgttgtagagatggggtctcactatgttgcccaggctggtcttgaactcctggccttaaatgatcctcctgccttggcctcccaaagtgctgggattacaggcttgagccaccacatccggccgggttgatagttgagacttccccaggatgcccgtgaaaattaaatgagataatatatgtgaaaggcgttttgtaaactgtgaaatctccataagccttcattgtttctggctttgttgatgagcgtccccacacatacgtgaatgcggtcgccctgaacgtttccccacaaatccagaatttgacagcagggatcccaggggcacttggctgtcctgtgccgccctttgcaatccgggctgaggggttttctgggccaagttaacagcggatggtgcctcacagcagaggcctgaaagcacctgctgcgtgggccataaacacagtgtgctcagacacgcagagacactggttcttacccactcccaagggtgggataacgctgcaccttgcacttgtgggatgaggaatgaggctcttctgctgggcagggcctgggcaagggagaagcttttatagaggaacccgcatggccccggagtcctcccctcttagcccctggcctgagtccccagccagcaacccagggtagctgttctgaagcagaggggctttgttccattgtgtttggaagcccagaagccaccttgtggcttagggtgacatagggacctacacacagaggagtgaacttagggttctagggactatggccgggtcaccggtggccaggggcagagatgagcacctgtccatgtaagccatatgccacccccacagggcctggcaaggtgcagagggtgcaggtctcggccatgtacccctttgcccctttctgagaggggcagatgcccagcccagtgacccagagcctcaccccaggaagcgggtccatgcagcaaatcagccaggcactggcatggtggcccccaggcctccaccgcctcaccagtccctgttcaatctgctgataacgcctttcctcccttgcaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttctggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagttagcgctggccttctgtgttccttctcgccggcctcgctttccgagcgcgtgtggccgtggccgtgcgctggctccaagctgggacgcgtgtgggccccgctcacggcagcaaggaagtgtcccgtccccagccccgccgccctgaaaacaccaggtatgtgatgaggtgcagagtccctgtccctttccgccctctgccgttggagggcagaagcaccagcaaacactgttctggcgccgcagcacgcacctcccgccgccttcccactgtgcctagtacaaatgtgaggcagccgaggttcagttgcagtaactcagccaaggctgcacagagccacagagtctgccttctaccctccaaactgccccagggaagatctgaagcagatctcaaagtccctgccgagaccatccccccatctgtccgtggccaatcagcgggctccacaacctggccagcccatgtgtttgaggtccctgggtctgatgcaacatctttttttttgagacggagtttcactcttgttgcccaggctggagtgcaatggcatgatcttggctcactgtaacctccgcctcccaggttcaagcgattctcctgcctcagcctcctcagtagctggcattacaggcatgtgccaccatgcccagctaacgtatttttagtagagacggggtttctccttgttggtcaggctggtctcgagctcccgatctcaggtgaccctcccgcctcccaatgtgctgggattacaggcgtgagccaccgcacccggccgatgcagtatctttatggagtgcaagtgccatggcatacagacagcagagaagcccctgccccctgagttcctagtgccacgtggagaacgcaggcacactccagccgtgagccatgaggggatgcacccagcgagccgttccccatgggcacacgggtgttgcagcctcccggggtcatgttggcaaggtgcctggcacacagaagggcccagcgagctgttccccatgggcacacgggtgctgcagcctcccggggtcatgttggcaaggtgcctggcacacagaaggggctggaaaaacaaatgttttgcttttcattttctttcatggtaaagttttatccaggatcatcaaggtaggtacaggggccactgcagtggggtcttgtggatggggagagagattgggctcaactctgagtgcagcagcacgggcaggtggggattagagccaaggagcagaggggggcagtgggtggaaaatgactcagaggaaacctcaggggtcaggggtcttccggccaaacacacctaacaggattcttgctgaagacaggccagggtgaccagacatcacctgggggtgggggtggaggatgaggccaggtgtggtggcttacgcctacgatcccagcactttaggagaccaagttgggaggatggcttgagcccagggctttgagactagcctggttaacatagaccccatctctacaagaaatacaaa

SEQ ID NO: 16679 - DNA, 15454 bp, Human
catctctactaaaaatataaaaaattagctgggcatggtggcgggcgcctgtagtcccagctactcgggagactgaggcaggagaatggcatgaacctgggaggcggagcttgcagtgagccgagatcgcgtcactgcactccagcctgggcgacagagagagactccgtctcaaaaaaaaaaaaaagaaaagaaaagattacgaacagtgtaggttgtaaaaattactgctgtcttacttctcctcgccctctaggagtctctgtggagtcttcttgaataagctgtgaaacatttccccacccgcttccctttcttggcccaggcttcctgaccacagcctcacctttgagcagctcagagccctgcctgccaggatgcgagccactgcctggatcgtggctctgcagggccacccatgatggaacaggtcgcctggtgaggtggtgaggcccttcatcatttcagggggtgtacagcagtactgggtaaccctgaaaatcagggatgagactgaaggatcccttccagaatgtggacacaacccctcctttgagtctcacctcctttccttcttttttttgagatggagtctcgctctgtcacccaggctggagtgcaatggaacaatctcggctcactgcaacctccgcctcccgggttcaagtgattctcctgcttcagcctcctgagtagctgggcttacaggtgtgtgccaccacacctggctaatttttgtatttttagtagagacagggtttcaccatgttggtcaggctgctctccaactcctgacctcgtgatccacctgcctcggcctcccaaagtgctgggattacaggcatgagccactgcgcccggcctctcgcctcctttctttcaagtctgaggtggctagcctggaggggtccccaggggcttgttgggcactgacgaggggacaccctgggggcccagtactccactcagacacctcccacagccttctgacagcatccttcccacagctgaccagctagaggacctcctgacccctccacttgtctgctggtgtggaaaagcctggaccctccctcttggagcctcagtttccctatctgtaaacttcggtctatcccaagctgaagaactggccagtccctgccatatgcctcactttcccctgggacacattttaatatccctttcctggccaggtgcaatggcttccccatgtaatcccagcactttgggaggccaaggtgggcagatcacttgaggtcaggagttcgagaccagcctggccaacatggtgaaaccccatctctactaaaaatacaaaaattagccaggcatggtggcgcacgtctgtggtcccagctacttgggaggctgaggtagcagaatcgtttgaacctgggaggcggaggttgcagtgagtggagatcacaccactgcactcctgcctgggagacagagtgagactgtgtctcaaaaaataataataataaaaaataaaataatatccctttcctcacaggggctattgtgtcatcttctagaaggatccgttgaggctctgaggggtgggggaacttgcttgtgggtaggaccacctgtcagaggtcagaggtcaggccaccaaggagacccagtgggatgcgccttccaaaggtgggggtacggatgggacccatgaaacctgactcctctcagactctagccaagtctaagactttggacggccaccacccagaggagaaactgagacccagagcggcacgggttggccagggtcacccagcaccagatagggactttgccagccccggggcaggaccctgtctccggccctcgaccccgctgggccgtaccctccccgttcacctcccccacccgggccgcggctgctaggagagttcagaacaaaaggcggcggggggcggggccgaggcgggccgggggtggggcggaagctataaggggcggcggcccggagcggcccagcaagcccagcagccccggggcggatggctccggccgcctggctccgcagcgcggccgcgcgcgccctcctgcccccgatgctgctgctgctgctccagccgccgccgctgctggcccgggctctgccgccggtgagtgcccgccactcgccggccgctcctcgctgagggggcgccgggcacgcgggctgggcccagcggcggatccggaccgaagggggcgccccgggtggcctccagcgcccggtacccgaaacgctttctggttccctctaggcgtgatagacagcgagcttgcagtccctgggggtgtgaaggggagccggcgccggcatcgttcgggctggtgggacgggactccacgctggactcacgcttgctcccagcgtggggacctgcctctcgcgctccagccgcgggtgctggagtgtgcgttgaaggaagcagcagagggagtggtaacagggccccctattcatcgtagggacaaagccgagcagatcccaggcaggtgtcagcctgcaggtgtgtggccgcagttagtacacctccaggtgtgcggtgggatgaaggataaagggagaagggagggcagcgctgtgctgcgggaaatggggtctaagcctggagatgtcccccgcgggcacctgccggcagcagttttgggaggcttggagccaggagaacatgagtatgaaatagtatgagtgcagtgtgtgtgtgactgagaggtggctgtcagaaagaagcggggagagaaaggaaagggagaaaatgtgtgctcaggagaggagaagaaagcccaggtaagagaggacagcagagtgaggagaggagggactgtcatggagtgtgtgtgacagcttgcatgtgtcccaaaagctgccccttccctggggcgcttccaggcaccagtcacagggcctggggccagagcctgggccactccactccacagcggaggcatccagacagctcgggcagggaagggagcaggagggtgtgacaggcaggagtctcaggactggcctggtgaggaggcaggcctggccaggctgggaccctctgtccagccactctggctctgctcagggcagccttgtcctgtgctggctatgggagcagaaagggatgggatgggtggggtagagtgaatggggggcatctcagtctggagtcttgcctccttcccagcccctcttggttcctaggacttgggacagagtcaggaatcactgtgggtagacattgaaccacaggtctggaaattggagagatctgggtttgaaccatgtgaccctgggtgaatcctgccatgcctcagaatctcacccactccatctctaatgggagtgcaggtgggagggggcaatggtgcctactgctgtgtccactgttgagcaatgaggtgatgccaggctcactagaaacactgtcacctgtagctgccactttgacgcttgtgcatggtcagtgctggagctgggggccagcttggggtggggtctgagctggactgtggtctgtcactctgcaaacacgcagggagcatttggggtcacctctgatgtgtttatcccccggctgccttcagcaaggctgggagagctctgtaaatatttatccagcccagttcccagctttcagggttgatggaagccctgcagtccgatggatgggacgaagctaccgtccctcctggagccagcagcagaggggtgagaataggaagattaggtggaagcttgagggagaagatatccctgcttgccacctggctgtgcgagttgggcaggttgcttgacctctctgagcctgcatggtgatgctcccgtcttcctccatagcctaacaagtgccctcctcgaagtcttgcctcccaccgacatcagaaggcatagctatgattaattatacccactagaccaactgcaaactgaggcccagaaaggggcacaatgagcccagcctttcgcagtgtttcctggcaccctggggtcctcccttatctcccctctatctggtgcctcccattttctggattgcaagttgaccccagggcggggttgactccgagtctctaagctctgccaggacactgggtcagctgagaaattccttgaatgtgtctgcagctgaggtttggtgtctggcagaagagggtggggctgagtgagctaagaacccaccacagggcaggccaagggaggctactggccaagacagagggaatgcactggaagcagaaatgcttcttgggaaagtgggttttggagaaaagccaagagctggggagacagggggaagccctggaggtgggaggcatgagccccaggtctaggtccagctcttgcatgacttgctgtgtgaccccgggcaaagtccttgagctctctgggctctgtctcatcctctgggaaatgggggagctgcttcttcctcaagctccccaggggtgtagatgaggccagtggtggcctgtgtctaccacttcacctcactgaatcctgagagtcctgggaaggccaagcccacctgtctcacaagtagcaagctgcttcatgccgtgccttgtagttagggcatctggccccaggccagaaaggacttggaaagatgaagtgtgggaggacagtgaggcagaatgtgtgtcctatcccagccatggggaaactgaggccaagagctcatgggctctaaaaaaataatgggctctaaaaacaacctcactagctagaggcctcatttctagcatctcctgctcactcagtttctaagaatttaatgaacaagacagggacagggagaagagaccttgatatgtgggagaccctgcacaaggcgcttctcttttctaggcctgaaagctcccttctagctgcgacttctgttttaccatttaaagcctgaagattttgttgggtagctagaggggcggtgggtgatgggaactgtagggactggcaagggcagattcccaagcgtgggaggggagggcctacagggacaaggaacagggccaggtaagaggtgcttttctgtgccagaggctacagcaggcattacagaaggatgtcatgtagccctttgctgtggcatcattcccatttgacagataggaaagttgaggctaagagaggaaggtgacttgtctagagtctccatgtcatagaactaggccttctgaacctcagtggctggctctttttgtgacactaagactgtcatgatccaggggtttgggcatggactgggtgcctcatgagggaaggacaggaagggacagtggaaggggtgggggcatgcccgtggctctccctccatgactgtctgcaccaggactcactagagggcagaggagagaagagatttctgaccatgggcataggcagggctggcaggctgggctctgggttgtttggagctcccaggggagagcacagctctgccctttccagggagggtcttcatacccctgccaggctggggaaaggaatctgtttctcctgtaagtcaagggggcagtgtggcgaggaggaggaggcaggcccctctggcagcccacatcctccatgggagaacttggatatgtagcatctccacctgcctggtggatattggaagcccaacgaacctgcctgcaaaatgcccgggaaatagcaggcgctgaataatttgcacctcaccaaggtgaggccagcctgggtccctccttcaggggaagggtaactcaacccctgcagagcagagcagaggtagcagggagctgggtgggctgtgagcacagacagtccgctgcctgccagctgttgtctgatcaagctgcttaactcctctggggcccatttcctcatcctggaaatgagggtgatgatggtggagttggtgagaggttccatcaggggctaagagcaagtctgtggagctgttgccaaggtcctagcctgcaaccagtgctaagtacttttttttttttttttgagatggagtctcgctctgtcacccaggctggagtgctgtggcacgatctcggctcactgcaagctctgcctcccaggttcacgccattctcctgcctcagcctcccgaatagctgggactacaggagcccgccaccacgcctggctaattttttgtatttttagtagagacggggtttcaccgtgttagccaggatggtctcgatctcctgacctcatgatccgcctgcctcggcctcccaaagtgctgggattacaggcgtgagccaccaggcccggccaaccagtgctaagtacttattaacaataagcccaggccgggcgcggtggctcacgcctgtaatcccagtactttgggaggccgaggcaggtggatcatgaggtcaggagttcaagaccagcctggccaagatggataaacctcatctctactaaaaatacaaaaattagccaggcgtgaggctgggtgcggtggcgcatgcttgtaatcccagcactttgggaggccgaggcaggcggatcacaaggtcaggagatcgagaccatcctggtaacatggtgaaatcccgtttctactaaaaatacaaaaaaattagccgggcatggcagcaagtgcctgcagtcccagctactcaggaggctgagtcaggagcatggcatgaacccggaaggcggtggttgtagtgagcccagatcacaccactgcactccagcctgggcgatagagcgagactctctctcaaaaaaaaaaaaaaaaaaattaaccaggcgtggtggcaggcacctgtaaccccagctactcgggaggctgaggcagagaattgcttgaacccgggaggtggaggttgtagtgagccgagatcgcgccactgcactccagcctgggcaacagagtgagactccatctcaaaaaaacaaaacaaaaaaccaataagcccagaatcggccagaacccacaacccagtgagactgcgctgtgccaggtaaccatgcaataagcaagctcggaaatggggggaagctgcttcagggcctcacgccctaagtagttccatagcctccgtgttcagaaggccccccttcatggtggggtgttcttgatgcctcagctctgggatcaggagcagggagcgttgggacgctgatcagatccctggggtgtatggagcctgggagagctgccaaaggctgagggtgaggtggggcctgagtggctgagctcctaccccaaatatggctgtgaggaggctgcagttgcccagaccagacaggtgctgagtctctcagcaagcagcacagctccatccctctccttcagtgcaggaaggacacttggcttctgtgcggtgtccagagccaggccttagccttaggcctgagccaccagagtcctggcctggccttgccatgcccttgctgggtgactttgcagggtctccaacctctctgagcttctgcttttctcatgcacaagaactgtaacttctgccctggagacttatagacaggtagcaggatgtagcttaggtctgaatcgccatctgtggtcctggggctttggcgagtggggctgggcacctggtaattaactgtccccaccctccccgcttgaagaaggcaggcagatcacagatcagctcccactgtactcctagccctggtggggtgtgaccaaaaccacctctgctagaagccaggcctcagtggccaggtgccttcccgggtgctgggcctgtgctaggtgctgtacatacctcaccttgtccagtccacaagtcagtgtcacccccagcagtcaggttacactgactgaggccacactgcagggctacagccgctccacactggggaggaggtgggggaaatcctgggcaggagagagggcagatcctgctcacatgacagggacaggagcatgacccaggtgtgtctgaacttagcggacacaggaagaaagggagttggaagcaagtttctgtggggagcaggaggaggttgcctggtgttccttcggaggaagctttttggggtccattcctggagtgtatggctcatagccagtcccagtgtgcccccacccccagacctcattggcctaagtagctggagtaggtgacaggcagcccagggccctccacgatgtgggggacagcttgatgccttggaacaaggtgccaagaaaccagagagccagccagatgccaaagggccctgccatgtgccggtgccctttccctctccatttgcccagccacacagtgggctggggttgcacgtgtgtttgctgacaggccacatctctaactgtgggccatgtggaccttaggcctgaccagaccctcatgtcatcctcctgcctaggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggtaggggcctgggagcaggacactaggatgccacctgtgtgtccgtgggtaagccagctgccctcacagctgctgcttgagacacaggccagggtagatcttcgtgtctaacagacctgtgtgtccactgaaccccagggaggtcatctatgggcaaaccccctgaaaccccaacttagacacatacacatatggagaccctccctcagcagaggggcagagcctccgtcatcatgcaaagagtcgcagcacatgcctgcggacgggtgttcagtcactcaggcagcctttacaagagacctgtgaggaccaggctctgggactccacggtgaatgaggcagacacagccccatcctctgtgtcagtctgaggtgggtgtcagccatgtcattgtccaactctaccatcacaacttgggcttcgagcaggtggagacagtggtaagcggggagaggcaatagtgggcatctcactgggtgacctgggaggaccctgggcaggtgatggggaagctgaggctcacacatcctgcgggtggggacccagcctgaagaatgggctggtgtcacacagcattggagctgagactggggtctttagaatttcctaggtgggggcctgggaaccaacaggggctcaaggaaccaaggtgtccccacagtgagtggcactgtcaggtctaggatgggggtctcgggacccctggtcctggttctttccactgaattcagacacttgtatttgcctaagtatgagcaaaccacatacacatgtgcccatgtggccagggagaccagtgcgctgaagctgaggcccagagtacacctggcctgtgtcctgagtgttcacacacccaccaagcatccaggggcaactcctggtgcctcagccatcgggggctgtcccttccctgaggcccaggcccctccatctccctccaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtgaatgggcggcctgggacccctccgggaacagcctcgcctgccagcagccactgaccccgcccccacccatctgtaggtactggcatggggacgacctgccgtttgatgggcctgggggcatcctggcccatgccttcttccccaagactcaccgagaaggggatgtccacttcgactatgatgagacctggactatcggggatgaccagggtatgggctggggacccattttccagatggggcaaccgaagatcataaagaatggggactcgccaaggtcactgagctggggtctggagctggatgtcctgggcaggaggttcgggggttgctgagccacctccctttttcaggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggaggtgaggccctgcctgccagtccccctactcctctgctggccactgtgactgcagcatatgccctcagcatgtgtccctctctcccaccccagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgagtgggggttggggatctgctcgagagacttcccagagccaggaatgttatggccaagggcaggaacagacagatggatccttagggacacagtggatagggagagctgccccaaagcctgggggccgagggagagagagtgtggtttgttcctcaggcacaggtaggaggttctcggaggtggctcttgagataggagcagcgtggaagggattgcacggtggggcctcgtgttggtgcgttcaaccctcagccaccccatggggcggggttctagagatgaggcctctggggccccgaggcagtgaagtgactcactgtgagtgcagctgggaagaggcagggcagggaattgatccaggtctatcatcctagagctgggatttccatcctcaactggcagagatgagagcctggagcattgcagatgccagggacttcacaaatgaaggcacagcatgggaaacctgcgtgggttccagggcagtccagcctgcaggggcccagggagtggtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatgttgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcctgcttggtctccttttgtgaatgttcagccaggatggggaggcctggccactgtccagccctatcctgggagccagggtcgaagtccaccacccccaagcctctggcccttggggctgggcacagtgctcagggctccttctgctccatttctacatcacattttgctacagtggcttcttaactggctccccactttcctacttgtcccctctgttcatcctccagagtggtggtttatctgctcatgccacagcccagcctgccatacatagctgtggtttctgcatccgtaggctcaactaacctcgggtagaaaaaacaatgtttaaaaaaaggatgcggccgggcgcagtggctcgtgcctgtaatcccagttctttgggaggccgaggtgtgtggatcacctgaggtcagaagtttgagaccagtctggccaacatggtgaaaacccatctctactaaatatacaaaaattagttgggtgtggtggctcatgcctgtaatcccagctacttgggaggctgaggcaggagaatcacttgaacgtggaggcagaggttacagtgagctgagatagtgccattgcactccagcctgggtgacaagagcaaaattccgtctaaaaaaataataaagtaaataaataggctgggtgcagtggctcatgcctgtaatcccagcactttgggaggctgaggccagcagatcacgaggtcgggagatcgagaccatcctggctaacaccatgaaaccccgtctctactaaaaatacaaaaaattagccaggcgtggtggcgggcgcctgtagtcccagctactcggaaggctgaggcaggagaatggcgtgaacccaggaggcggtgcttgcagtgagccaagatcatgccactgcactccagcctggacgacagagcaagactctgtctcaataaaataagtaaataaataaataaataaataaataaataaataagggatggttacctccgtactgaacatgtacggacttttttccctatcattgttccctaaacaatagtataacaactatttatataacatttgcattgtattaggtagtataaggaatctagagatgatttaaggtatacaggaaagtgtgtgtaggttatatgcaagtatgacaccattttatataatggacttgagcatctgtggactttattatctgcagggggtcctggaaccaattcccatggatactgagggatgactgtactttggtttcccaccactgtgaggatacagaacaaagcaacttcagtcactgcccttcccaactctccagtgtctccttgccctaccttccagccccatgtgtgtcttcgtaatagcatagttgcattttttttttttttaagagaggcagggtctccctttgttgcccaggctgcagtgcagtggtgcaatcagctcactataaccttgaactcctgggctcaagggatcttcccctctccacttcccaagtagctggggctacaggtgcacaccgccatgccacacccagcttatttattttagaatttttgtagagacagggtcttgctgtcttgtccagtctggtctcaaactcctggcttcaagtgatcctccctgccttggcctcctaaagagttgggattacaaggccgggcgcagtggctcacacctgtaatcccagcactttgggaggccgaggggggcggatcacgaggtcaggagatcgagaccatcctggctaacatggtgaaaccctgtctctactaaaaatacaaaaaattagctgggcgtggtggcgggtgcctgtagtcccagctacttgggaggctgaggcaggagactccagcctcaaaaaaaaaaaaaaagagttaggattacaggcatgagccgctgagcccagccacagctgcaatttcattagattgaacggtgtgaaatcatcagtagtgggccactgttttactccctgcattattcaatcatgattg

SEQ ID NO: 16680 - DNA, 11026 bp, Human
  misc_feature (1)...(11026): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattgcaagctccgcctcctgggttcacgccattctcctgcctcagcctccccagtagctgggactacaggcggccgccaccacgccctgctaatgttttgtatttttagtagagacagggtttcaccgtgttagccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcggtcaagatgaaatcaccatccttgagcgtcggcagtttccccaggctgttgatctgcaagaactccttgctcttgtgctgccctgaagaggaagaagtcagaaaaggtcttcagagtaaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagcatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatccctccaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcctctaaaagggatcttagagtttcacccagtgggatgtgacacttgcaggtgtcccaaactggtgggaaccttgactggaaggctggggtcaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccacctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttcttttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacaggtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagacaggctgttcatactcccgcccgccccaaccaggctgtcccaagttctggttttcctcactggaaacttgctgttacctctgagaggggcatgttcacttatggcccagacattagtggcggggttggtggggtggggggtcaccctgtgctcagcctttgagaaaacaggtggctgaggtactgtgcccttagggagcctgcaattaggaggcagggtacccctcagtacacaaactgatggagatgatagagtgtacggcacacacaccgaggctactgtattgtgtgtctgtcctagctgggtcatgatgtgcggctacatcccacacctgagtgtcccactgccctgctgggggttggggaaaatcattattgggatgagcaggtttgcaaaatgcctggtggactgaggcaggctgtcctgagtacccacagtgggagtacctggcaggggtcttgcaagatgtggtattaccaaggagctgatgatatctttttctctgtctcctgaaggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaacatgacttcttaccttctattatctctcctgggcatctggggccaccatgggcagcagggctggtggataagaccgtagggaacctggagggggatgatttagactgctcagatctggggctgggagactcagcctggaggctctgctctccacacccatctgcaggcctgtgggaaggtgtgagcagctggtccagctggggccttcctgcagactgctgacctgaggctcctgtcctcagccccaaaatgggaccagacctctgtactcctcctgaagtctactccctccatgactggctgggcagcctgccacgccactctccccttttccccactgtagagtggaggcaggggttgcctgtgtccctttgggggttggtcgctggttttccagaagcagggtccccagtctgcccctcctcctccccagggttgcaagcttcgactccctccctttggcaagactcaaaccgtcctcccagctgccccatcaccccttcctggcagtagcaccacttttcataacctttccagcccaggggtccccaggctgggaggacagctggggggatga

SEQ ID NO: 16681 - DNA, 51508 bp, Human
tcccagcactttgggaggctgaggccagcagatcacgaggtcgggagatcgagaccatcctggctaacaccatgaaaccccgtctctactaaaaatacaaaaaattagccaggcgtggtggcgggcgcctgtagtcccagctactcggaaggctgaggcaggagaatggcgtgaacccaggaggcggtgcttgcagtgagccaagatcatgccactgcactccagcctggacgacagagcaagactctgtctcaataaaataagtaaataaataaataaataaataaataaataaataagggatggttacctccgtactgaacatgtacggacttttttccctatcattgttccctaaacaatagtataacaactatttatataacatttgcattgtattaggtagtataaggaatctagagatgatttaaggtatacaggaaagtgtgtgtaggttatatgcaagtatgacaccattttatataatggacttgagcatctgtggactttattatctgcagggggtcctggaaccaattcccatggatactgagggatgactgtactttggtttcccaccactgtgaggatacagaacaaagcaacttcagtcactgcccttcccaactctccagtgtctccttgccctaccttccagccccatgtgtgtcttcgtaatagcatagttgcattttttttttttttaagagaggcagggtctccctttgttgcccaggctgcagtgcagtggtgcaatcagctcactataaccttgaactcctgggctcaagggatcttcccctctccacttcccaagtagctggggctacaggtgcacaccgccatgccacacccagcttatttattttagaatttttgtagagacagggtcttgctgtcttgtccagtctggtctcaaactcctggcttcaagtgatcctccctgccttggcctcctaaagagttgggattacaaggccgggcgcagtggctcacacctgtaatcccagcactttgggaggccgaggggggcggatcacgaggtcaggagatcgagaccatcctggctaacatggtgaaaccctgtctctactaaaaatacaaaaaattagctgggcgtggtggcgggtgcctgtagtcccagctacttgggaggctgaggcaggagactccagcctcaaaaaaaaaaaaaaagagttaggattacaggcatgagccgctgagcccagccacagctgcaatttcattagattgaacggtgtgaaatcatcagtagtgggccactgttttactccctgcattattcaatcatgattgctttcagactttcattagtttcactagcttcgcgctgtaagagccaagaggcagagccacagggctgggctgcctggtttcactccccactgcagggctcggttaagcagagtgtaggctaagagaggaatggagaaggtggaaggtgtctctcccttccaacgctcatctgatgcaccagccaaaccaaataccacctgggcctttgaacattgccaagcctcatccgctgttgtcattttgcccacctccacagctgcagggacagccgtaggcccggaactgggatatctcttcctaggggcctgcctatctgctcagctgcactgcgttttaggggtggggaagctaaggcacgagattggggtcccaaagcatgcccagaccacccaggcttccagatactaggtcctcctccttcaggcctcacttcgttgcttttcccctgggctcagttccagtcctggctgtaagactgggaaagccactgcttgagtcaggacctcagtggctatttttgtccgtgagaagtcctctacaccacgacttgggaggcagcctgggagaaagagaaattagtcgtggctcctttaaggggtccgcggaggcgcgcccggccttttgtttgagcggcggcgcgcgcgtcagcgtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtagcccggggcgcgttctcgccctccccgggctcggccccgcgggagccccggggcgggcccatgcgccgagagcgcgcgtctccattcatcggggcgggcgggcgcgcgcgcgcgctcggggctgtggggcgtggcctagtgggcgtgtcgggtgtggcccccgccccctcatcgacctgggatttccttacttatttcgccgaggtccgccgccttcagtgctgccaagattttggcgccgcgaggggccccagtggttccgcgctgggttggtttccagtcagacgcaaagaaacgggatattgagttagcccctgcgacgcttgggggactgcactgctgcctttgaccctttttagatgtcgtaaatttcacgtgcacccctccccgtattgctacttgtgggaacctcaaatggcaggctggaaaccctggacttagtgagggctcatccccattgtgtttgttgcctcttaggtgagcagtggaggtcttttgacctttgtttaccggtgaagaaacagattggaggaagatgtttgcttttgggtgaataagggccccatgcctaagctagatctttcagcagttctgaagcgattgacactttccatatctgtgaactgattctgaattattacaggggaaagagcctaaggatgtttaacccttaactagagtggctgcattttgttgcatcaactggatgactgacttcaggaaaactctactggcctttgaatgggtgtttgttccaagtctattaggttcttgttttttgttttttatagagacagggtctggctatgttgcgcaggcaggtctccaactcctgggctcaagcagtctgcccgtctgggtctcccaaagtgctaggattacaggcatgagccaccacacccggccatatattaggtttttacagattgtctcaaactagccttttttgctccaaaggcagtccccagctagtatatgttacctttttaaaaaaattatggatatacagttcagatgtacaaatgtcaagcagtagaatctcatgtaaggaagtaagtgccaatcctggagaattaaagctatcatgaaatgccaagagtttcttctccttatagcagtttttagtatcatattccagcattttattcgtactttattttcttttatttttgaaaaaagatctcactttgtgcagtggtgtgatctcggctcactgcagccttgacctcctgggctcaagcgatcctcctgcctcagcctcccaagtacctgggactacaggtgtgcaccaccgtgcccgactaatttttgtattttttgtagagacagggttttgccatgttgcccaggctggtcttgaactcctgggctcaagtgatccttgcacctcagcctctcaaagtgctggaatgacaggtgtgagctactgcactcacactcagcgcattcatactttttaaacttgtgggttttatccttcacaattgagcatagcatgaatgaatgaagcctcaagatggtcacactgagtcccatggatgagactaaggtcaatagcatcagaactttagtgttagcattttccaccattttttttttctggacgaggtttgactctatcacccaggctggagtgtagtggtgtaatctcggctcactgcaacctccgcctcccaggctcaagccgtcctcccacctcagtctcccaagtagctgggactacacgcacacaccaccacacccggctaatttttatatttttagtaaagatggggttttaccatattgtccaggctggtcttaaacttgtgagctcaagtgatctgcccgcctcggcctcccaaagtgctcgattataggcgtgagccactgtgcctggcctccactaatttttataaaacaaaaaatataggattcaataaaattttcacgttgtcacttaaattacaactgttcaaagatgccagtgctggggaggtagagccagtgcctgtccatctgccacagttcagaatggtcctcattggccagtaggcacctgcctaactgcagaatgcaaaaggtgtcaaatttcagcctgtgatactaggcgagttgtttacctgatctaatgggtgtaaaagtaatcagtttggctctaagtaggtgacacttcaaaagaaagctttcatttattagttggagcaaattgagaagctgtgcgtggccaagtgggaagaaccttgggaggcctggttccagccctgctctgccttgctgtcgtgtttctcatgtgtataatgtgatgcttagactagatggtctccaagatcttccccaaaacacattttagtttctagaaagctaattacagtcttgtctttcagccccttgactcctgggcctcccagtaagaataatcttcctgagacccaggctgtaagagactcagttggagaggcagtttgttcttttgggcctgacttaatcatcagaccttcggagtttagggaagagttcaaggtcagagctctattgaaattcagtagctccagtgatagtagtggatggacggtctcagcccactgccctgtggaaaacaggcactgtattcagagaggtgggccagccatagcaacatacccagtgcctccatgcgccatctgtggagctgtcttgggaaggcatctgcatttactaagagtgtgtgtcactgttctgccattaacagacagctgtatttaccaagccggagtcatggagctttgaggaccctaacagatccccaagtccagcaccttgattttatattcaggaaacctgggtcccaagagggtgaaggctggttcagaggaaagccaggaaggcaagcccagtttcctaagttctgaaggggctttggggggcatctaggagactcagagccctgcagggcctgcaaggtagtcataggggggagtattgtcaatttcttttaaaaaacctaatggaaactctacatttaccatgatactggatgatactgacacacaagccaaataacatagaggggtctgtgccctctatgtggaaagcgagtgacttgctgtgtctgctcttctctcagcgttcagtagccctggttgttgattacagtcactgctgaaaatggagaaacattttatttaatactatgcctgggtctcacacctataatcctagcactttgggaggcccaggcaggagaatcacttgaacccaggagtttaagaccagcctgggcaacatagtgagactcttgtctctacagatttttatttttattttttttaattaggccgggtatgtggctcacacccgtaatcccagcactttgggaggccgaggtgggcagatcgcttgagcccaggagtttgagaccagcctgggcaacatggtgaaactccgtctctacaaaaaatacaaaaattagccggttgtggtggcaagcaactatagtcccagctactcaggaggctgaggcaggaggatcgcttgagccgaggagttcgaggctgcagtgagctatgatcgatcgcaccactgcaatcgagcctgggtgacagagcgagaccctgtctcaaaaataataataaaaattaaaaataaatttaaaaatgcaaaatatatactatgttgcatagataaaatgggaaacataatagaagtggtccttcatgggggtgaagttcagagttgctgagcatttggcagatgagtaaagggtacccagaaaatgggaagtgatcccaggttacagatggagccagcacctggcacccagtctattggccatcccctgcaatgtgactccgaagtgatcatacttgaaaagtcaacgagacaatagggtaccctcataaaaactttaggtctagatttattttccttaaggaagtcacactttcagtatttggtacaagcaaactgaagccattgtttgagtcagtgatgatttatatagcagtctggtgattgccttgtaaaccttttggaaaattcctttggtatccctggtttgggttttgttactaaacaaagtaacacaggccatgggggaaattatctggcatctgtctaaaattaaaagacctttttggtgtttattacattgtaaaaatatcaaagtcttgtccttaagataaaagaaggtcaaggaggccttgcatttctggaaagtgccagagatccttagtccaaaatcaaaatcaccacgaacttcttgctaagctctgggggcctcccactcaggcatctgcccaggcctttcggaacttggttctgttgtcaggatgcacatatgcaggccagatgtgcactgctggtgaacccttcatatcagcagaatgtgttttaatgctgccgaaagcgtggcgcctgggggccacctcaaggcctgtttgtctgttgcttgatgcagtctgcgccaggaccctccccttccctgtggtgctgcgacccttataatgagccttcttgctttactcataggtgggaaactacctccgtatgttccgaggttctctgtacaagagatacccctcactctggaggcgactagccactgtggaagagaggaagaaaatagttgcatcgtcacatggtaaaaaaacaaaacctaacactaagggtgcgtcttcacgagggtttgtaaacctgtttcaaaaccactcgcttatgtcatgaagataaaacgttttcactccagagtgtcttcactgcagccttggccttagtcgggcagggagcatcccggggtgggccgccctgtgagcactccaggcaaggaagtggctccagggagccattggtggtccactgtcagttatttccagcagggccattgggtacgtgagcgggccggggccaggacactagcaggtgctgtgaagacatgttggtctcaaaacgttttaggaatgctgcgatgctctgccatctgccgtgggtgtgtcgccataatcatcttccatgcagcccaagtggcgggtggtggtcccagctcccactcccctctggggctttcactgcttgcttcctggagcacatccatcccatagcacttcatcctggcagccagtgtgctagagcccatgtgcatgtccctgctcctggtggcctgcgtgtgcctggggcttgctaggtacactagtgaaactagtgggctttgggtcacggcagctctgtgcagggtgaaagggtgctcttcagacactctgggggctctgtgggagacactcccatggagacatttgggtgtggacacagcatgtccttgggcaggtggcaaaactgcttcccacgtgacaatggcgccttgtagagagctgccctgggcctgggtgtgtctgtgagcatgtgcgcgatgcttcgtagtctgccctgtttgtttgtgtctgtaggtgctgctgtggttttgtccactgcgggaaagtagtggttcttttaatgcaggagccggagcttctttttgatctgctgctatgacatttccactcacttgcttaaaacagtttcctttttgttccccctcctcccctagcagagcatcagtcgctaacacagtgagtccccagctttgcttccccctccgcaagtccctgggctaagtcttgggagataccttccccataagcgattgatttctccaggagaagccagactgggcccacagacaggtagctcttgacggagattccccggaagagctaggggtcgagctgcctagaatctgtcctgcttcccaggcagcacgtgtggaccggctcggggatagaaattcgtgtttggtgtgaagcagctctttccaactctctgggctcttgttttaaaagaaaagtattcttcatcttccattccatctccccaccttgcatcgtgttgtggattgtggtggtgtcagacctcttcccactggggtgttactctgggagctttcttttcccctgagtgaggaccaagagaatatgttctggagtcgagtgtccccgctggtcgtgctgtattgtagttgctggtgctgccctgagcacttccctctgccccgagccagtgctcctggggcagattagtccaaatcagtcccattggaggctctacccagcaggacttgtaagtaaagcactcagtccagattgcccttttggaagaggccagcattcagcagtagtaagtttgacaccttgcttttcccacctcccgcatgcgaggaccttgatgtgctgcatccacttggctggctgctgtgtgccaccgccaccagcagagtgacccagtgatgtttgtctgttacagatcacggatacacgactctagccaccagtgtgaccctgttaaaagcctcggaagtggaagagattctggatggcaacgatgagaagtacaaggctgtgtccatcagcacagagccccccacctacctcaggtaatgcgttcctggccagggcatctctggggacacctgtggggtcttttctgagactcaagaactggttgggttgaagttaaattgaaacacttttttttttttttttttgagatggaatcttgttcttgtcgcccaggctggagtgcagtggcacgatcttggctcactgcaacctctgcctcccaggttcaagcgattctcctgcctcaacctcccaagtagctgggattacaggtgcctgccactatacctggctagtttttttttctttgagacagagtttcactcttgttgcccaggatggagtgcaatggcgtgatctcagctcactgcaacctctgcctactgggttcaagtgattctcctgcctcagcctcccagatagctgggattacaggcatgcgccaccacgcccagctaattttgtatttttggtagagacgagtctctccatgttggtcaggctggtctcgaaaccccacctcaggtgatccgcccgccttggcatcccagagtgctgggattacaggcgtgagccaccgcgcccggtcctgatttttgtattgaaacactttttaacagttccctctgtttttatacattttcttagccaggtttctaagtttcttctatatcattggaatttctaagaaacgtaagccaagtcctggattccggagaacagttacaaatgcttggaaagtgggactcgtggggcacagtggcttatgtttgtaatcccagcgctttgggaggccgaggcattgcttgaggccaggagtttaagaccagcctggggcaacacagcaagacctcatttcttaaaaaaacatgtaagtgggaccaatttgtcagaaaaatcagtggctcacataaactcacaaaagaaacaacaatagatttgaatgtataaaaacttagaacctggctgggcacggtggctcacacctgtaatcccagcagtttgggaggccgaggtgggcagatcacctgaggtcaggagttagagagcagcctcatccacatggagaaaccccatctctactaaaaatacaaaattagccaggtgtggtggcacatgcctgtaatcccagctactcgggagcctgaggcaggagaattgcttgaacccgggaggtggagattgcagtgagctgaggttgcacctttgcactccagactgggcaacaagagtgaaactccacctcaaaaaaaacaaaaacaaaacaaaacttagaacctttagaagagtatttatagtaacaattaaaaaaccaagtaattgggaagttacgatgttgtatctagaatctatacatctagatttatacaacaaacttggataccccaacaaataggtaaaagatggtccataccttgaagtacaagggagtaaacaaacatggaaagaatttgccctcatgtgtaatttcaaaaattccaagcataagactgggcatggtagcttatgcctgtaatctcagcactttgggaagtcaaggcaggaggatcgcttgagcccacgatttgactgtgttgcccaggagaccagcctgagcaacatagtgagacgttatctctactgaaagttaaaaaaattagctgagtgtggtgatcacaccactgtcctctagcctaggtaacagaacgacactctttgtctcttaaaaaaaataaaaaacaggccgggcacggtggctcacgcctgtaatcccagcactttgggaggccgaggcgggcggatcacctgaggtcaggagttcgagaccagcctgaccaacatggtgaagcctcatctctgctaaacgtacaaagttagcctcgcatggtggtgcatgcctgtaatcccagctactcaggaaggctgaggcaggagaatcacttggacccgggaggcggaggttgcggtgagccgaggttgcgccattgctctccagcctgggcaacgagagtgaaactccatctcaaaataataaaataaaataaaaaataaataaataaaaaataaaaataaaaattccaagcataaaacaaaaaactggcaacataaggaattggggaaggtgtgatagaactgcactcatgtgtgctggaggtgctttttttttttttttttgagatggagttttcactcttgttgcccaggctggagtacggtggcatgatgtcggctcactgcaacctccgcctcctgggttcaagcgattctcttgcctcagcctctggagtagctgggattactggaatgcaccactatgcctggctaatttttttgtatttttattagagacggggtttcaccattgtgcccaggctggtctcgaactcctgacctcaggtaatcctcccgcctcggcctcccaaagtggtgggattacaggtgtgagccactgtgcccagccgggagtgccctttctgtaaagtatcctgacatcaaacttttttgttctctggcccattaataccacccctgggaatttgtcccaaagaaacattttcaaagaacaaaatgaatcagtaaacccactatatgtacagagattctctgtagcattgtgaataatactggagaatatggagtcgcttaagtatccagcctttaaggaaaggctaggttagtgacgggtcagccacttgaatggacaaaggtgtgacccatacatggtataattaagtagattctgcagtgacccgagacgggtcctgtgggtgagacgtgcagaatacaagattgtacccatctaccttgtgcattcagctctcaacaaagtatgcatttctctgcacaaagcccaaggagcattaagaaaaaggattattgttcagagtgatgtggttatggaaaatcttttttatgattcccctgaaaggtggcacgcctccaggctggccagtgttacagacgtgtgctttgcagattctttttcccccaagggatgtggtaagaacataaggatggcttgaccttcccagggaagttgcagaaggaaattgtgtacatatggagggcactttaattctgcacatgtcagctgggaatcttttatggggcgataaaacagtttcttggtgatcatgtcgtgaggaacagctgcaggagtggaatcccgttgccctggaggtcaagtctttaggggtgggggctggcagaggtttgagggaagtggctttggctggctccacactactcagtcagcccaataaggggacttatggcaccctccccatcctgtcatcggacaatttgagcagaggctgggtgccctctctcagggatgctgggattgcaatggaaggaaggttgtttttctttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccaccttgcccggctaattttttgtatttttagtagagacggggtttcaccgtgttagccaggatggtcttgatctcctgacctcgtgatccgcccgcctcggcctcccaaagtgctgggattacaggcgtgagccaccgggcccggcctgtttttttttattattattattttttttgagacggagtttcgctctgtcgcccaggctggagtgcagtggcgccatcttggctcactgcaagctccgcctcccaggttcacaccattctcctgcctcagcctcccgagtagctggaactacaggtgtctgtcaccacgcccgtctaattttttttgtatttttagtagagatggagttttattgtgttagccaggatggtctcgatttcctgaccttgtgatccgcccacctcggcctcccaaagtgctgggattacagacatgagccactgcgcctggcctttttttttttttttttttttttttttttgagatcgagtttcgctctgtcacccaggctggagtgaagtggcaggatctcagctcactgcaacctccccttcccgggttcaagtcattctccttcctcagcctcccaagtagctgggattataggcaccaggcaccacacctagctaatttttcgtagttttagtagagacggggtttcaccatgttggccaggctggtctcgaactcctgacctcaggtgatccgtccgcctcggcctcccaaagtgtcggggttacaggtgtgaaccaccacacctggccagaaggttgaattttatggcttagatttgcagattctgtgtatggctgagcatgttactcacattcactgtgtctagtgacacttgcattgtccacttgagttgatagctagacctggaaatgagaacttgctactgagatagggcaggatgagggggcaggggctcagcccaggctctaacgtatccagtcagaaaagaggaggtggtcaagatctgtggtttgcaaatacaggctcagctgcctggaaatcacccgtggaagctgcaaagaacacatcttcttgggcccttcctcagaggtgggaagtcactccacctgggtggggctcaggaatgtgcttcttaaaattttgcattctgggtttgggtgttgtagctcacacctgtactctcagcactttgggaggccaaggtgggaggattgcttgagcccaggagtttgagaccagcctgggcaacatagtgagaccccaccatctctataaaaataaaaaaatttaaaaattgcactctgagcggccaggattaggaactatgacccagataggttgtagaggggacccctgtcttgctgtcccctctcatagtctctgcccaagctgattccatgttccccaaattgggtactacaaaatcctccctacccctaccagcgatcaaggggtagtcccagcctcagcatcagacgtgtaagtgattcccactttagaagggaaaagagttaaagggcccagagtccaggcaggtcttggccattgcttctgccctcccccaccctctggaaaggagaaggacctttgtgctgtcttcccgggtccctccttagagggaactgtcaaacgtttgtcggccgggcgcggtgactgacgcttgtaatcccagcactttgggaggccgaggcgggcggatcacaaggtcaggagatcgagaccatcctggctaacagggtgaaaccccgtctctactaaaaatcaaaaaacttagccgggcgtggtggtgggcgcctgtagtcccagctactcgggaggctgaggcaggagaatggcgtgaacccgggaggcagaccttgcattgagcccagatggcgccactgtactccagcccaggcgacagagcgagactccatctcaaaaaaaaaaaaaaaaaaagtttgtcatgacttgctctgaatggttgaatagttattgtggaagtggttgcgcaggtgttggggttacacagggaagtgacacacagtcgctgcctgctcctgctcacagccttgccagggaaaatggaaaagcacagagcacaacgggcacccaaatgctctcatctgtttcacccagccctggagccttagtttaaaacagcttttggtatttttttttttttttcgagataggatgttgctctctcgcccaggctggagtgcagtggttgatcccggctcactgcaacctccgcctcctgggttcaagtgattctcatgcttcagcctcctgagtagctggattatagacgtgtgccaccacgcctggctaacttttgtatttttggtagggttgaggtttcaccatgttggccaggctggtttcgaactcaccttttggttttttttttttttttttgagatggagtttcgctcttgttgcccaggctggactgcaatggtgtaatctcggctcactgcaacttctgcctcctgggttcaagtgattctcctgcctctgcctcctgagtagctgagattacaggctcctgccatcacacctggctaatttttttttttttttttttttttgagacggagtcttgctctgtctcccactctggagtgcagtggcgcaatgttggctcactgcaagctctgcctcccgggttcacgccattctcctgcctcagcctcctgagtagctgggactgcaggcgcctgccaccacgcccggctaattttttgtatttttagtagagacgggctttcaccatgttggccaggctggtcttgatctcctgacctcgtgatctgcccgcgtcggcctcccaaagtgctgggattacaggcgtgagccaccgcgcccggctacacctggctaattttagtatttttagtagagacagggtttcaccatgttggccaggctggtcttgatctcctgacctcaggtgatccatccgccttggcctcccaaagtgctgggattacaggcgtgagccaccgcacctggcctggtttcgaactctagacctcaggtggtctgcccatcttgaccttccaaagtgctggagctacaggcatgagccactgcacctggtgcttttggtaaaagcaacctggaatttgggagaaaagatcaaacgcttcatgggacatgggttatttaaattaccttggatgtcacctctggaaggtatttatcaacccatcttctcaactcctactgctgtggaagctgagaggccagaggccttgcctagtccatctcaggatggctggtatgtctaaaatgacagcctgatcatgtctcttccttcaaaaccctggggactcccagccacctgctgagtaaagtcatctcacggagcatgtgagacctgtgatcggtcccctccctggggacctcctccctggactgcccctcagtctctcctacttgctgctgcccgtgcccctccccgcagtgaaccctgactcagtgtctaaggctgtgctctattatccactcctctgggaagtctcccccttgtaccacttccccgcatccaggaagtgcttccgtggagccatgcctggctcatagtgcagtacaccatggccgtgctgtgtctggtgcccctacgtacccttgcccttgcccaggtgcctctagcatctgatgacagcctggggactaggctcctgcaaagtcaggtgcacagacaactcccatgggagcctcgagcctgacagaggtacagtgggcatccctggagcattagttgattcctggtgggcaggatcaggctcctatactgactgggaggacttttcttgtatctcctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccagcacgtttcagttccttcctccccagaaaaacactctgctttgaccttgtgctccccacaacgccacagtacctcctcgcctttgaactgttgtgtttccctgacttccaggacattgtccatagcctccttggctctgtctgctgtcaccttgccatgtcctcctcacctctctggccgctcaagtggagttactcagggcgcggtccttgggccctttctctgccctcagtttcacatgagtgggccacagccagtctgatggtgcagatgccatccacgtgactcccactgtgccaccatttcccagagcctgctggagtaaaccaccacaaactggtggcttcgagcagagcacatttcttccctcacagttctggggcccaggagcctggatttagtttcactagaccagactcatgtgtggacagggccatgctccctccagaggccatcgaggcgattcggtccttgcttcttccagctttgggggctgccacgttccagtctcagcctctgtggtcacgtggccttctctgcatgaaacttccctgtctctctcttagaaggacacttggcgatgtaatttagggcccttctggttaatctctcaggatctttcacttaatcgtatcttcaaagtctccttttttggccatatgagctgacagtcacaggttttggggattaagttgtagatgtcttcggggtctgttttttacctctgtggcccagacttcctcagctgccctcaccccctcagcctcatgctgcctgaagacctctccatctcggcgcgtggagatccagccctctccttgctcaggctgtaggtttctttcccaaggcctgccttttcctcacacagcaagtccagtctctccaggttctcccctgggactgcctcagacagccccccactgctctccctggggtctctagcagcccctacctcccttccctgctgccttctcagctctgcagctggtgtggcctctgctccaggcagatcatgtcacctctccacgcagaatcctccaggctccccatcaccctcggagcagaagcaggagttctcactggggtgccaggcccaacctggcctggtgctgccaccgctgcactctgccccactcaccctgcctcaggcctgagaacgtcctcattgctgtcagacctcccagagctcctgccctgcagttgcctctgctgaggtttagccccgttctccctcctcccctctttcctttcctccttccttccttccatcattcctccttccctccctcccatcctaccccctcctccttttccttctgtcttccttccctctatctcctcttcccatccctagttgactgtccccttctcccttagagtggccaccccttttctgcagcatccctgcccctttccctgtctgtttcccagcgcattcatgcctggcactcagctcacttttctctgtcttccatctacctcccaaggtcactgggggcctttcgcagccctctccatgctcccagacgcccttaggtgtcctgtgtcctccagctccatttcaccaacctgcctgccggactcttccctctttatcttcccaaagtactccattgcttggaatcctcctgggactccctcagggcagtggccagtttgcatagcctgagggaagaactgtgggtgcttcgacacccgctagctttgcagcatccctgaccactgctcctcacggaatctgtgctctgtggtctgtttgtacgtcctcagcagttcctccattcacctgccttggccttgctagaatatttcctcttctggaaatgcccttctcctttcccatagccttccatgaaagtcctgccaaatttcaggcttaaatatcccttcacaggatgtctgggtgttgttccaacactgcccaggtcgattctattgcagacagactggtgcttgttatttatggccccaactgtccccattagaccgtggccccgggacccctgctagcctcgtctgctgcctcagctgttagctgacaagcggccatcttccccagatgggtttgcagaggcctgctgtgcagagagagaggctgaaaatttgcatacctagggctccggccccctcgctgactgttgcttccatttcactttcagctttgatgaccatgacccagctgtgatccatgagaacgcatctcagcccgaggtgctggtccccatccggctggacatggagatcgatgggcagaagctgcgagacgccttcacctggaacatgaatggtacaaggcagtcgggcttggctgggcctggccccaacccctgtgtgttacgtgggaacagtcccctttcctgccagctgcctgtcaggcagattctggacctgacacgcaggacattggggcatagttttggagggtgtgggctctgggttcagtcctggttctgttgctgttcactgtggattgggcctgtgaactttggactctttccccatactgaggttgggtggcccaagaggcctggcatgggaggcggctgatctgcatagcatggatgatgatgacaatgccagtcagacctagttcagcccccgagccctgcacacacctgccttgggtcctgtccaccactctgcttctgctgtgtgaggctgcatgtgtgccccgtgcctctctcctcctctaactggtcatctctagacatcctcactctgtaagtcctgggtcagatgccatctcttctggctcttcctgggcttccaaagcctggacagaactcggtctttgtgcaaatgtagacagaaaggttagaaggatatgcatcccaggtgtctagactgcttatcccatctgggagggtggatcatgcatgcatttattgttttctctatttttaagtctgttagaatgtatttttattattttattttatgattactgtttttttagatcttgttgcataccagttttttttttacttagtgtctgtatcctgctgaatttttataatgaacatactatttatattcagacaaaatgcagtgaatatcatctttattttacttatttttttttttaagagacagagtcccactctgttgcccaggctggagtacagtgatactctcatagctcactgtaatcttgaactgcctgggctcaagcagtcctcctgccacagcctcccaaatagctaggaatacaggtgtgcaccactgtgccaagcgttatcatttttaaatgagtaaatgtttaaaatcatcagaatctcaccacctgaataatgttttcagttttaccttttctgtcaattccacatgcaaacatatttaacatagttgtcactatagagcaagtatcgttttatttttcttcacttatcataagtatctttctggtttctcttttttttgggaggggagatggagtctcactctgtcgcccaggctggagtgcggtggcacgatctcagctcactgcaacctccgcctcctaagttcaagcgattctcgtgcctcagcctcctgagtagctggaactacaggcgcgtgccaccatgcctggctaatttttgtatttttagtagagatagggtttcaccatgttagccaggctggtcttgaactgacctcaggtgatccgcctgccgtggcctctcacactgctgggattacaggcgtgagccactgcacccagcctctttctgatttctttaatcttcaaacagtgcagcattttctcctgggtcaaggcgcctttgtttgctaaaactccccctgctgtagacggctccacagcagataacgtagttgcagcatttttctctcagaagggatttcctaagggaggagagtatgagtggttgttgatatgtggctgccttgagctttctgaaggattaggctgcttcctttggtcatccccaggcgctcagcatggtaggcctgagtgctaggcctaccacttgctcacaccagtgccaggcctgagtccaaaggcctctgctcagccctgagaagaaggcctgagagccatgtgccgggtgcttgtcccgtaggtcccacaggtcagctggtgaggggggacgccagtgggaggagacatgggtgagggaggacactggcaagagactccgggaggttgtattgagtgtagatggggacaggtacagttcactggtcatgccccagaacagggacaggacagcccatggggaccaggccaccagtgctgcacaatgcctgttatctctgccaagctccccgtttatctctgctggcccacatcatagttatttgttaattcttttctctccctctccatttcaaccctttaaggtcaggggccttgtttttcattgccgtttttcttcttttttttgagatggagtttcactcttgttgcccaggctggtgtgcaatggcgtgatctcagctcaccacaacttccgcctcccaggttcaagtgattctcctgcctcagcctcccgagtagctgggattacaggcatgcgccaccatgcctggctaattttgtatttttagtggagacgggatttcaccatattggtcaagctggtctcaaactcctgacctcaggtgatccgcccgccttggcctcccaaagtgctgggattacaggcgtgagccaccgcgcccggctgctgtttctcttaacatagaatctagcccagcataggaacttagtgttccaattggatcagtccatgctctgtctcgttacctttctttgggcaacacatagaaagttctggtttgtttatacccccgccctgttccagaaaggatgcaaggaagcttaccataagtacactgggcccaaatgactaaagcaaatgaaaacggagtggttaggaaaaactggataaagaggaaatgttcaagttgaagagggagctcgtactcagcttttatttggtgaacgttgctgggagttgggcgtggctctgggcctttttagaaccaggcagaatgagacgtgaaaatcatttgcatactcagtgtggtcaaggttagcagcagcctgtggctctgaagaagtagaatcacacgtggtcctggaatctgagatttcctacagccctcaggaagagggcacagtatagtaaggaagaccaggatcgtccatgaactccacagtgagtttcactgggctgttcctcctaggagttctaatgtaaaatatgatgcccactgaaagtaatttagaacaaagtcttaaccagtggagaaccaaaatagtgttgttctgcgaactcttcctcagctctgggtggtatttggcatttgtaagagctgtgattcttaattggtggttagatgccatgccaaaattgttactgatttgctttgaaatttcagatcatcttaaaggtgggcatgagagtctttatcacagagggattaaatatgtgaagtagcagtacttgagtagcacgaatgaagtgtatgttcagcccaccttcagaatcaggattggccaggcgtggtggctcacgcctgtaatcccagcactttgggagggtgaggtgggaagatcacttgaggccgggagtttgagaccagcctggccatcatggtgaaaccccctctctactaaaaatataaaaattagtcggatgtggtggcacacctgtggtcccagcaacctgggaggccgaggcacaagaatcgcttgaacctgggaggcagaggttgcagttagctgagattgtggcattgcacttcaacctgggcgacagagtgagactctatctcaaaaaaaaaaaaaaaaaaaaaggaatcaggatttttctcaggtttctggtaggtgttgtgatgagtttgaggttattttctctgaaaaggacttgaagtagtgcttctctgaatcactggtgatgtatggtgtcacctggcttaacagcctgctgagggagggaagtattaaaatcctccagaaaagatgagttgcctaaccagaacacatgtggacatagatgccatcttcacccagaaggggaacaaggggatcccctcaggaagagttttggaatctgtcttggcacacaggcaaaggagtgattagggccctgagtgtctacacttggctacagaaggcaagtttttagagatttatatccacatgcttgttttgggctctaaaaaagttaaatgaggctgagcacagttgctcacgcctgaggctgaggtgggcagatcactttaccccgggagttcaagaccagcctgggtgtcacggtgaaaccccatttctacaaaaattcaccagatgtggtagcacgtgcctgtgatctcagctacttgggaggctgaggtgggaggatagcttgagcccgggaggttgaggcttcagtgagccgtgattgagccactgcactccagcctgggcaacagagtgagaccctgtctcaaaaactttttttttaaagttaaaaaaaaaaatcaaatgatagattcaggaagccaagtgaagcccaacatgattaacccaaagcaatccatgccaagacacatcataattaaacttctggaaactcaacacaaagaaaaaaatcttgagagcaatcagagaaaaaggacaacttacctgtagggaaaagacaataagaatggtggtagatttctttttttttcttttttttttttttgagatggagtcttgctctgtcgcccaggctggagtgcagtggcatgatctcggctcactgcaagctccgcctcctgggttcacgccattctcctgcctcagtctcccgagtagctgggactacaggtgcccaccaccacacccggctaattttttttttttttttttgagacggagtctgtcgctcaggctggagtacagtggtgcgatctcagttcactgcaagctccgcctcccgggttcatgccattctcctgcctcagcctcccgagtagctgggactacaggcgcctaccaccaggcccggctaattttttgtatttttttttttgaaacggagtctctgtcgcccactctggagtgcagtggcgcaatttcggctcactgcaagctccgcctcccaggttcacgccattctcctgcctcagcctcccgagcagctgggactacaggtgcccgccgccatgcccggctaattttttgtattttttagtagagacagggtttcaccgtgttagccaggatggtctcgatctcccgacctcgtgatccgcccacctcggcctcccaaagtgttgggattacaggcgtgagccacggcgcctggccaattttttgtattttttagtagagacggggtttcaccgtgttagccaggatggtctcgatctcctgacctcgtgatctgcccgcctcggcctcccaaagtgctgggattacaggcgtgagccactgcgcccggccaaatgatggtagatttctcatgagaaactggacgctagagcaagtggcaggatatttttcaagtactgaaagaaaagaactgttaatctagaatcctgtacccagtgacaatattgttcaggaatgaacgatattggacattcttttttttttttttttgagacggagtttccgctcttgttgcccaggctggagtgcagttgcacagtctcagctcatcacaacctctacctcccgggttcaagtgattctcctgcctcagcctcctgagtagctgggattacaggcatgtgccaccatacccggttaatttttgtatttttagtagagaggggtttctccatgttggtcaggctggccttgaactcccacctcaggtgatccacccaccctcggcctcctaaagtgctgggattacaggcgtgagccactgtgctcggccaattttttgtattttttagtagagatggggtttcaccgtgttagccaggatggtctcgatctcctgacctcatgatctgcccgccttggcctcccaaagtgctgggattacagacgtgagccaccgcgcccagccaaatgatggtagatttctcgtgagaaactggacgctagagcaagtggcaggatatttttcaagtactgaaagaaaagaactgttaatctagaatcctgtacccagtgacaatattgttcaggaatgaacgatattggacattctttttttttttttttttgagacggagtttctgctcttgttgcccaggctggagtgcagttgcacagtctcagctcatcacaacctctacctcccgggttcaagtgattctcctgcctcagcctcctgagtagctgggattacaggcatgtgccaccatacccggttaatttttgtatttttagtagagaggggtttctccatgttggtcaggctggccttgaactcccacctcaggtgatccacccaccctcggcctcccaaagtgctgggattacaggcgtgagccactgtgctcggccaattttttgtattttttagtagagacggggtttcactgtgttagccaggatggtctcgatctcctgacctcgtgttccgcccgccttggcctcccaaagtgctgggattataggcatgagccaccgcgcccagccgaatgatggtagatttctcatgagaaactggaggctagaagaagtggcatgatatttttcaagtactgaaagaaaagaactattaatctagaatcctgtacccagtgacaatattgttcaggaatgaacgatattggacattcttagtcaagacattcttagatgaaagaaaactaagtgctgggcggggtggctcatgcctgtaatccctgcactttgggaggccgaggcgggcggatcacgaggtcaggaattggaggccagcctgaccaacatggtgaaaccccatctctactaaaaatacaaaaacaattagccgggcgtggtggcgcatgcctataatcccagctacttgggaggctgaggcaggagtatcacttgaacccgggaggcagaggttgcagtgagcagagattgcgccattgcactccagcctgggtgacagagcgagactccaactcaaaaaaaaaaaagaaaaagtaaactatcccctgcagaccttccctaaaagagtggctaaaagaaaggaaatgattgccggcatggtggctcccacctgtaatcccagcactttgggaggccaaggcaggcggatcacaaggtcaggagtttgagaccagcctgaccaatatggtgaaaccccatctctactaaaaatacaaaaacaattagccaggcatggtggcgcacgcctgtagtcccagctactcaggaggctgaggcagaagagtcacttgaacctgggaggcggaggttgcagtgagccgagatcacgccactgcactccagcctgggcaacagagcaagactctgtctcaaaaaaaaaaaaaaaaaaaagaaagaaaggaaaagattaaagaagaaacattgagacatcaggaaggaacaaaagaaagcatgataagaaaaaatgtagataaataaaatagactttcctctcctcttgggtttaacaaattatgtttgacagttgaagcaaaaattgtaacagtatctgatacggttctaaaggtatgtagaaagatttaaggctttaaggctgggcatggtggcttatgcctgtaatcgcggcattttgggaggccgaggcaggcggatcacctgaggtcaggagttcaagaccagcctggctaacatggcaaaaccctgtctctactaaaaatacaaaaattagctgggtgtggtggcgggcgcctgtaatcccagctactcgggaacgggaagctgtggcagggataattgcttgaacccgggaggtggaggttgtgttgagctgagatgacaccattgcactccagcctgggcgacagagcaagactgtgtctcaaaaaaaaaaaaagatggataaagataaaacgttaatcaaaggaaagcaggagtgacaatgttagtatcagtaaggcagacttcaaagaaaatgaccagagacagagaaggacattaaataatggtaaaaagataagttcatcaagacatagcaatcctaaatatgtatgcagcaaacgacagagctggaaaatatgtgaaacagtatcagatagaaatcagatagaaccaaaaggagaaataaacaaattcacaatcattggagacctcagcattcctctctcaacaaccgatggaactggatggaaaatcagcaaaacgatgtaagatcaaaaacactatcgaccaacagaatctgattagcatttatagaacactccagcacagccgaatgcacattcttttcaagtgcctgagcaacatataccatataatccgtataatggatcataaaacaagttttaacaaatttaaagaattgaaaccatacagagtgtgttctccaaccacaattgactcaaatacttgtaagctaaataacagacttctaaataatctgtggttcaaagaggaagtctgtagggaaatttaaaaacatacacagacctaaatgaaaatgcagcatatcagaatttgtgggataaagctaaacagtgcaatacagattatctgtagcaccagtgcgtacattggaaaacaggaaaagctttcctcaagtcgataatctaagctctaatctcaagaaccaagagaaacaaaaccaaaggaagcagaaggaaggacatttgaagagcagaaatcaatgacattgaaaacagaaatcaaacaatagagaaaattaatgaaaactagctggttttttgaaaaattaataaaactggcaatctctagcaaggctgacaaaaagaatgtaaattatcaatatcaggaatgaaatgggatgtcaccacagaccctgcagatatcaaaaggaatactgcaaacaattctataagtttgacagcttacacaaaatggattaatttcttgcaaaacacaaagtaccacaactcatccaatgtcaaatagataatttgagttgccctataactattaaggaaacagaatttgtaatttaaaaaccccaaaaaatggccaggcacggtggctcttacctgtaatcccagctctttgggaggctgaggtgggaggattacttgaggccaggagttcaagaccagcctgggctacatagcaggatccaatctctaattaaattttaatataaaacattattttaaaaaaggaaaacaattctcccccccaaaaaaatctctgggcccatatgatttcactggagaattctgtctatcaaatgttgacgaatgagttaacaccaattctacacaatctcttccagaaaatggaagaggagaacgcacttcctgatcaattttataaagctcgtattacctagataccaaacctaaagacagtaccaaaaaaagaaaaatacagaccaatatcctttatgactaaagatgcaaaatccttagcaaaatattgcgaaatagaattcagcaatatatagaaataattatatactgtgaccaagtgggatttattgcagggatggaaggctgggtcaatatttgaagctcaatcaatgtaatccaccatattaacacactaatgaagaaaaatcacaggatcagatcagttgatacagaaaaagcattttgtagaactcaacacctgatgataaaaatgctcagaaaaataatagcaggaaacttcctccatttagtaaagagcatctatttagtacaaaaagtcctgttgctatttttttttttttttttttagacggagtattgctctgttgtctaggctggagtgcagtggcatgatctcagctcactgcaaactctgcctcctggattcacaccattctcctgcctcagcctccctgatagctgggactacaggtgccctgccaccacacccagctaactttttgtatttttagtagagacggggtttcacagtgttagccaggaatgtctcgatctcctgaccatgtgatccacccgcctcggcctcccaaagtgctgggattacaggcgtgagccacagagcctggccttctgttgctagcatttaatagtgaaaggttgcatgctttctgccagagaccaggaacaagccaaatatgtctgctgtcactattcttattcaacatagtgttggaagttctagctaatccagtaagctgagaaaaggaaataaaagacgtgtagattggaaaggaagaaataaaatcctatttgcagatgacatgattgtccatgtagaaaatcccaagggatctacagaaaacttggagaactaataactgaattccccaaggtcacaagatacaagggatacaaggtaaacatgcagaaatccattttatttctatatgccattaatgagtacctagacacaaattaaaaatacattaccatttatcatcactcaataaaaaaaggaatacttaggtataaatccaacaaaacatttacaggacttatataccaaaaactataaaacactgacgaaagtaatgaaggaagacctaaataagtagacatatcatattcatggattaaaagactcaagatgatgtcagttttccccaaattgatatacagatttaatgcaatttctgtgaaaatcccagcaagattttttttgtagataagatggttctaagatttatatggaaaggcaaagaaactaaaatagctaaagcaatttatttattattattattattattttttgagatggagttttgctcttttgcccaggctggagtgcagtggcatgatctctgctcactgtaacctccaccttctggtttcaagcgtttctcctgccttagtctcccgagtaggtgggattacaggtgcccgccaccatgcctggctaatttttgtatttttagtagagacagggttttaccatgttggccaggttggtctcaaactcctgagctcaggcagtccgcctgtctcagcctcccaaagtgctgggattacaggcatgagccaccacacccggccagcaattttgaaaaacagtaaagtgggagtaatcattctacccaatctcaaggcttactatatagctacgataatcaaggctgtgtggtattggtggagtgacataccgtgatggaacagaattgagaatccagaaacagacccacacaaacgtgccctcctgatttttacaaagatgcaaatgtgattcaatggaggaaagacagctcattcaacaaaatggcactggagcaattagacaatcataggcaagtaggctggcacagtggcttacgtctgtaatcctagcacttcgggaggctgaggtgggcagatcacctgagatcacgagttcgagaccagcctgaccaagatggagaaacctcgtctctactaaaaatacacaattagctgggcgtggtggcgcatgcctgtaaccccagctactcgggcgggtgaggcaggagaatcgcttgaacctggaaggcagaggttgctgtgagccgagatcacgctgttgcaatccatcctgggcaacaagagtgaaactctgtcccaaaaaagcaacaacaacaaaaaaggctgggcacagtggctcacgcctgtaatcccagcactttgggaggctgaggtgggcggatcacctgaggtcaggagtttgagaccagcttgaccaacgtggagaaacctcgtctctactaaaaatacaaaattagccgggcatggtggcgcatgcctgtaattccagctacttgggaggctgagtcaggagaattgcttgaacccaggaggccgaggttgctgtgagccaagatcacgccgttgcgctccagcctgggcaacaagagcaaaactccgtctcaaaaaaaaaaaaaaaaggcaaaagacaggaagagaaatttcactaaagaagttatataggtggcaaataaacattgaaaagcttttccacattgttagccttagggaaatgcagattaaaattacactgttattccacatctttaaaaagtggtgacagcatcagatgctggcgaggatgtggaggaactgggtcactcacaagctgctgatgggaatgtaaagtggctggaaaactgccctagaaaacagtttggcaatttctgttaaaaactaaacatgcggccaggcgtggtggctcacacctgtaatcccagcactttgggaggccgaggcgggcggatcacgaggtcaggagatcgagaccatcctggttaacatggtgaaaccctgtctcttctaaaaatacaaaaaattagctgggcgtggtggtggctgcttgtagtcccagctactcgggaggctgaagcaggagaatggcgtgaacccgggaggcggagcttgcagtgagccgatatagcaccactacactccatcctgggcgacagagcgagactccgtctcaaaacaaacaaacaaaaaactaaacatgcaaccagtgtaccttgagcatttatcctggagaaatgaagacatgtttatacaatagcctacacgtggatgttcatagcagctttatttataatagcgggaaactggaaatgatctagatagccttcagtgagtgaatagttaaagtgaggccccttcgtaccacagaatgtcacttggcagtaaaaggaagtgacaatctggatgaatcactggatacagatacagtcctctatcttgtcttttttggaggaaactgggcgcagtgtgcatggaatttctctgtgttgtttcttgcatctgtacatgaatctacaattacttaaaaattttaaaatgctctgggcagtgtattcactgggtgtttaccccgtgcacctgaggttcctgctgttgctgccccgcgggctgttaggatgctggtctccagcgtgtctttagggcagggaggagatagtggggctgtggtctgttaggccgacctgcttcttgatgatggaatcctactgtctgctctgagggaatttttcttggctttttcagcttattcctgcaaggcgtcttgtcagtaaggtctgggtggagcagggagagaatgttgactgagaggaccttgctgaggtctggctggccacagatggtccctgtgagctcccatctggtacaattccttttccaggatccgggatctgtagggacctccacgcttgtgaccttgttgaggccctgctgctgctactgcagtcacaggcctggaaatcgctgtggcttggcacagtgtgttttgctcacatgaggcctggtattgggccagcctctgtgccatcacatctgccaccagttcagcacagaggggagtagagagatggcacgcaagctttgatgtgcctttgctggcctcgcctggatcatctcattagttgggataatctcatgcgcccacccagctatgactggaatgaggggagtgtttatggccatgaccacccccagggcatggagcaggaggtctgtgcaggatgagggctgggggcctgctagtcatgtgcttcctccttccactcccagtttccaggaaggccacccccagtgccctggttgtcctctcctgcatccggagatgtttggcttcaaagaagaaggggtgagggaggccggtccatgcccaagcatggtgcaatctcttggcatcccttccctctcctgatttcagagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaaggtaggtgacttctcacccagcactggagccttcctggccctcagggtgggtgtcatcatggagcactgagggtacaccaaggcctcagcagaagcccgtctttgggttccatatcatctggaaagtcataacacctggctttgctccctgcaatcccccaggaagggcataggctgagttctcttagtaaagtgttatattccggacacattcagggggtgtctctgaggcactgccaggctctgagcaaagcccggaggtctagaggaggtgaaggcagctgattggctgggccaggctgagtgctccagggtggcctagtaacccaataagatgctgccttagtggccatattacaggtgaagaggtgggcacgtggagagctgagatcacctgcggaagttgcaaactggccagttgagaaatggtgaggctggcgattgggcgcaggcctgcaccctgcagagcctatagcataatccttgctgtgctgagccgccactgccagactatgccttgagggtgaggggagctttgaaaataggaagatatgagaagtaggtgaaattggcacatgtgatgaccctaaaaaggtcagtggtttggttagatctgatgctgtgcctttggcttccattttaggaaaacattgatgtataaaaataagagccatgttacaaagggttcctgaaaatagtctttggggtcgaggagcctcgggagggatgcctcctgtgactgagggatgcctctgccccgtgcaccagatggagcctgggccgacttcttcccactgtggttctccgtggcactttactaagattttggaaaataacgtgggggaatcaccagcaacttcctctgtggtcccccaagtaacaaacaactaaatatcttatcttatttagttagtcaagacagtctcactgtgtcgcccaggctggagtgcagtggcacgatcttgactcattgcaacctccacctcccgggttcaagcaattctcctgtctcagcctcctgagtagctaggattacagttgcccgccactaagccaggctaatttttgtatttttagtagagacagggtttcaccatatttgtcagtctggtctcaaactccttacctcaggtgatccacccacctcagcctcccaaagtgctgggattacaggcatgagccaccgcacctggccgaaatactttgggtgtgtgtgtgtgtgtgtgtgtgtgtcgcagtctcactctgtcgcccaggctggcttgcagtgtgcgatctcagctcactgcaagctccgcctcctgggttcacaccattctcctacctcagcctcccaagtagctgggactacaggcgcttgccaccacgcctggctaattttttgtattttttatagcagagactgggtttcaccgcgttagccaggatggtctcgatctctggacctcgtgatctgcccacctcgacctcccagagtgctgggattacaggcatgagccaccacacctggccaatactttgttttcttgattaatattttaaaattgtggtaacattcataacataaaatttaccattttaaccacttaagtgtaaattcagtggcagtatattcacatccatggctgtgtaattatcaccaccatccatctccagaattctatcatcatgtaaaactgaaactgtccatcaaacactaactccccattccccctccgcccacccctggcaagcaccattctgctttctgtctctatgaatttgactactcgaggtgtctcatttacattcctaagggaatcatgcagtatttgtccttttgtgactggcttatttcacttagcagaatgtcttcaaggttcatttatgttgcaccatgtcagaatttccttccctttttaaaatgtatttatttttagacagggtcttactctgttgcccaggctggagtgcagtggcgcagttatggctcactgcaacctctgcttcctgggctcaagtgatccacccggtgcagcctcctgagtagctgggaagctaggactaccggcacactccaccacacccgactgattttttgtattttttttgtagagatggggtttcgccatgttgcccaggctggtctcaaactcctgggctcaagccatctgcccacctgagcctcccaaagtgctgggattacaggcgtgagccactgcgcccagcctcctttcttattaaggctaaataatattctgttgtatggatctatcacatttttatttattcatccctaaatggacagacacttgggttgcttccacattttggctattgtgaataatgctgctatgaacctgggtgtgcagatatctgttggtgtccctgttttcatttattcattcattcattcattcattcatttagatggagtctcactctgttgctcaggctggagtgcagtggcgcgatcttggctcatggcactcctgcctcccaggttcaagcaatctcctgcttcagcttcctgagtagctgggattactggcacccaccaccatgcccagctaatttttttggatttttaatagagaccgggtttcactatgttggccagcctggtctcaaactccgcctcagcctcccaaactcaaatgatctgcccacctcggcctcctaaagtgctgggattataggtgtgagcccctgtgtctggcccctgctttcatttcttttgggtgtatacctagaaatggaattcctggatcgtacagtaattccatgtttagttttttgaggatccactatactgcctttctcggtggctgcacccttttatattcctaccagcaatgcgcaggggttccagtttctccacatcctcactcacacttgttagtttttcttttcttttctttttctagacagagtctcgctctgttacccaggctggagtgcagtggcatgatcttggctcactgcaacttccacctcctggattcaagcgattttcctgcttcagcctctcgaggaggagctgggactacaggcgcatgccaccacgcccggctaaattttgtacttttagtagagacggggtctcatcatattgaccaggctggtctcgaactcccgaccacaggtgatccacctgccttggcctcccaaaggattatagacgtgagccactgtgcccggccagtttgccagcatttttttgaggatttttgcatcaacattcataaggggtgtaggtctgtagttttcctttcttgtagtattttttgtctgacttaggtatcagggcaatgagttaaagaatagtttgagaaggattggtgttagctcctatttaaatgtttggtagatggccgggtgcagtggctcacgcctgtaatcccagcactttgggagaccgaggcgggcggatcacctgaggtcgggagttagagactacctgaccaacatggtgaaaccccgtctctactaaaaatacaaaaattagccgggtatggtggcacacacctgtaatcccagctactcaggaggctgaggcaagagaattgcttgagcccgggaggcggaggttgcagtgagccgagatggtgccactgcagtccagcctggctgacagtgagactctgactcagtcagtcaatcagtgtttggtagaattcaccaatgaagccatcaggtctaaggcttttctttgtcaggaagattttattattgattcagtctctttacttgttaatacctttttgagaggaatacaaatttgtttcagtttcacattatggccagctaggaggaaaagaagggacaatggtaggagagaagtggggtggggatgggagtggcagcaagcacctggcctgtgtcctgcatacggtctgctggctctggagggcagccctgagggctccactctgtgcttctctttgtcttgtaaacatgtggaggatgaggctgtgtgggctaacccacccagccacgtggttccaaatgactgggattggccacacaaggggcctcatgaagcctgactggtagcttcccttaacgtttttctcagaattgagcccattttcattgttgttgtcttgacggggcctgcagaggagccatacaggaagttgcccagcagctgtaatcctcctggggctgttccctgccccaccagaagaggcttccccagtgaccctctgacttacctgtgattcccacctgggggatggtggcagctggcaggttgagagactgtccccagccaggtgtcctgctctgccctttgggtcagaccagatgtcacagggtggacacagctggcccagggaagcctgtgttatgtgggacagactgcatttttcaggccagaggcctcctgggcaccgtgaccctgggaacagtgtcctgtcttgcccatgaggaatagaaggtcacacccagggtttcccatctataattgggactcagaagagctgggtatttctttcttccttccttttttttcatggctcactgcagccttgacctcctgggttcaagttatcctgccatcttggcctcctgagtagttggaactataagcacgtaccaccatgcctggctaatttttaaattttctgtaggaaatggagtctcggctgggcaccgtggctcatgcctgtaatcctaagactttggagagctgaggtgggcagattgcctgagctcaggagttcgagacaagcctgggcaacatggtgaaaccctgtctctactaaaaatataaaaaattagctgggcgtggtggcacgttcctgtaatcccagctactctggaggctgaggcatgagaattgcttgaacctgggaggcggaggttgcagtgagccaagattgcgccactacactccagcctgggcaacaggctcttcccatctcactgactctgtctcaaaaaaaaaaaaaagaaaaaagagaaaatggagtctcactttgttgtccaggctggtctcgaactcctgggctcaagcaactcttccaccttggcctcccaaactgctgggattacagacatgaaccactgtgcctggccagagctgggtgtttctgtaaggacgtcctttgtcttgatcctggaacatgactgaaggaaaacaagaatctttggagccatggcacatgaggaccatctctctcctcagaaagagtgccttaggttagagcagcatcttccagatattcttggcaatgctgggaccaaagcccaggcctggctgcccttgccagggcacctggcccaagtcggctttgcccagttccagcaggggttggggggcaggggaggaagctggggacatggtgctgctgcagtttgagccatcagaccctgtggcactgtccaggccccgtccggagagtgcatggggtgagatgtgagtcagggctggggaggtgggcaggggcctggccctgctgtgcacctgcttgggagtcctggccccgtcttagctctgtgagtccacctggagtccagcactcctcactaccccaccaaggccactgccagatggctcccttcctccctccccgccttccagtagaggtctcagcatggcagctcagcccatgtctcttgtctgcccaaaataccgcagaagcttcccacatccctctgtggaagccaagcctgtccaaaggcctcagggccctaactgctctctgctacagtccctcgccaccctcatctcctcccttttcccctcactgggcagatccgggtaccagaccttggctcctcagtcttttacatctctgtgtcccccacctgggactgttctcccccagggagccacattcctgctccctgggcacattcacttcttcctaaaggccaccttcctagaagccttcctggcctcctgacttctgaggccagcctggactttctccccctccctccctttcctccctggcactcccgtgctttctggcacaccacatgctcacttaacctacttagtgtctgtcagtgcccccaccagcatagctttttttttttttttttttttttttttttttttttttttttgacacagagtctcgctgtgttgcccaggctggactcaaacacctgagctccagtgatcttcccacctcagcctcccaagtaactgagactacagacatgtaccacctcacctttctcagaacagccttttgaatgtttgtctctcttgtgcctctccttggtagacacacagtctagactttggaataaatgaatgtgttagtgactgaatggcaggggacaggcaactccatccatgagcccagggcagggagggcttgctgggtgggagccatgtgcctatggtcctatggggtcctgttgggtggttccatgggctgtctgctgctgcacgttctttttggacccagcacccacgtggtttgcttggcattagattccagttgggaagggccagtgcctccgattccattcatcatcaggcgtgggcgtatgtggagatagcaaaggacatgggggcccgactgcagtccccattgcctggctgcatgccgtgtacaggacactgcagctctgccctcggcttcctccctctgcgtgaggattccttcattcccagaacaaatacaccctgcctgtgctagaattcctggaggcaaatgattcagattgtttcagacagtcctaagtgctgtgaagaaaataggagaggtgccagcatggtggcccgcacgtatagtcgcagctactcaggagactctcgggggaggatcttttgaggccagcctgggccaacacagagaggcagcagggaagcctgcggggaacagaaggctcaaccacagggtctcttctctgcccaaaacacttgatacattgcctgggccttgtagaaaccttgtctctacaaaatattagccagacatggtagtgcatgtccgtagttccagctactcaggaggctgaggcagaagggtctcttgagcccaggagttcaaggctgtagtgagtcatgatcatgccattgcactccagcctgagtgacagagtgacatcctgtctccaaagggggagaaaatggagagaagggtgtggaaaggggctgatgggaaggggagctctcaggagctggcactttagcttagaccaggatgctgagaagaggctggtcctgccaggtgaggggaagagcattctagcaagtgggtggtgatgtgcagggctcagaggcacagggctttatgaacatgatcggggattggggtaccctaatctctaaaaggaggcagaagtccccggaagggctggactccgaggcagtggtgagttttccctgcagctgcccaccctgatccttgacttaaaagctaagggccaacaatgaatgggcaggtgcactgtgacctggttgccctgtggagcactggatagcagtgagggatgaccccagccccacactctaatgggaggagtcttgcaagcatgatgcagagtgaatgaacctggaccccgaagtgtccatcctattcagaacagccacacctactcaaggggtgagaagtcaaaatggtgcctccccaggggggcaggtgtaggtgggagcccctggggtacagtctgtgttctctcagctgggtgctggcttcccaggtgtccactagtagaaaacccctgacagcacacccggggcctgggccctctggctgtgagtcacgtgctgcagggagtcctctggggaatgtggaggagctggcccagcactgtgatccctgcaggcttccctgtcccctcaccgtgttgacccagagtggggtgcatctgtgaacacgctaggcagggttttccgagaggggcaagctctgtaaagggcatagacattggctcaagacagggcttagggatgccttagctgagccctgcctttctggtgtagtcacgtaagaccgatggcagcaggagcgaagggcagaaaggaaggtccccaccagcacagggcacaggggagatgggatgaaggtaaggtgggactcaggtgcccccggggtcacttcagggcctcccgagggtgactgtgctgggccctgagccagagcccctcatggcagacagggttgtggggtcagccttgttttggggatggggaactggaaggacaaggaccacctgcagttctcagctggtggaccctggtgggcagggcccaccccaggcctggcagggccccgctcctcgcggcctccctgggctgcaaaagctctaacttgtgtcctttggttgttgcctcagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcaggtaggatcatgcatgagtctctccctccctcatctccctgcaaaactgttttgagaaagacttctctgtgtgagcggtgatacctttgaggctttctcacgcttcgcagcacaatctggctggggtctgtgtgtttgctccgtcctcctcctgccctatgtatctctccagggctccgctgtgccaggtagggttagaagcacctaacacaatagctggcaaagacttggagttctgtcagggtgaacctcaagtccttgcctccacggagccctggcctgcccccaccatccaccattcagttgtcctgccccacaccctctctctctgctcttgcccagactgttattttggtcagggtgacccctgcccagggttcttcatctgttgaacttgaattatgtcttaaacacaaaggcccgcccagcttttgagagtcaggggtccctagcagctccttcttactctagtatctctgcctttggtcagtcagagagcatttgatgagtaccatgctgggctggaccccatcctggctgccctggaagatagagacaggtcaccttgatccctgcctgtagcatttgggctggctgagatggtggaggtgtgaacagaatattccagtccagtgtcctctgtggtagggatggggatggacccgggagaggccctcctgttcctggcaggaggtgggactcagagttaaaagtgaggtcaaggcccagtgcgatggctcacacctgcagtcctagcacttcgcggagctgaggtggatcaccagaacccagtagttcaagaccagcctgggaaaaacatggtgagaccccacctctacaaaaaaaaaaaaatagaaaaaatgagccgggcatgttggtacatgcctgtagtttcagctactcaggaagctgaggtgggaggatcgcctgagctcaagaggtcgaggctgcagtgagccaagatcacaccactgcactccagcctgggtgacagagcgagaccctgtctccaaaaaaaaaaaaaaaaatagcgaggttgaactctcccggctcagcaggactctaggactgggaagccccgtggttcctcaccctgtcctctgtgttgggatggggtgggggtgcagcaagcatccctacatcaaaacaggatgttcagatttagtctgctcatcagactatcatcatccacatctgcagtcatcactcagggatgacagcttaaaatgctacatgaggagcaaataggaaggtctgttttgcaaagccatgacaattaatggagctcgttaggtttgtgtctaacttgttttcccagacatcccaagagacagctttctatgacttcccataaatctgagcaaggaagaaggaatgagagccacccacggggctcaagggcccgggcctgggaaacagctgagtccctgcctgagcgccatggtgctgagatcctgtgacctgccccccagcagccctgccagtcacatggttctgcttcacagacagggcagcccagagaggaggctggggggctggtgtctgatgcctccctgttccctcggggtgttgcctgggagtgcagctgtagcgtccattcaccctgcacagagccaagccctatggccggagagccagtcaagggtggcctccctccaccagagttgactctgaggccccgggaggcagtcatgttgcgcgcatcaacactgagcacctcctcccgcagaggctgatccagtcagaaccctcgtcttgggctcacaggtgcaggtggtaggctggctgcccccagcatccagcccctacggtgttgaccttcacctagtcctgcagccgctgccagtgcccacagtccagggtcaggaactgaagtccccggggcctcttgacaggtccttgcaacatcccttctttcagccaccatggcaccatccctcctgctctgacccgaaggtgacctgagcctaaattcctttccaagttccgggccctctgcagtttgcagagtggctccagagcagaccccctggggagtccctggtggtggcaggtcaggatttagaggcagaggcgggccccttctttatctcatcgaccacttagtgcattccagttgcagggcctgggggcatcacagaccccctgctccctgctctctcttatgctgagaatgcaggtttcaaatctttggggttaaaggcaaaggccatcccgctgggaccaaggtgagcacacgtccctatcacagcagccagatggagaggcggcctgcctggggaactgggaagtgtcctgagtgggcttttagcatcaggagggctgcgtgtgtcttcccagtccccacactggaagacagctgcaaggataggacagggccttagggttgggctgtcatccctgactccaactcgcgttccccccactgtaccaccccaccccatgggatcttaggagggacttcgtttaactctgtccccagggagaccagtgtcagtcctgcctggccctgcctggggaaaggaggctgggccactgagtccccaggtccaggggccagtcagcccacagagagctagaccaggagtcctggcctggtctctgccacacagaaagcttggcaactgctgtgtcacatgactttttgttttgttttgagatggggtctcgctctgtcgcccaggctggagtgcagtggcgtgatctcggctcactgcaagctctgcctcctgggttcacgccattctcctgcctcaggctcctgagtagatgggactacaggtgcccgccaccacgcccagctaatttttgtgtttttagtagagacggggtttcaccgtattagctaggatggtctggatctcctgaccttgtgatccacccatctcggcctcccaaagtgctgggattacaggcgtgagccaccgcgctcggccacatgacttcttaagaagggttttcaggctaggcatggtggctcacgcctgtaatcccagcactttgggaggccgaggtgggcggatcacctgaggtcaggagttagagacaggccaacatggcaaaaccccgtctctactagaagtagaaaaattagccaggtgtggtggtgggcacccgtaatcccagctactcgggaggctgaggcaggagaattgcttgaacccgtgaggcggagattgcagtgagctgagattgcaccattgtgctccagcccgacagagctagactccatctcaaaaaaaagggttttcagctctggacctaggtcactccataatggaagcactcgctgattccccaagagccagtccctccatctctcccagccagagctcagtgcctgacttccataccctcctcggcagtggggacattgattggatccatggtacagtggggcaagctgctggccacaggacatgtgtgcgcaaggccactatgcccacacctcaggggaaccagggcagagaacagcctgttccctttggcagtgggacagacaggagacaagcatgaaggggaaacaggggcatgtgacaaactggtcagaagccctaggctcctagaggacagactgggaccagagtgacacaggcgtctcagagccagtggagtgggatgaagggccagcgaaaggagggagacagggctcaaggggaaggaggctgggctaggcagagcctctgaggagagctgatcctgcgaagttactggcacctcccctgggccagccctgtgttcctggccagggacgggaggagacagtgccctgtctggcagaggaaacagattcatgtgcatgactatcagtgtgccatggccacagaaagcaccggaggctgtgggcatgaggaagggcagttgggggcatagaacctggggtgaggatggccagggcaggtgctgatgggggactgcagcaggaaggaccgagaggagaccagggacaggcaggtgcttgagaaggaaggtgggccctgtggatcaggcagggtatctgccccagggggctctgcacaccagcagtcctacacgtacagggtggggatgaaaagagactaagggtcagggagcttggtagctgggcctgcatgagggacagagaggcagtgtccctctgatggcacagcatcaggaattaggctggggtatgtcaggtacacgttgggctggttgagcgtaagcctcaggttccttccgaagctctgcccgccagccctggcctgatgtcaggttttgtttgtttttttaacagctttattgtgatataattcataaaccatacaattcacacatttagagtatatagtgcagcggtttttgatatatgcagagagctgtgtaactatcaccactgtcaattttaggactttttcatcaccccactgcaggcagtcccgttcctccccgctgtctctcagccctaggtgtccactcatccactttctatctgtagatttgcctattccgggtacttcatagaaatggaaccatctaatatgtggtcttttatgactggcttgttagcataatgttttcaaggattatccatgttgtagcatcttttatcaggacttcattcttttttatgattgaatattatctcattgcatggatataccacattttattcattcatcagcagattgacttttgggttgtttccatttttcagctattgtgagtactgctgctgagaacatttgtgtatgagtttttgtgtgaacatctgttttcaattttcttggatatatacccaggagtagaattgctgggtcacgtgacaactcagtggttagcattttgaagaatttctagactgttttccaaagtggctgcaccattttgcattcccaccagaagcgtgcgattcccgtttctctggatcctgctggcatttgctgttctctttttgatcgtagccgtctgaggaggtgtgaagtaattgtggttttgatttgcatttttctaatgactgatgatattgagcatctttgcatgtatttctggctgtttgtgtatcttctttggagaaagtgctttgctagtttcttaattgggttttattttattgttgagttgtaattgttctttatatattctacatagaagtccctcatcagatagatacatgatttgaagatattttctctcatttggaggattgccttttcactttcttgatagtgttctttgaagcacaaaagttttcattttgatgtagtccaatttatcttttttttttttttttgagacagtctcgctgtgtcaccaggctggagtgtagtgctgtgatcttggctcactgcatcctccgcctcctgagttcaagtgattctcctacctcagcctcccaagtagctgggactacaggcacctgccaccacacccagctaattttttgtttttagtagagacggggtttcaccatgttggccaggatggtctccatctcttgacctcataatccgcccgcctcggcctcccaaagtgctgggattacaggtgtgagccactgcacccggcctgtaatttatatattgttttagtttgttgctagtgcttttggtttcatatctaagaatccattgtcaatccagagtcatgttgccccagcaccatgttgaaaactgctcttcctccattgagtggacttggcacccttctaaaaatcatttgaggctcctggcggcctcggaggtgtgaattgcaaacataagggtgacaccaagttttggcatctccccttcctggtcgagtggctgtggacaggtcattttcccttgaagtctgtattttgtcatttgtaacttggggataatacttgtgtgttgcatcacatgaggtcatgaaagtgagatcacattgaaagtaaacctcaagatactcgaccggcatcagtcctggctccctctgtccctcagacgtgagcatcccctgcctgggtatctttgtccccacctggacactttgggtggtaggaaggtctggggtccctggcggcttcgaagcccgtgaaccagaattccctggaaggaatggggagcagggtggctcccagggtccccagcactctttggaactcaggacagcatctccatgcccacatgcccccaaaacccaaggcaggctagtgctggctctaggcccgttcttacatggttggtgcgagcatttcttactttagaacaaacccactggagtggaatattcccagcatcaaggggaggtaaacaaaggaccctctgggacccactcgccagctcttgtttaagaggaaaacatgttttgctcccctcgttgtgggcttggtacctttcacgtctgccctccaaggaaggctgctgggagccctcacggtgaggaatgatgtttggggtctgaggctggggtggtccctagactgctaaaccacccggtgctggccagggaccagctgtcaggagctgctgaggatgggtcagccccagagggtgggggtgccgacattgcctctggccctgcctctgcgtcaccagtacgagcttgagcttctgcgactcatgagcatggacctggtgggctgagcttcagctgtgaggggtcaggcctgctgcagggagagccagctgcagccagtgccctgcgctgtgcccacagtccctgagaccccaggctgaggagagcagcactgagcccaacctgaaacgggctcacggctactggagctgggtgtgtgctcactggtgtggatgtgcagagccgggactcgctctgcaagcaggctggtcccacaaccttgagcacccgctacagggaggctgtgagaaggtccctggcccctaggaagctccctcagtggagatgttttggctgctttaataacagtcatccttccaaagcccttcacagcaataaatgtttccatattccagatgaggtttgcagggacctgtcctctctatcagtgtccacctggcgcctcccccgagtccggcctgcccttgcttctcccagagctcatggtgtttttcagggccgcaggctggcagggtgtccttctcccaggggactgagcctagggagagccaagtggaggtgcccaagtggaggagaaaggaaaggaccacagagaggggaggggaagtgggagagtcatggttaggacctcaggctgaggccttctgccaagccaggggtctggtgtcactcaactgggaaacactgtcagcacccaaagctgctctcagaggtgggggtgacgggaccactgcatgtgggaggcacacgggccctgtggcatccacagctgtggtctccttagtgtcctgtcacagacttgcaaatcaaagcccagagaggcggcagccagccaccctcccacctccccagcactcctgtgcccaccccatgcctgtttagcctctgcccttgctgcccccttcctctgctgtgtccttttggcaagaggaaggtacctcggggcagatttgggtggtccttgtgagacccagggcagagtgtggtccggggatatggcttctgtccagctccctgccagacagctgtctgatcctaagcacagaccagcctctcgggggttttgttcagccaggaggtgggctgaggggcaagtgtgtggaacatgcaggaacaggctgtgcagtggccctcagtagtggggggctggggacttctgggagactcctttgctcccattcgccatccatcccctttccctgatcagtgggccctggctctggacactgagtggagcagacagtcctcctgcccctataggttccacctcctgactggcactgtggcatcagcatggtccagcccgtgctgtcctgtcaaggaccacctccacagccagtggccccttcctccatctcagagacagagagacgctgggcacaaaagccctgttgaaagttcactttgaagggaagcccatggggtcatggcgacaacacttgttatggaaaggccctggcgcctccagcagctcccttgaggttcaggtgactggagcatccactgggtgccagcagtgctgctgggaggagcagggcacagacaggggccaaagctttctgaggattctccatctatagctggaaaagtcattcctctcactgcctcccctcctcgtagcgagaaccctctgcccacagtggagattgccatccggaacacgggcgatgcggaccagtggtgcccactgctggagactctgacagacgctgagatggagaagaagatccgcgaccaggacaggaacacgaggtacccctggccctgtggtcctgggctctgcccacaggcacctggctttccaggcagaggcagggccattgcctttcccagtctcccatggtctctgagacagagtacctctagtgctgctagaggcaggcaggcttctgggtgataaggccccatccaaacgccagggtatgtttccctgcatggaacaaacataattcctcaggctgagggtctgaccacagcccagatccaggttttggggtccctggagtgatgagcagggcctgagtggcagacaggcgaggctgagagaaggctgggtctgaccctgctgggggcccacatcctgcctctgttcccacccctacacttggctgccctgtagagccttgggaagggcagcgcccaggctgggagctggccccgactcattgccctccccactcctcttccaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaacaggtcatgttcaatttcttcaaagttttaacataaaaataatgagagccaggagtggggccggggcctggggggacgaaggtggtatgtgaacaaggttggcacacaggcctcaccctcctctgcctcagattcccaagtgggcaggtgggggtgaatggggctccgggtagcacctcagctcctctcagctcccctcagcctgttctccttccagacccagagagctgagaagagtagctgtgaggctcagggcagaggctctctgcctttcaggaacagccctaaccctgctccccttgcttggcctcaggaaggtgccgcgagctctcctgccgtccctgggccgccctggctctgctgtgtccagatggtcaggctactgccagctggggccttgctgctctgaagtcccctgcggagggcccagtcctgtgtgggcactgctgggctgtcgccagcctgggtgcaggagggctgttctagctccagtggcacccatagccaggtcagctggggccctttcccaccccagcaggtgctgtggcctgggccagctcctgccttacaagccagctgtgaggaatatgggaatagccctcccggcctggtgccagctcttggagttgacacggtacagggaggagacacagcccagggtcccttcccagccctgcctccaaggagttcatgtcccctctgttctcatctgtaatagggaggtgtccccattcttcagaatggacacaggatctgggagggcagcaaactggctcgcagctccagccttactgaagagaatgggcccagatccgggcacagatcccagcacagactgctgccaccctcagctgttggcaggtcccatgctgccagggcagggctagggtcagaggctgctgtgctccctggaagtggggtagggccccatgtggggcagaggcagagctctgattagggattggggttcttggtcgctgagatgtgagaggagggctcctttgagcacatgttagcatgggactcttcccagggagtttgcactcagggcctctgccctccatcaaagagtggaactccccagagccccatgcacagcaaggggacagctgggccttactggaaggccttgaacaaaggggaagattcccagcccagctgctcttagacatgaacaggtttcattgctgaggtgtttgttctgtccatgaggtaggaacctcggcaatgaaagggtgaggcagccctgtgtctccacaactggggggatggaaggaaccttggctgcctcaccccacaggtcgggcagggccacctggctgggaggtgccgggaaggctgggccctcactcctgaccgccagctcacaccgccgcaaagccatctccacaaggtctggctacaacacggagggcagactcaacagagaacagtgttgttaccatgaaaatgacaacctgtctttggaggaggccccgtgccactgagcatccagaaataaaccacaacatggacaggcttagaacaacaaggaaagctgccaggtcagaagagaaaaatgagccacaggggtcagataaggctcacacacgtcctcagctaaaaagggcaggaacagaaccttccagaagtccctgcctcacccagtctcagaactctgctaaggtgaaaacttaggctctgaggtcatagaaagggcagaagacctagtcctggccctcttctgcacctgaatccatggggctttggcatcaccagatgaaaaatgaggcatacgcccacctgtcagggtggctgatgagagacaggagaggctagattggcatcagcctgaaggcaccactggcaggaacatctgtaggctggtttggcacaacctaggagaggcctgtcctggccccagcagccgaaatctggtgaacttccccgctgactggcaggtagcagaggcctatggtgggcaggacttgcccaaggccctggtggggccaggatgagaaccctga

SEQ ID NO: 16682 - DNA, 25274 bp, Human
cacacaacaaattaacaacagaaattttaacaaagtcattaaaacttgggctaagaaaaactttgtagggttcttgtagccctttaaggtctcacacaatttttctttccaagtctggataaagctgtggtggtcttttcccggatctgttgttgctgtttataactaacaaacaaatctcagttctttctcttttattattttttttgggggggaacggagtctcgctctgtcacccaggctggagtagagtggctcgatctcggctcactgccacctccacctcccgggttcaagagattctcctgcctcagcctcctgagtagctgggactacaggcgcgtgccaccacacccagctaatttttgtatttttagtagggacggggtttcgtcatgttggccaggctagtctcaaactcctgacctcaggtaatccacctgcctcggcctcccaaagtggctcccaggcgtgagccaccgcgcccagcctattctttctctttagcaatagagtcagcacgctccattacccgccagttatcttttaagagaaaatacaaggcttcaaatgcacctgtacgacatctaagagtgctctggcagagtcacacctctgcaaggttagagatgtcaaagggagtcctggtctagccagaaatgggagagtgacaaagtacaggtgcttgggtcgggtgggatggctcactcctgtgatcccagcactttgggaggccgaagtgggaggatcacttgggcccaggagttcgagaccagcctaggcaacatagtgagaccttgtctctattttttaaaaaaattaaaaaagaaaaaaaaaaaaagcggctctagcactttgggaggccgaggcaggcggatcacctgaggtcaggagttcgggaccagcctggctaacgtggtgaaaccccgtttctactaaaaatacaaaaaattagccgggcgtggtggcgggcgcctgtaatctcagctactcgggaggctgaggcaggagaatcgcttgaatcctggaggcggaggttgcagtgggccgaaatcgcgccattacactccagcctgggcaacaagagttaaaaaagaatgcctcacaaaaattcaagaaatacagcgactgcagatgggtcggtttcactacagcacaagcagcggaaaaaggacacagatcggggagaaatcaccctacaaagatgacaactgaggaatgcggagtggggactgacacacgttacggtgaaaccgtgcaccacgaccaaaggcggtcctaggactgcgactatgtgggcgcagaggccaccccccaggcttggcgggcgagtaaaggcagggctgggggcctgctcagtgtggccttagggaggaacttcgggggtctcctctctccccatcgaatccctgagcagttcccgaacagaaatcggagaccagacggtgcctgggccccagccctcccacggggactgcaccttgggcctggctcggaagcgggtcagagtctgcgaaagaccagcgaggactcttgggtttcggggcaggccgcgggcgcccacccacgccagcaccgggagccgcgcggcgactcggcgagcccggcaggcaggacaggactgcggcgcaggtctggctcaggcggaggaagcagccgccgccccagctgacggagtgcggccgggggcttcccagaggaggcggcgacgtcgagccctttcgaacgtttccacccggctagctcacgtagcctcggccccgcccggccccgcccggccccgccccacccactccggccaccgccccctccccggcctacagttcgcgggtggggcgacctgcgacagcccctttaagaggcgtggtcacgtgctccgcccccacctccgcctcgcgcgccagtaaggggtggggtgcgggaggaggtgccggggaggtggggggagcgaagtgtgcgctgctgcgcaggcgcggtggtcggacgacagaccgtgtgtttccaaaatggcggcagcgatggatgtggataccccgagcggcaccaacagcggcgcgggcaagaagcgctttgaagtgaaaaaggttgggtctcgccagcgccttcctcagggaagctagagaggcgcggatctggctggcaggcccgaggatggtcgaggcgcggagtaaagggtttcatttcagggcgttcctgggaccgggtaccacgaaaggaagccggggggcgggtcttagagttgatcggcgtgacggcggcccactgttgggggaagtgttggtttcgctgtgaggctaaggggccaatcacagagctgcttattgagatacgcggggttgcgacttggcggcgggagccaagcgcttgagctgtcactggagtggttgagaggtgggggaaggacagggtagggtggggtggggtgggtggaatggggagtcgaagcgaatgcggcggtggaggatggggcagtgcggcgagagcctggaacctgaggtcctaccgcattagaggcctctgaggaccccccttggtgatcttgctccgcccctttttgaagcttggggtcctctcacttggaggggtcctctcacttggagggatcctcgctgaaccgaggcctcacactgcctggttagagtctggagtgtaatgcttggctcttctgagacgtctgttggcttttcacacaaccaccccactcttgggttctctgtcacgtccagaatctcccccttccaaaataataataaaaagcatggtggaacttgttaagaaaatccgagcccaaatcctgtggcagttagggagggttgagtactagtcgcgaacgacttggtaagcgtgggaaagcaaaaatggaacgtgtctttttgcatgaaatgccttttagtggtttgccacagtttgggagaacagtatcgattctcacctaacatgaaagctgttcaaaatggagattctaaaatagggaagatattcctagaacatctggctaaacactgacaatatcccccgtcctagtgctttttggtgtctcattgtggccactgctgctcagttacagccagcagccatattgaaaaataatagaagtaggggcttttcctccaccttgaagctgtgatgtgaaaagtggtaaagaagttactaggcactgagaatggggtttgaaagcgaagaaggtttgggagtatttgtaattgaggaagccagagttgaatgaatgaaattctgttaaactcttactggaattattatcttaatagaagagtctaaacatataaaagttgagaacatcagtttattttatggtaagaatcaaacaaaattctagtgaattgtagaatttgttatgaagtaatctaagatttaagtgatgaccttgttctgtgtactgacacgggtatttaattatccagcttatcccatgattacccattttatgatccagtcattatcttagttcattctgttctctagctttcacttcattgctcatgcttccagagctgtgtagagcagatacttattcagattttgagctcttctgcaactgccaccaaaacctgcacagaaattcaagtttgtgccctttttttttttttttttttttttttgagatggagtctcactctgtcgcccaggctggagtgcagtggcacgatcttggctcactgcaacctccgtcccccagattcaagcgattctcctgcctcagcttcccaaacagctggtattatagacacccgccaccaggcctggctaatttttgtatttttagtaaagataggattttgccatgttggccaggctggtcttgaactcctgacctcagtgatcggcccgcctcggcctcccaaaatgctaggactataggcgtgagccactgcacccggccagactaaattattttaaactataggaaacaaattaaaagatgacattaatttctgtgttcatatactcagccttttggagaatagaacatacgtgtagtctactgttgtctttggtataataagattaacgtaatatccaaaaacttttgtttggtggttccctgtggccaaagagatgataactgcagctgcagcctgaggtcctaaagagtatgtgtgtgtgttacaagcagaatgcactgttccctctttttgtctttgcagtggaatgcagtagccctctgggcctgggatattgtggttgataactgtgccatctgcaggaaccacattatggatctttgtaagtaattggaggaggatgggaggaagttgagaaggttgcagagattgtggctatcttgatgtgactgattttcttcttcacacgaggagatagcaagcctactctgagcactcggtcttctgtatctagtctgttggtgtgtttgaaatagagtagtttttttatgatgtcctggaggcatacccagctctcagaataaatctactcaatctaaagatggcagggacacatttagaattaattgtggacgacaggcactgttgatttttcctgcatatcttccatcttgtacctagactcaaaggtagaaatagtgaaaggaggaaaataaactttgagctaaaatattctgaggccaagcgcagtggctcatgcttgtaatcccagcactttgggaggccaaggcgggcagatcatttgaggccaggagttgaccaacctggccaacatggtgaaaccctgtctctactaaaaatacaaaaattagctgggcgtactggtgcatgtctgtaatcccagctacttggcaggctgaggcaggagaattgcttgaacctgggaggcagaggtggcagtgagccgagatcacaccactgcactacaacctgggcgacacagcaagactcaaagtctcaaaaaaaaaaaaaagtctatctgatctaatttttgctggtcattgtttacaaaggaaagaagcgttaaggagtgaggattttgtatgttaggcccaaacataataaaaaggaaatcattgccaacatctaaataaataattaattgcactaaagaaatttcatttaaatctccacatattttattacatgtagtggtcagcacatagtgatctgattatagtctttgatgaactgatttcctgtccttacagtagaagggacaagaatgttgatcacaccaggaacagttgaggttactttttcatccgggaactaaaatgatttgttactgaggccagaaatggaggaaagaaactttaagtttctagaaatggaattataggaacttatttttcagatcactcacctgcctttacaactttgtcttgagtcactcctgctcactctgttagtttacctggatgcttttttttttttttaactgaccacggtggccaaagcagccatggccccggccagttttccattttttttccttattctgagatggagtcgcccaggttggagtgcagtggcgtgatctcagctcactgcaacctccgcctcccgagttcaagtgattctcctgcctcagcctcctcaatagctgggattacaggcacctgccaccacacccagctaatttttgtatttttagtagagacacagttttaccgtgttggccaggctggcctcgaactcctgacctcgggtgatccgcgtgcctctgcctcccaaagtgttgggattacaagcataagccaccatgcccggcctgcttttccattcttaagtgtccatgctctattttagagcccttaaatagcctagtcttttttgcctagaatattcttcacctcttctcttccttggttttgtctaacccagcactgtccaatctgaatgtaagccagtacaaacacgtatataattttaaattttctttttcctttttttttttttttgtttttttcagagacgggatctcgctttgttgcccaggctggtctcgaactggcttcaagtgatcctcccactttggccttccaaaatgttgcgattataggcgtgagccactgtggctggcctgaaattttctagtatccacattcataaagtaaaaagaaaataaaaaggtgaaattaatgtattttatttaaccttatatagtcaaaatagttttacttcaacatgtaattgatgtaaaaaaaaaatgagatattttacattctgtctttgtactatctttgaaattctgtgtattttacacttacagcacatctggattcagactagccacatttcaagtgctcagtagtcacatgtggttaataactactttattgtgcaatgtaagactaacccatagttgagctttagatcttatcttaaacttgctcagatgttttcaacttgaaaagcacgaatcaaatattttctgttggaaagcagtcatggcttatactggtcatgtattgcccttggcttctttgagctttgacactgtttatctcttcacactacagccaaggaagatcagcacctaccataatgtttaatatagatgccgtgaacccatcacagaaaaacatatgcagggtttcaaatgtgtttgggtggggtctttgattacatgcttgccagtttctcggccttgcattttcacaaggagttatacccagagaaaattttactttcttggggctctgttttgaaaatagttaatgatttttaatgattttatataaccctgatttttttttctctatatttaagtcagtgtatatgtgtctctggatatgagagaatgtacttcttaaaaggaccacagaagacaaaggcgatctatattgtcttctcttagagtgaaatgcttgagacatcatattaggctttcagtgggatacctgttttgtttcataatatattttgaatgtcagatgaagtaggatattgaaatcctataacaaaaacttatgaaagtattttctaagtcctatcttttatttatccaatgaatatatcctgagcatcctggtaggcaccaggataaaacaatgagtgagatcgggcaggtctttaccttttttttttttttttttttaaagacagagtctctgtcgctcaggctggagttcaagtgattctcctgcgtcagcctcccaagtagctgggactacaggtgtgggccacctcacccggctcattttttgtatttttatgagagacagggtttcaccatgttggccaggctggtctcaaactcctgacctcaggtgatccattcgccttggcctctcaaaccgctgggattacagacatgacccattcaaactcctggcctcaaaaaaaccaccccccttggcctcccaaagtgccgggattataggtgtgagccaccatgtccgacctcaagtctttacctttaagaaacacactcttaggccaggcgtggtggcttacacctgtaatcccagcactttgggaggccaaggcgggcagatcacaaggtccagagatcgagaccatcctggctaacaaggtgaaaccccgtctccactaaaaatacaaaaaattagctgggtgcgatggcgggcgcctgtagtcccagctacttgagaggctgaggcaggagaatggcgtgaacccaggaggcggaggttgcagtgagctgagatcgcgccattgcactccagcctgggtgacagagtgagactccatctcaacaacaacaaaaaaaagaaacatactcttaggcggggcgcggtggctcatgcctgtaatcccagcactttgggaggctgaggcggggggatcatgaggtcaggagatccagaccatcctggccaacacagtgaaaccccatctctactaaaaatacaaaattagccaggcgtggtagcacgcacctgtaatcccagctacatgggaggctgaggcaggagaatcacttgaacctgggaggcagaggttgcagtgagccgagatcctgccattgcactccatcctggacaaaaagagcaaaactctgtctcaaaaaaaaagacactcttggccaggtgaggtgggtcacacctgtaaacccaagactttgggtggctgaggcgggcagatcgcttgagcctaggagttcaagaccagcctgggcaacatggcgaaaccctgtctctacaaaaaattagccaggcatggtggcttatgcctgtggtcccagctacttgggaggctgaggtgggaagatcccttgagcccgggaggcagaggtgacagtgagtcaagattttgccactgcactccagcctaggtgagagagtgagaccctatctcaaaaagagaaacactgtttattttttatttttatgtatttttttgttagagacagggtctcactcaagtgcccaggctggagcgcagtggcacagtcatagctcactgcagccttgacctgggatcaagcagtcctcctacctcagcctctaagtagctgggaccacagacgtgcactaccacacctagctaattttttttttttggaggcggagtctcacactgtcacccagctggagtgcagtggcacgatctcggcttactgcagtctccaccttctgggttcaaacaattctcctgcctcagcttcccgagtagctgggattacaggtacccgccaccacacctggctaattttttgtatttttagtagaaatggggtttcactatgttggccaggctggtctcgagctcctgacctcatgatcacccatctcggcccccaaagtgctgggattacaggtgtgagccaccgcatctagctgctaattttttaattttttgtagagattgggtcttgctgtgttgtccaggcttgtcttgaactcctggactcaagcaatcctcctgccttgcccttccaaaacactgagcttacaggtgtgagccactgcccctggccacacacttttattatagacactgaggagaagtctgagtgccataacttaaaaaaaaaaaaaggatttatatgggaaaagaacttagcaagtaaagaaaaaaatggatttatcatttttataaagacaatttttgttaaagatgaaagtaagaatctagatttagcaacggttgtattttaataaatcttgtctgaccttaaatgagtaattatatacatagctctaagtaaataagaatgattatggctgtgccctagtcggattctgaagacttcctcttttaagtccatattgattctgcatgccctcctgtacctttgtatttattttattttacactgtctccttccttggttgtattaaggagttgctgaaaaatcaaatatgtgaggttttattttctctattacctctggtaatcttattcctgatgatggggaatcttcatcatcttagacccagccttggcccagaagatgttagcatctacctaaaactacagatccatcagtattttggtttggtttggtttggtttggtttggtttggtttggtttggtttggtttgtttgagacagagtcttgctctgttgcctcggctggagtgcagtggcatgatctcggtgcactgcaacctctgcctcccaggttcaagctattctcctgcctcagcctcctgagcagctgagactgcaggtatgcaccagcatgcccagctaatttttgtatttttagtagaaacagggtttcaccatgttggccagtctggtctctttaactcctgacctcgagtgatccacccggctcggcctcccaaagtgctgggattacaggcgtgagccaccacgcccggccccgtcagtgttttgaaagtgtaatctgtctactcttgagatgaagccattgcttccttaacagttctttggtggtacagcgtttttatcaaagcttaaaggtccccaagctttataaatcacatgataggcttctgccttggcaggggtgtgacatgaacccgttatgtgccactgtcaacctgttctgggttgacagtgaacagttcctgcccgtttaaactaactggactcaacccctgtacttactctctgcaacaaaagctggaaaacttttgtattgagcacattttacactaatatttaatcattttccctgctatatcccttcttatttggtactctagattgcagtaatatccctcctatacatttttgttctttgttaggaattttgtagtaaagaatgaatctggccgggctcggtggctcacgcctataatcccagtactttgggaggccaggacgcgtggatcgtgtgaggccagaagtgcaagaccagcctgggcaacgtggggaaaccccatctctactaaaaatacaaaaaatagccaggcatggtggcgcatgcctgtagtcccagctacttgggaggctgaggcgggagaatcacttgaacctgggagacagaggttgcagtgagccaagattgcaccagtgccctccggcctggggggacaaagctagactctgtctaaaagaaaaaaaggaatgaatcttggtcggatgcagtggctcacgcctgtaatctcagcaccatgggaggccgaggcaggcagatcacttgaggtcaggagttaaagaccagcctggccaacatggtgaaaccccgtctctactaaaaatacaaaaaattagcttggtatggtagtgcacacctgtaatccctgctacttgggaggctgaggtgagagaatagctggaacccgggaggtggaggttgcagtgtggagattgtgccactgcccttcagcctgggcaacagagcgagactgtctaaaaaaaaaagaatgaatctgtatttgtcccgtatttcttctatttatagaaatagtttttgtttgcttgttcaagtaccaagagcctaatttgcacttggcatagaaagaccaggtccctgctctgtgggagctttgagttgagggggaaggagggaggtcaggtatgtaaagagatactcataattgatgtgttaagagtgcctgaaggagaggaaaatgactcagggtggaagagtcaggaaaagcttcagtcaagaagtagggatttaagctgggtcttgaagggtggggaggacttgagagtgataggaggaggagcatgttccaggtatggcagggacgaaggaaaggactctaccgtgaagggagcctgaagggttctttaggttagtagtgccatggccacagtcaaaagaaagacccagatcaaatttaaacacgataatgtaccttgaaacagttttgattttcactttaataattgtggctcttatttagctaattttataatacatagtcttcctctaagttagaggatccagcttaaaggacatcatatttacttttctctgccattcttttaattatagtagtgtattccagtttcaataagttcttaaatacactgcatagaccctagatcccttttttgtttgtttttaagatggagtctcgctctttcacccagggtagagtgcagtggcgcgatcccagctcactgcaacctctgcctgccaggttccagcgattctcctgcctcagcctctctagtagctgggattataggcatgcgccacccaccacacccggttaattgtttgtatttttagaagagacagagtttcgccatgttggccaggctggtctcgaactcctgacctcagatgatctgcctgcctcgacttcccaaagtgctgggattacagacatgagccaccacgcccggccgagccaccgtgcctggcctttttttttttttttttttttttgataacaaggttttgctctgtcacctaggctggagtgcagtggtacgatcatggtgcactgcagcctcaaccgcctgtgctcaagccattctcctgcctcagcctccttagtagctgggaccacaggcatgtgctaccacaactggctaatttttttatttctagagatgagatgttgctgtgttgcccagcctggtcttgaattcgtgggctaaagtgatcctgctgccttggcctcccaaagtgctgggattacaggtgtgagcgactgtgcctgacccaattctttatttttattttattttattatttttatttttattttttgagacagagtctcgctctgttacccaggctggagcgcagtggtgcgatcttggctcactgcaagctccgcctcccgggttcacaccattctcctgcctcagcctcctgagtagctgggactacaggtgcccgccaccacgcctggctaatttttaaatatttttagtagaaaccatgttagccaggatgggctcgatctcctgacctcgtgacccacccgcctcagcctcccaaaacgctgggattataggcgtgagccaccgggcctggccccaattctttatttttatcagttggcaaaccaagttactctgtagtgtgaatctggctagcaaaagtaagtgctttgctttctctgtgtgtgtgtgtgtgtgtgtcagccttactctgtcacccaggctggaatgcagtggtgtgatctcggctcactgcagcctctgcctcctgggttcaagtgattctcctgcctcagcctcctgagtagctgggattacagatatccaccaccatgcctggctaatttttgccttcttagtagagagggggttttgccatgtttgccaggctggtctcgaaccctgacatcaagtgatccgtcaccctcgtccttccaaagcattgggattgcaggcgtgagccactactcccagccttttatggtttgtttgtttgtttgtttgttttttgagacagagtcttgctcttttgcccaggctggagtacagtggtgtgcaacttcggctcactgcaacctctgccccttgggttcaagcaattctcctacctcagcctcccaagtaactgggattgcagacatgtaccaccatgcaccactaacttttgtatttttagtagagattgggttttgccgtgttggtcaggctggtctcgaattcctgacttcagcctctcatagtgctggcattacaggtgtgagccaacatgcccggcccactttccacattttcgaagagtgaaaagaaaaaggtattatcatggtatctcttcccctaaaaccacacatgcccattaacatctagttttgttttttttaatagttttacttttttttttttttttttgagacagagtctcactgtgtcacccaggctggagtgcagtggcgcagtcttggctcactgcaacctctgcctcccggattcaagcaattcttctgcctcagcctcctgaatagctgggactacaggcgcccaccaccacacacacctggctaatttttatttatttttttatttttatttttatttatttattttttgagacggagtcttgcactgtcgcccaggctccagtgcagtgatgcaatcttggctcactgcaagctccgcctcctgggttcaagcaattctcctgcctcagcctcctgagtagctgggactacaggcacccgccaccacgcccagctaattttttttttttttttttagtagagacggggtttcactatgttggccaggatggtctcaaagtcctgacctcatgatgtgcctgcctcggcctcccaaagtgctgagattacaggagtgagccatcgcgcctggcctactcctggctagtttttcatatttttagtagagacaggtttcaccatgttgggtgggctagtcttgaactcctgacctcgtgatccgcctgcctcagcctcccaaagtgctgggattacaggtgtgagccaccacgcccagccatagttttactatttttcacctgtagtagtttgaagtaattctcccctattaaatagtttctcctgaagctttttattcttcagaagggagactccatttagttactatgatcagagaaagcaagttatgcattagtaattcttgttctgtgaatatttatccccagttgtgctttacccatcagatcttgatctcagtcaagaactcattgcaggccaggtgcggtggctcatgcctgtaatcccagcactttgggaggctgaggtgggcggatcacctgaggtcaggagtttgagaccagcctggccaacacggagaaaccccatctctactaaaaatacaaaattagccaggcatggtggtgtgcgcctgttaattccagctacttgggagtctgagacacgagaatcgcttgaactcggggggcggaggttgcagtgagccaagattgtgctattgcacttcagcctgggcaacaagagggaaactccatctcaaaaggaaaaaaactcagtctaggcaacatggtgaaactccatctctacaaaaaatacaaacaattagctggtgtggtggcacgcacctgtagtcccagctactcaggaggctgagggagaatcacctaagcccaggaagtcaaggctgcagtgagccatgctcatgccactgcactgtagcctgggcaacgggagtgagatgtgcatttcccatttgttactctttttaaacaaggataggaaatcgtcagaaagcatactgttatctctgtcttctctgttcttcctttcccacattcattaaaaaacaattatggctaattaaccacttgagaattgttttggctgctatagattgaaacgttgctgctcccaaggtccagtgatcctgttgctcttgttcccacaggcatagaatgtcaagctaaccaggcgtccgctacttcagaagagtgtactgtcgcatggggagtctgtaacgtaaggaagcatctttacctgtcagcatggcttgtaaacatatttccacttttcctgctttgctagtcttgaaaataactagggaaaaaaatgactagtccacctttctcccaaaaggtatacaaatagtaaaaaagattttaaatcataatactattcacctgttacagggtaaaaattacagttactgcaaagaggcacttatttgtcttaattataaagtggacccaattttgttagcagtattttggggcttcatctatgggaattgccttcaaaacctacatgcaccctttggaatattctcgtggtagaactttgtacctttgaaacaggcttttttaaagaccaggtgtctaatggaactaagtttgatgagtaaattgagtgttgaagtctctgtgtatgtgtgttttaagtgtggcgtatgtactgagataagattattttttaacatggcttatgccagaaatgttttgtgtagctttattggactgaatggccttccaagagtgtgacagctgtgaaggataacaaatatcaaatatgttagttctagcatgtgttaaaaattcattctttaagctgtaaagtcccagtcacatgagctaaaattgtcttgtcagggcctcctgtgtcatggggacagaatactcacagttcccagcatgacacagggataagagattctagagtcagaccaccattccctgtctttgtgacttacttgctaagtgacgttaggcaaggcatttaacgtctccaatcctgggttccctcataaaatggggctgatagtggaccacataaaattgtaatccggattagatgatttatgttaaaatgtgattaaacaactcccggcacatagtaagcacaagtgcttgttaaaaaaaatctaaataggccggacgcggtggctcacgcctgtaatcccagcactctgggaggccgaggcgggtgcatcatgaggtcagcagatggagacatcctggctaacacagtgaaaccccgtctctactaaaaatacaaaaaattagccgggtgtggtggcaggcgcctgtagtcccagctactcgggaggctgaggcaggagaatggcgtgaacctgggaggtggagcttgtagtgagccgagaccacaccactgcactccagcctgggtgacaaagtgagactctgtctcaaaaaaaaaaaaatctaaataaatacaaatttgaggtagaggtgttactgtgtagatggtgttctcagtagtttttcctgttgggttgcaactctttttcctacctacactggttttttgtttttttttttgttttttgttttttgttttttttttgagacggagtctcactatgtggcccaggctggagcgcagtgacgcagtcccggcttactgcaacctttatctcctgggttcaagtgattgtcctgcttcagccttccgagtagctgggattacaggtgtgtaccaccacacccagctaatttttgtatttttagtagagatggggtttcgccatgttggccaggctggtcttaaactcctgaccttggggcgatctgccagcctcggcctcccaaagtgctgggattacaggcgtgagccaccgtgcccagcccctacccgcactttcgggtacaccttcttccatctttgttgggaccctttggccaggctcacaatagaccatgttggccatgggggagctttaatcgttcatggggataaaggaagtatattgggctctttgccctttctggcatacagacatatactaagaaccatgttcctttatgtggaaagaaaagagagtgaacatccccttaaatttggctaaggagagattctctgagagagcctgccgtagaagagagccagcatggtgtggcagaaggctctggattagtcctgggttctagttctgggtcttctacaaaccagctccatgaattaggcaagtcacttgtctgggtttcagtttcctgtctgtaaaatgaagataaaaatatctgtcatgcttgcctgccagggttgatgtgaggcctcaaatgaggtaatacatgtcaacatcttctgtaaactgtcaagtactataaatttatcttctgtaaattgtactttgaccgctaaatatatccattaatacatcttagtaaatgttcaggggtgctgtcacctccctgacacctcctttacagcccccttttccccagcgcgtggtatgctctgacttagttgggctctaccaggacaccgtactgctgcaaagtgctcagtgggtgaggtgggagagggagaagctgtcgaatacccttcggtgagcccgaccccaacacctgatggttaagaaaaatgtctctgctttctgccttttggaaattttgctctttctctttttcacagtgagttatacaagagtcagctgaaaagggatcttccaaaaggctgtcactctaagagaatatttgtcctcttgggtatccctagtgtactagctgtggattccactcttagttactgaattatatttttgtctttgtcaaaaaacatttcacaagataataatccatattatataatcccttaagttccatacatactttgggagacgtaccgaccagatttcagttgttattaaatgaagcttgtaaagcttttgttgttttgttagggtgagtaatttctgcccgtgccccaccacagtgcaccaatcacagacgaaatgaaggaagcacttgctgcgtctgtcctaatacgcacatgagcagggggagaagtgctcattgcagaagcattgtgattagcatctgcatgtcatgagcccacgccaaaaaactgcatgcagattgtccttttcccaaatctaagcagacttctagctccctgtcagttaccagtgttcttgatactcttgtctttttacttcttgtcttgattatgaaataagccttttgatgctctttaggctgcttgtgtgccgtttgtccctcataagaatacttccttttaccccaattttcttttatctcattccctaagacaaagtccctcacccattaaaggcacgtgaagtactgagctcttgtaatatcaatatgtctgtgaataaatctagaaataaagtttctttgaccagagctgagctgggtgtggggaggttggggaagtgcccgtctcagttctgggtgggcggcagtgaccatgcacttctctaccaagggctggggagaaggctctgctcctacaggtcgcattctccaggggcaggagggtgggagggaagctagagacccagaatggggatatttgaaatctgcattgatgaggggcctcctttcccaaagaaagtggaagtatccccttacaggctgaatgggaccaaggagccacattccacgttctcttaaatagaagagagctcagtgctggcacatactcctgtgcttcctgaatgatttcctttagtagtaatgacatttctaacaaatgctttgttggaaatacccttgcatctaaccaagatataatcagttgttgaacttttgcctctcgttgtcttcttttcttttcttgcccactatatgtcacccatgccactaccctgtgggacctgttgtcgctcgatggctgagcctgcatagagttatttttaataaaatatatgttttctttcagcatgcttttcacttccactgcatctctcgctggctcaaaacacgacaggtgtgtccattggacaacagagagtgggaattccaaaagtaggtatctttggttgttttgacggggctttttgacttgcctcaggctgaaaggagcgtggtcttgggggatggagacatgatacatgccttgttttttttaaaactagtttttggttacttaagctaggacttatctatatggaaaatgcacaaaggattagccaacattagacatttgcagcctagggtttcccaacctttttttttttttttttttttttgagacggagtctcgctttgttgcccaggctggagtgcagtggtgctatcttggctcactgcaacgtccacctcccagattcaagcgatcctcccacctcagcctagcaagtggctgggattacaagtgtgtgccaccatgcacagctaatttttgtatttttcgtagagattgggtttcaccatgttggccaggctggtcttgaactcctgatctcaactgatctgcctgcctcggtctcccaaagtgctgggattacaggtgtgagccaccgtgcccggcaggtttcccaaccttctacggtctgtgaaagtagaaaatgtgataatctatgaactcttaaatatttccagaattacatcctaatgaggctccatggactacctaatgtcaggtagctttgggctagacttgtatccacttatcatatttcactggtttatttcacagtgattaattctgatatagcatttatggctatcctgattagattttattgttatataaataaaacatgacctggtaaacttttaaaaatttaaatggttgaaagggtataccacagaatatgaatttcccactgtaggcccctgctccggcttgctggagctagccatcagcaacaggacagcttcttaggagattttctgactatctcttatatgtcccggtatttacatggttgtgtgtatatatatatttttgttaacataaaagtgagtatcctatacagtaattcaccttttttttttttttcattttgtacattttggagattttccatttccacaaataacaaactacctcatttctaatggttgcagagtatttctttatgtaaatgtaccttaacttttttcttttctttttttatttgtttgcatgtttttaacattttttatattttttaaaaagtcagtccctggccaggcacggtggctcacgcctgtaatcccagcactttgggaggccgaggcaggcggatcacctgaggttgggtgttcaaggccagcctggccaacatggagaaaccccgtctctactaaaaatgcaaaatcagctgggcgtgggggcacatacctgtaatcccagctacttgggaggctgaggcaggagaatacttgaacccaggaggcggagattgtggtgggctgagatcgcaccatcgcactccaacaagagcgaaactccatctcaaaaaacaaagtcagtccctattggtggacatttgtgtttccagtttttcactgatgcaagcaatgtgaagggagaaacatccttatacatgaagctttgtgtaaatgtgtagctgtatctggagcagtaattcctaaaagaggaatttatgggtaaagagtatggctgggcttggtggctcacacctgtgatcccaacactttaggaggccaaggtgggcagattgcttgagtccactagttcgagaccagcctggtaacatgttgaaaccccatctctaccaaaaaatagtaaattaggccatgcctgatggctcatgcctgtaatcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgcagtgagcagagatcgtgccactgcactccagtctaaatgacagagtgagaccctatctcaaaaaaaaaaaaaagaaagaaaattagctggatgtggtgccatgcacttgtagtcccagctgctctggaggctgaggtgggaggatcgcttgagcccaggaggcggaggttgcagtaagctgagatcatgccactgcactccagcctaggtaatagacccaatttaaaaaaaaaaaaaaaaaaaagcccaggtgtagttgctcacacctgtcatcctagcactttaggaggctgaggtgggtggatcacctgaggtcaggagttcaagaccagcctggccaacatggtgaaaccccctctctactaaaaatacaaaaattagccaggcatggtggtgcctataatcccagctatttgggaggctgaggcaggagaatcatctcttgaacccgggagcccagaggtttcagtgagctgagatcacgccacatcagccggggcaaaagagcaaaacttcgtctcaaaaaaaaaaaaaaaggaatgtatatttttgtttttgataaatagtgtcaggttttccatttctaagaatacacactaatttatactccctccaaacagtgaagcagaactcccctttcttcatttcctgccagtgcttcattatacagtttttccatcttagccactctgataggtgacaatcagtattcgattttcatttttgaattttcagtaagattgggcaattgttcatgtttttatatctcttacgcttttctgtgaactgctgtgtttatcttcctgcacgttgctttattttgaattattggtcattttctttactgaattttttacgggaaaggagtttcttaatttaaatacgtctttattaggctattcttgggtttaaaaaaaccaaaaaataggattcttttgtttgtgaaatgtttagaaatccattattggtgcagtgattttgcctttaaattcaataatttattttggtaaaacatttggaagtcttatcaatgcgtattcagtttttaagaaacctgccaaatactcagtatctgagtggtactgttgggctcccttcagcaaaatatatgctaagtaccgtgtaaaatataaaaacatttgagacggtccttcctgcccttggagcttgcattctacagggaaccataacaggaatacatgtcaaggcagaggacttttcatagttttcagggggcctttgtaattggctctgccctacagcaggctcaaggttccattttagaccagaatggtctcgttttgccagtacatgtgcccagggctaaatctaagaattgcgggggtatgaagaattccttatctggggctttgactctgccactctaactggtgactttcccaggtggtagttatcagtgctttgggaaaacaaattcttcagctttctttaatctgatacgattgttctacagcccatctcacatgctagagcctaacctatgtggaatttggcacaacagctttttaaagacaatattcaagtagatttcttatgagaagctgtgatccagagttccagtgccctagtttctatccaaataacaaattattttaatcaggttaactgcctaaaaagatccaggacaaaagataataatgagggatcttgtgttcaagaaatctgtttatatgtggaagaaattccttggctttatttatttttatttatatatatattttttgagacagagtctcactgtgtcacctaggctggagtgcagtggttgtgatctcggttcactgcaacctccaactcccgggttgaagcagttctcttgcctcagtctcctgagtagctgggattacaggcacctgccaccacgcccagctaatttttgtatttttagtagagacggggtttcaccatgttggccaggctggttttgaactcctgacctcaggtgatctgcccacctcagccccccaaagtgctgggattacaggagtgagccactgcacccggcccccgttaatttttataatcttcttagagccaaattttggtttctggggaaagcagaaacctccaaaatccacgcctagcttctcttctctttgtatagaactgactgtaatcagagttgtaattggagctgatgacagattttgaaattgaaggctgatcaattgctattctcattattagctttaccctaaacatgcctgagtactggagttcaggtgaaaataggccgccatgatcagggcagcccgaaagttcaaactgtctgagcccctgttgggagtgagcaggcggagctccctttcacaaccaccaatgacttttccctctcacctccctaataccaccaggcagctactggcacctgtcaggtgggcatggttgagtcagagggagagcctgtccctaagagggggcagtaggcaagaagtcctgtaagatggggaggggaaaggggaatcacagcgacagccaagctagtgtcagtgtcgtcacctaatcctggagcacactgtgatcacttaggttctaactaaagttgcttatgtgtttaagcaggttttatgtctcaaacaggaaattatcttggaattaatcagagtaatttactttgtctttcaggtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacggatgctctctcttgtgtatgtgaacaaagtgaacataaatgaagagtctccccttccaaggctgaaaactcagcttttgaaagtgaaatgtttgttcatcggggccagagcagggttgtcctctgagcgcatcacttagtgacgaggaatccaacagctcaaggcagagtgtggatcaccggctcccgaaaacagcagtcagcccttctttctcctgtgtgacagcagtgggcagctgaaagagggaagaatgtgggattcagtcatcaaacccagttctgagtcctggttccacagcttgggtactgatggcaatcttggccaagttgtctctctactctgaactttcctcctctgtactgtgggcttctgaggactaagtggcatcatgtgggcacagagagaagctttgtaaaatgtaaaaccgctatacaaatgtgacctttggttgtgtatgacagcagtccccaacctttttgccaccagggattggtttcatggaagacgatttttccatggaccgggggtggggcgggggtgtgcttggggatggttttggaactgttccacctgagatcatgaggcagtagatggaccgcgcaacctagatccctcacatgcacggttcgccaatagggttgaagctcctatgagaatctaacgctgccgctgatgtgacaggcagagctcaggcggtaatgctcggtcaccaccctgctcacctcttgctgtacagccgggttcctagcaggccatggactggcatccactccgcagctcaagggttagggaagcctggtgtatgacatgttgctttctcttcttagcttagaaaaataaagatatatataatcttggctggcaaagggacaatttaagaactcaagttaaaaattgatattggctgggtatggtggctcatgcctataatcaggcgattacaaggtgaggagtttgagatcagcctgaccaacatggtgaaaccccgtctctactaaaaataaaaaaattagccaggcgtggtggtgtgcgcctgtaatctgagctactcaggaggctgaggaggagaatcccttgaacctgggaggcggaggttgcagtcagccgagatcgcgccattgcactccagcctgggcaacaagagcgaaactccgtctcaaagaaaaaaaaaaaaatcttgggagatggaaagaattgtcagttctaatactaattcaatggttaataatatagactttttaactgagaagcaacatagtttgttgcagtggttctcaaagtatcatctgaggattcctgacaagggggtacctgaaaccctttcagggggttcatgaaccgcaagtctatgtgaaagtttttctttatattcaaccaaagcagcatatctaatgaagacaccgacttaagaatccagtgtcttctattaaatcagatgtaaaagacattagcaaaaatacaaaaacaatgctagtctcactttttttgtttaaaaaaataattttaataaaaatatgctcataagtgatgggtttttattcttttcagtcatttttttaaatttctgggctttttttttgtggggggcgggatttgagacatggtcttgctctgtccccaaggctggagtgcagtggtgagatgacagctcactgcagccccaacctgctgagttcaagtgatcttccagcctcagcctcctaagtagctgggattacatgcatgcaccaccatacccagctaattttttttttttttttgaaagtctcgctcttgtcgcccaggctggagtgcattggcaccatcttagctcactgcaacctccttctctcgggttcaagcgattctcctgcctcagcctcccgaggagctgggattacaggtgcatgccaccacgcctggctaatttttgtatttttattagcaacgaggtttcgccatgttggccaggctagcctcaaactcctgacctcaatccactcgcctcggcctccca

SEQ ID NO: 16683 - DNA, 22911 bp, Human
aattgtatttaatgttgcataaggtgagttcaaatagttacatgtggctggtagctgcatgttggatgcacagctccaaatgactgacagccctgacaaccctgttccattgctctgaaagggcctgtgttccctggagggggatggctgggctcgtgggccatgggagctgcctggctggcaggcctcttgggctcgctggcatttcaagagctgtctgagggcagctgggcgagccatcctgcctctggaagagcttcaagtgcctggttcctaattggttttgtttattccaagagagcaggcctcacatcattgaccgcccatgtcccaggagtgccggggcttgagtatctatagtttgggggtggcctgctgtgggggggtctagttgctgtggttacaccttggttcccttttccatctgggtttagatgtcctaattggcctgatatttcaggaataggaaaatggtatggagaaaaggagtgagtgaataggaaggaatggaggaccaagaaacgcagtcaacaccctgcagccggtttattgccatcatggcacaaataataaaagctgagttttttttttctttttttttttttttgagacgtggtcttgctctgttgcccagactgtagtgcagtgatgcaatcacagctcgctgcagcctcgacctcctgggcttcagcaatcctcccatctaagcctcccaagtagccgggactataggcaggtaccatcacctggataactttttattttttgtagagactgggtctccccatattgcccaggctggtctctaactcctgggctcaagcgatcctcctgcctctgcctcccaaagtgctgggatcacaggcgtgagccaccaccccaggcctggctgagatttaaaaagctgacattttaaagtgttgttaccctggttaaaatctcctgtttacagaataggaaaagtctgagaggagtgatatgtatactcaaggagttggccaactccagagctgcattccaaactacccacctcctgaaacaggactgacaggtgggaggtttagcttcagactcagtatgtgagtctgtaaaatgatttttccttgtgggcctcagttgtcccatctgtaaaatgggggaaggtttgaattggactaaaaatcttccctaccctaaatggtaaggacacagcactgggagatatatactccctgccctaaagctataaggatccccttgattccactttggcctggttctggctacatgccaggactcatcgtggacacagcctcgttcctgtaaccatgggagattaagtgttaggaaggtcttacagatctggatggtgaaactctttccatccattccttgggtaagttgctcttcctcttggtgtcatgctttctcatctgtaaaattgggatcatcacactttccttttattggggtttaaatgacacaggtatttgcgtggtcagcatttggtcagtgttaggtggtgacagtaggatgttgtgttcaattccaggaagcagcatattccttgtaggctgggcctgtggtaccatttggaattgtgcagtccacaacctgatcaaccatacccagccatctcaggtggcaatagtggtgtgtagtggtggttgttgttgcttattgttatatttacttttcctggagtccaaggtccctaggccaagaggaggggagaggcctggttggcataaaccaggggctccctaaggcagcggcgccttagctcagacttcagctcacacctctctgcctaagaagtgagccagttcattccctgtaggagtagataagttgagactccagctgtggtatcttgagctgaagcagcctcccctgcattccagagtccttctcccaaatgtcactgtccagtgctcttgggagcctaaaccctcactctgcctctttgaaggcttggcccctctccacagtgcccatccctgatgcaatatctcctttgcctctccagggctctgccagcagacagccttggcacacaggcacaagggctggagcccagagatgagagtgcccaagggaggtaagtgcacctagaaggaacttcccctggagtcctggcccctcctgagaccgccctccaaaagtcccctccatgcccccagcctccatgattgggtgcctgggcaaactcccctggctggttttcacctttctgttcagccagcaggttggaaatctggtactagaaaaagctgcatcccagcaagcatcatagagagatgagcatcttccttgtctattaggaagacgattctccaggtgataggagagagaaggctgagtcccaaagtgggcgggggacttgcccagtgtcacggagcagattcaagccagaacccaaacgctgttgtgtcccgttctcctaatgttagtgttttaggtatgctttctcagcaccccacaggagttccttggccttctgaatagcttccttgagaaaagggtattattattccttttttggagaagaaagtagaagctcagagaagtgataccttttgtccagatcaccagctggcaagtggcagcagaagtgagatttgaaccttggagtgtagtactccaagttagaagccctcacctatcatcctcactgcaaggatgccaggatacctcccttgccagggtccagcagggtgatgagggtgttgggcaggcctagttccctgggctgggccctctagctccttccacagtggggtccctagctctgggtaaccaggaagctactttctgctttgtgggttccaggctgctttctgtgtcccaagtcaccctgctttttcttcttaagccatcgtgcaggtcgttgctgtcttctgctcacttctgacttgcctgctttgagctgttttcttcagccttggcctggtctgatccaggattcctgccctggccatgcaaccttgggcaagctgcttcatctctttgagcttagatactgcagggaaaatgctttagcagagtttatgctccataatttcgaacacctttgctgaacataaaatgctgaagctggccgggtgcggtggctcacacctgtaatcccagcactttgggaggctgaggcgggcagatcaccttaggtcaggagttcgagaccagcctggctaacatggtgaaaccccatctctactaaaaacacacaaaaaaatcagccaaggtggggatgctgtcactgaaatcctaataactgacaggattctggtcacaggtctcaggggagaatttcactgagcacctgatgaagacaaagggtcgttgcagggatttcggaatggcttcatgtcctgttcagcctgcctccccgcaggaagtagctctgaattagctttctccatcacagaccctgaatcgagggtacaaatgaagccccaacctcttcagcagaacttcatcagcacgtttttctgaagagagggaaattatccaatgcacagagaggccggtgaccccagcctgagatccatctctggtttgtcagctgcttctcatattttcacagcagcctctgaggtcagtggatccaccctgattttgcagctgaagagactgtggctaagatgagggaagtgactctcccaagccacatggccaggaagtcctagcctcttagcagtttccaccccaggcctgagactgtgttccctccgctttgatgtttattttccacttgctatagcctaagaaggcccaggcagcccaagcccttgcaggtggataggcccagctgcagactgggcccttgggtggttttgggtggaacctcacatccaaagaggcatgctgtcttcccactggcttccaccaaaccctccgttcactaagtcacttgcagttccccagtcgtgctgcatcctttcctgcctgtggctctgcgctggctattccctttgctggtaacatccttgtttcccttctccacctgcctgtttcctacccaccactgaaaattctgcatgaaggctacctcctgcaggaggccttccctcacctacgcaggtagaacccatcaatctctctcaggcacaggtccatggtaagagtagactttggaggctgaggctcccagcacatagcaggtgctcattaaatgttggaataagtaaataaccaatgattatgatagaaatcactaatattcttgggccagatggggtaactcatgcctgtaatcccatcattttgggaggctgaggcgggaggatcacttgaagcgagaccctgtttctaaaaattagccaggtgcggtggtgtgtgcctgtagtcccaggtacttgggaggctgaggcagaggattgcttgagcccaggagtccgaggccgcagtgagctatgatctctcaccactcaatgcactccagccttttttttttttttttttagacggagtctcgctctgtcgcccacgctggagtgcagtggcgcagtctaggctcactgcaagctctgcctcccaggttcacgccattctcctgccgcagcctcccgagtagctgggactacaggcgcccgccaccatgcccagctaattttttgtattttagtagagatgggatatcaccgtgttagccaggatggtctcgatctcctgacctcatgatccgctggaccgggtggctcatgcctgtaatcccatcactttgggagacaggtaggaggatcacccaggcccacgagttcaagagcagcctgggaaacatggtgagaccccatctctttaaaaaaacaaaaaaaattgaaaaaagtgcccagcagggtgccaggcacacagctagtgcttatgaaaggtgccctctgcattcatgtcagcagcctcttgtttgcagttatagggctttgcagttattggagagctcacagctcacagacctccctgactatgcatgtccccctctctccccagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcccaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagtgagtggagcccctgatgcttccactcagactctggccctggagtcagaggcgccaggcaagaaaatcagcactgcctttcttgagctgtgtggccttgggcaagtcactatatctctctgagcctccgtttcattatcccaaaaaatgacaacaattactcctctcctttctgagagaatctgcaaacttcgtgggctgtttgtttgttttttgaggcagtgtctcggtctgttgcccggctggagtaacagccgccacctccctgttcaagtgatcctcccacctcatcttcctgagtagctgggactataggcatgcgccaccaagctgggctaatttttgtatttttggtagagatggggtttgccctgttgcccaggctggtctcaaactcctggcctcaagcagttcttccacctcagcctcccagagtcctgggattacaggcatgagccaccacacccagcctagaatctgcaaactttgaatatgctttgtagtaaggcaatagtgggtaaaggttaagagcacagattccagaacaaggatgtctgggttcaaacctcagctctgccacttcttagctgtgtgaccctgggcaaagcgactcaacccctgtgcttccattgcttcatctgtaacatggaaatataatttgcctaccttatagatacctgtgggcatcaaataggttaataaatgttaggtgctattattactattttagtgttgatactgcttttattgatggagtacccatcctcaccattgtcatttaatgagtgcctactgtatggcaagtattgggttaagcccccaacaagtttatctcctttaatcctcacagcaacctgaggacataggaacacctcttatccacattttatagaccaaaaaactgaatctcacagaggagaagttactggcctcaggctacacagctaacaaagcatggtgctgggattggaacccaggtctgttttttggggtttttcttgtttttgtttttgtttttttgagacagggtttcactctgttgcccaggctggagtgcagtggcacgatcccagctaactgcagcctcgacctcttgggctcaagcaattctcccacctcagtctcccgagtagttgggactacaggcgagcatctccacacccagctcattttttttttttttttcctagtagagatgagatctcagtatgtcttccaggctggtctccaacccctgagctcaagccttcctcctgccttggcctcccaaagtgctgggattacaggcccctggcctattgtgttcttaaactccccatgtccagaactcctcccatcctccccttcactccccctcatcctttcctttccttcctccctctgtcccttgctccctgccttcttccattggaaaagctgctgtccctatcctgagacccagagcactttgaacaatgctggagcagaatatgcagtttccacgctttcccatcctgatcaggctctggatagcctgagagctcagtgaaagggtggtccttcccatggctggtccttcccatggctggtccctgctgggccccttcccaggcccagagcagagctagaggctcgcagctgctctccgctagcaacaaagttcctacatgccgggtaccccagccagttggtgctggagctaggattttataaattattatgacaaaaatattagattaccaaagtaatacatcttgactatagaaaattagaaaagatacaccaaagaagaacggagaaacaacccatgatctcaccacccagatcttgatgtgtggcctactgcaccattttcagggcctgttgatgaaactggagtccaacgaaacatactcctctgtagcctttttccacggtggtgtgggagcccttgccagtggcagccagcactctttggtagcagcatttttgttgttgttttgttgttgagacggagtctcgctctgtcacccaggctggagtgtagtggcgtgatctcggctcactgcaacctccgcctcccgggttcaagcagttctccctgcctcagcctcccaaatagctgggattacaggcacccgccaccacgctctgctaatttttatatttttagtagagatggggttttgccatgttggccaggctggtctcgaactcgtgacctcaggtgatctgcccgcctcagcctccccaagtgctgggattacaggcatgagccaccgcgcctgacctgcagcatcattttgaatagctgtgcgacaggctgctacacggattgccatattcgacttcacattccctattgttggacacttcggttatttccagttttactgatatgtatcaagcattgccctcattcatgttctgggatgtgtccacctcatttctgcaccataaagtcctagagacacaaggattttggcaaaagccatgcacatactcaagatttttgacatattgggtagagttaagatttaaatccaggtttgcagcctctgaatctgtgttctacccaccagtccacaccctttcaccttcccctgttctcctcacctcacgcccggtcttgtcttccttttgctgcctctttctgttctttcccaagtcacctcttagttgggatgaaaacatttagaactaggcccttgatcctgggggttccccaccattcatcctgtcaggcccctgagttataattggtaagatctgcatcattcaggtggcttgggaagcctgttacagggagagttaggaagcaggttgaagatgatggttattccatggtagctgtgaaaagttggaaacaacctaaatgtctgtcttcaggggaatggaaaaataagtgatggaggaaggctacatagctggcaaaaagagtgaggtattgagtggggaaaaaaaactagcgtatttgttttacagctgcagacgcgcgtttgtgtgtgtgtgtgagagagagagcgtgtgcacaggagagagagcatgctaacccttattaaaaatttacaatgtgttggccaggcacagtggcttatgtctggaatcccagcactttgggaggccgaggcgggcagatcacttgaggtcaggagttcgagaccagcctggccaacatggtgaaaccccgtctcttctaaaaatacaaaaattagctgggcgtggtggtacatgcctgtagttccagctacttgggaggctgaggcatgagaatcgtttgaacccaggaggtggaggttgcagtgagccaagattgtgccactgcactccagcctgggcaacagagtgagactccatctccaaaaagaaaaaacttacaatgtgcctacgctcttctaagcactttctttgtattaactcatttactcttcagacaaccccagtgaggtaggtactactatcattgccaattacagaagaggaaactgaggcccagagaggtgaagtaactttcccaaggccacacagctggggaacagctggcgtctgaacccaggcaatctggctccctggtttgctcttaactactctacaagaaaaggttagagaaggtggtgtgctccacagtgcaaagactgagtgcctgtaggaagccgatgggctggcagtgatgaacacagtggctttcagctttatcattagtgttttataactttttttagggacaaaatattcatgttagtcatacacattaaaaagtgtttcttttttttttgagacagggtcttgctctgttgcccagtctggagtgcagtggtgcaatcacagctcaggctcactgcttcttcaacctcccgggctcaagcaattctcccatctcagcctcctgcgcagctgctgggactacaggcgcttgttaccatgcccagcttatttttgtaatggggtttcaccatgttgcccaagttggtgtcaaactcctgagctcaagtgatccttctgccttggctttctgaagtgctgggattacaggtgtgagccactgtgcctgacctaaactgttgttattttttaagctggagaagaaagcagaatgtatgtaccaatggtgtatactgctagtactttcttctgacttctcactgcatgctgtgttcccattgtacaaaggaggtatgaggaggcaaaaatgactcacctgccatctcacagttgatggggcagagctgggtggaggccaggtttctccagtctttcctgctgccccagagtggctgagcagggaatccgctcaggcgccatctgggtctgccctaccctctccagcgtctcctctctccccaggatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtgagtgtgcacctgtacttgtggaagtgtactcttggggatatggggcttctgcagatgtggaaactccagccacctgaggaaatgttcagtctctcaattcctggtcatctgatttgttcctgtctgatggacacagtgaactacatgattgcttgtatttccattttgcttgggctgcagggaagctcaaagccaactggtagcctgtctctcatactctaacatctaacagcaggccagcttgtacactaatttcatcttatttctctaattttatttacatttttacccctatttccctggctatttgtttatctgtttgtaaggcacctcaagtctttgttgagagggggtataaataaataaactattggtccctttcttgtcttataaggtttaatgtggatttctcagacaaatgtgagtttagggctgtttaaattatgcttaaaattctccttagttaagatggtgaagggaaatgacttttttgttttgtactgttttgtttgaggcatggtcttgctctgttgcccaagctgggtgcactggtgcagtcatagctactgcagcctgatacttctcggcttaagccatcctctcaccccaggctcctgagtagctaggactgcaggtgcacgccaccatgcacagctaattttaatttttataaaggcggggtctcgctacgttgcccaggctggtctagaactcctggccgtaagggatgcccctgcttcactcttcccaaagtgctgagattacaggtgtgagcctccagtgactgacaaaatgcttttgaagtgttaaagtaggctaacacccactgggtaaaagaacagttaacaagttgatggccttatttatacgtttccattacagcttctagtttactttaagtgctgtgttctaacttccttataggcaaatatttgaaaatgggacccaggcctgaggaagagctttcacagcccttacttcattaagacccagagtctttaatttaagctaagctcagcatttctgagcgtgtgctgattttaggaaataaacagttatcgtattgaatcacaacggaaaaaagttaatcgtctcttagttccgtaactcttcagttggctcaagaagaaagtttccatttggtgctaaaaagtcattaccacctctctagcactcactgatctctctttaacaaagagaatttactaacgctgagctttgggggctgtgcccttgtaattgaagtgtaagctttgtctgtgggtctcgtgagttcctcttcctcttgacattagttgattttgcagacatctatttatggaaatactcagagattcaacgtacataccagccgacattgacaggtgaatggctgcaacccagatgtggtttgttatttttattataaatattattaatttttattttattattctttaataatagtaatctttaaaccctacttatgtgttttacatacttttatctgcctgtgggttgtacatgtattatcaaaataaaaaattaattaactggattaaaaagatggtagtgatctcacaatccagccccaggtgcttctcagaagcagaggcgagggccggctggggacactgcagtagtgggctggatgttgcttacttcactgttctcagccaagggcccagcagtggctcctctggggtctccttaaaaggtggctcgctgcccctggcttgccccaggctatgggtcggacgttcctggagtaaagcctgactttatgtattttataaaacacaaataattttcatgagcactggtggttaacatcaactctttggagctttttgtgtttgtttatttaaaatggaagctgtctctcattttcatccaaagagatttcttccctggggcggtcaacaagtcttggcaagtgctagatccctggtttagtttttgccatagcttggctgttactgcaaagaaaagtcctctcactaagccctgtgagtttgcatgcatgcctgtgtgcttctgtgagtgctgtggaccctgtgtgttccaataatggatcctggggctcagtaaacacagtggctaaaaggacatctatgctgatgaaatcgtctctgcctgcagtgtcccatacggtagccactagccatgtgtggcccctgattctgtaacaggaggctagtccaaagtgagaggtcctgttaggtgtaaaatacacactagattttgaaggcttaggacaaaaaagtatgtaacgtttcttattagtcacttttatataaattacatattgaaatgttaatattttacataggctggacatgatggctcatgtctataatcctagcacttttggaggccaaggcaggcagactgcttagcctaggagtttgagaccagcctgggtaacatggtgaaacctcatctctactaaaaatattgaatattagccaggcatggtggcacgtgcctatagtcccagctactcagaaggctgaggtgggagaatcacctgaggctgggaagtggaggctgcagtgagccgtgatcgcaccactgcactccagcttgggctatgggagtgagaccatgtctcaatagaaaaaaaaaaaaattagctatatcaggttaaataaaagatattgttagaattaatctcccttgtttcattttattttaaaatgtgactactagcggaaaggcctgaaatgttgtggttctaacttcagggcctttgctctgttgcctctgcctggagtgctttttcttctgagcttagcctacctatttttccttgtcgtttgggtctcagctcaaaggttatctatttcaagaggccctttttatttttatttattcactttcttagagacagggtctcgctctgtcactcaggctagagtggagtgatgtgatcatacttcactgcagcctcaacctcccgggctcaaccaatcctccagctgaggctggagtagctccagagcagctgggacgataagtgcatgccaccatgcccagctaatttttaattttttagaaatggggtttcagtgtgtttcccaggctgatctcaaactgctggactcaagtgatcctcctgccttggcctccagaagtgctgagattacaggcatgagtcactgcgcctggcccaagagtcccctcttgaccacccactcaaaagaagccccctggttactcctaatcccacctctttactgtacttttttcacaacagttcccatggtttgctatgtccttgtttatctgtgtttatttttcttgtatgttatctggtgccccctctagaatggtagctccaggggaacaggaatttccattatctggttaacatcatgtcaaccagacacaatgcttagaataatgcctagaagaagaggagcttaagcaatgtttgttggatggagggatgggtgggtggcgaggtggatgggtggatgactggatgtgttgggaatgactaaattttattttttggccattttcataatagtgatatttctttttctcttccttaggtcttgaaaggggactataaaacaccagccaatctgaaaggatattttcaggttagaaaccccaaggggaattccgaattctgtctttctcagctataccaccatctggctgtatgcccttagatgtgtcacttctccactctggttgatggttttcccattataaaaagggggatgtgagctggctgcctgtaatcccagcactttgggaggccaaggcaggcagatcacgaggtcaggagttcaagaccagcctgaccaaaacggtgaaaccccgtctctactaaaaatacaaaaattatccgggcgtagtggcacacacctgtaatcccagctacttgggaggctgaggcaggagaatcgcttgaccctgggaggcagaggtcgcagtgagctgagatcacgccgttgcactgtagcccgagcgacagagcgagactccatctcaaaaaataaaaataaaaaataaagggctgtggggatgcgtgctggaccagagggtctctaagcactgatccagctggggccacatctcagtggcccttctgccaggaagcagcctctcacttcgtcttccggcttgaatgcagttggagggacttcgtggggactttttcttgggctttctttcttgttgagactggagtgcagtggtgtgatcatggctcactgcagcctcaatctcctgggctcaagcaatcctctcacctcagcccctcaagaagctgagactacagacacacaccatcatgcccggctaatttttgtgttttttgtagagacagggttttggcatgttgtccaagcttgagttgtattatttataataaacaggtagcagttagtaaagtgttttccctagtgtcttgtgagctgttctagtgaattatcaaaccagagtgggggttgtgggaacctccagatttgaagttggctgggaagaagtgtggatagcctgcgcaccccattgcagctggcatctaaagtggggcagtcgtggaactgggcccttaatctgtggcagctgatgctaagtaagtctgggagctggtgtcagaactgaactgaattgttgaacacccagttggtatccagataatcagagaattggtcactgatattggaaagcacccataagccaatatctgaaggattaaaactaggtctgccacacaaagatctggatagaaaaggcttcccggcagagggaactgtaaacgcctgaaagtggggagtgtggccgaaacctctggagtgcgtatgcacttttgcattcgttgcaattatatttttctttgtttctaccccaatgtgatttacaggaatgttcattgcaattttcatgttcaaactgccttgttttgctttcttaatattttcctatcttttgagtttcaccggcaccattttggatggctacgtagtgttctgtggaatgcatgtgctaccatttactaaacagcttcttcaagaccatttccagtttttacgacatccagaatgacattatgtgcacagtggaggacagtagggagatgagggttggaaatagaggcttgacaaaacttatctgcagggcagccctcctgagcgtgggggtatgccattccttcatattttgttcctaaaagcaacaaaaaccagtcccaggtcagctagacatcttgcatatgtcatacacggcaggaagtataaactggcccaacccttttgtttttgtttttgtttttgtttttgagatggagttttcctcttgttgcccaggctggagtgcaatgcggtgatctcggctcactgcggcttctgcctcccaggttcaagcaattctcctgcctcagcctctcaagtagctgggattacaggcaccggccaccacgcctggctaatttttgtatttttagtagaaaggggtttcgccatgttggccaggctggtctcgaactcctgacctcaagtgatccacccacctcggcctcccaaaatgctgggattacaggcgtgagccactgctcctgaccccaacccttttgtaaaacacttttagccttgttgttcaagagtcttcaaaagatctgaacccttccacctgctcctgctgattcctttttttttttgagatggggtttcactgtgtcacccaggctggagtgcagtggcgccatctcagcccactgcaacctccacctcccgggttcaagcatgattccattttttagaagtgaattctaagggaatgattcagtagagcttcagtacccaacagaagagaggcagaatcaggatgtgatgtcatttaaaatactgcaaaaattggaaccattcttaggtaagcagtcagtaaacggtggtacatgcactccacagaatatctgtagccatccaaaatggtgctagtgaaacccaaatgatgaaaaaatagtaagaaagcaaaacaaagcagctcatactatacaattgcaactaatgtaaaaatgcatattcaggtggacaaaaaaaggcaacacgcaggagttgggtgcagtggcatgcctgcagtcccaggttctcaggaggctgaggtgggaggatcgctggagcccctgtctcttaaaaacaacagcagcaacaacaacaacaaaaacgaaggcaacgtgcaaaaatgagaagtttcagtttgtggataattctcctcatccccactgtgttgttctgcctacatcatctttttggttaaaacaaatactaaattagtgctcactaattctggctactttcttgacgtcagcaaaagatagatctctgattcccacaaagggagtgggacctctccccaaacaaccaggaaatgctcaaaagccatggtccctagctctcagatcgcattaattttttttttttaaattcaaggccaacacagtgagaccccatctccctacaaaaaagagaaagccttagctgggtatggcacatgtggcacatgttcgtgccactgcactctggcctgggtggcagagtgagaccctgtctcataaaaaagaatacaactcaggtacagtcaaatgcaagaagcgtagggtgaggtatgggggatgggtcacagaacatccatgccctttcccggcatgacaccctcccagcctctcaatgtgtttaccaaccaggaagctttccaaattctgtcatttagagatttcatcatagaggcatgactgattaaatcatgggtcatgggtgattgcccaatctccagctcctagcccctagaccctctcccctctcccctcccaggaggtcagggaggggagaaggcaggtggggcttaaagttccaaccttctggctgggtgtggtggctcatgcctgtaatcctagcactttgggaggctgaggcaggcagatcacttgaggtcagcagttcaaaaccagccgggccaacatggtgaaaccctgtctctactaaaaatacaaaaaatattagccattcgtggtggcacacgtctgtagtcccagctacttggaaggctgaggcaggagaattgcttgagctcaggacgcggaggttgcagtgaaccaagattgcaccaccgcactccatccagcctgggcaacacagtgagactccgtctcaaacaacaaaaaaagttccaaccctctaatcatgccttggtctttctgagaccccttcccctaatcctgaagctatctagggacccccagccattagtcatgtcattagcatgcaaaagatacgttttgttttttttttgtttttgtttttgtttttttgatacctagtctccctctgtcacccaggctggagtgcagtggcatgatcttggctcactgcaacctctgcctcccgggttcaagcgattctcctgcctcagcctcctgagtagctaggattacaggtgcccgccaccacacccggctaatttttgtattttagtagagacagagttttgccatgttggccaggctggtctcaaactcctgacctcaggtgatccaccctcctcggcctcccaaagcgctgggattacagccatgagccatggcgcccggccaagatacccttattccttcagagattccaagagtttggggagctatgtgccaggaactggggacaatgaacaaatatttattattataccacagctgaaatgccatcttgtagagtcctttcctggccaccgtttttgaagtagcacagatactgatcactcatagcagcctgtcatattgcccaagtttgacattttcttgcatctgtgtgtgttcagtaggctttttcttcaactcgaacgtaagttccgtgatcctaggtttgggtctgtcccgctcaccacgctatcccagcacctggcacatagtagatgtacagtaaatactacgtgaataagcatgtgcatgactcagtgatgctgaggggtgaccctcaatacagcaaggcatccctcacctggccgtgaccccttcttctgtgtattgtctttctccaggtgaaccagaacagcacctcctcccacttaggaagctcgtgatttccaggtaagcctgtggacttcactgggggttcccgctgcttctgggtggccccggagccacttttctgaaaagccacttttctgtccttccagagcctccctggggtagacatgtccactagggtgggctgacccagccccatcagaggtttccatggtgacagactgggggtgctatttatagaatcaaggcttagttttctagctctggatcaaggacagggagagggattaacgctgaaccaaccagaaaaaggtttgtctgacactggggacagggcaggaagcaccactatgatgggggagggggagattctggaaccatttttgcacagaatgctgtctgccagtctggcttctaaaaacagcatcagcgttgggccagagcaattaatgttctaataacagtcacaagtcgttctgttctaagaataacccccatggccgttgggccaggtactggtcctgtgttactcatttaaccctcagcatccttgggaggcggatgacatgatcattccattttacagaagagaaaaccaaagcacagagaaggaagggctttgacttgcccaaggctacacagccaccaagggacagaattcctcccaggtttgcttttagtgaatgattttaagtgcacatttatccatccatattctactaaggggtcgggaaagggattttttgaacttggtaattcaaagatttaagatctccaggtttaactcccttcagcccctgttttcttcatctggagaatgggcattcatcattgcccacctctgaggttggccatgagatggcgtgagctggcccaggtgggagtgcttggaaaccgtgaagtgctgggccctcgctgtggacttgggcactggagttaaggctgcatgagtgagctcacttccttctgtcccccagcctctatgatcaggttaaaggaaacctcaagagaggttattttacatggaaacaccttccagcttggactcttatttttagtctctgtatctatttttaaacaatcagcatatgttttagtttttctttcaatttactttgctccaacctgcaaggactctgtcattattagggttcccatcttgagttgcactaagatcccagagtttttgtttttgagacagagtctcaccctgttccccaggctggagtgcagtggcacgatctcagctcacagcaatctccaccttctggggttcaagtgactctcgtgcctcagccttccaagtagctggggttacaagtgtgcgctaccacacccagctaatttttgtatttttagtagagacggggtttcaccatgttggccaggctggtctcaaactcctggcctcaagtgatctgcccacctcagcctcccaaagtgctgggattacaggcatgagccaccacacctacccaagatcccatagttctattccaaagaaaagaaccctctcatgaaaaacagctttcctccctgttcctcactaactgttccctcgctgcctttctgcagatcattagtagaatcctggaccttctcattgacaaaagcagatttgttacttgttttactgtttaaatgagataccatatagaggtgctttagctgaatcctgggtacagagttggccttgaacaaacatgagtccttctcttgcctccaagaattcatcagtatttatcacataatcactgtcatttgctctgtgtccataagaaaagtgtatatttgaggtcaagtggatgcaagatgagatgtggggaagaacccaggaaacgtttttaaatttaaactctctctggccatctgggatgcattcttaaaacattacatgcttatgcgaatggatgaagacagtatgttctgcaatcacatgtataaatataaatgatctatttcagaattgttactctgagcctaacacagtcttccccactttcagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaatgaatagggttttttttttctttccatactggattttgtcaggtagatttgtgatgagcaaaaagctggagaatataggtgcatgtaaggcacagctgaattcctgtgtcagggtccccagggccacccccaggatcgatgattggctagaagaactcagaattcagaagagctattatccttatggttatggtttattacagcaaaaggataaacattaaaatcagcaaaagaggccgggtggagtggctcacgcctgtaatcccagcactttgggaggccaaggcaggcagatcgcctgaggtcaggagttcgagaccagcctggccaacatggtgaaaccccgtctctactaaaaatacaaaaattacctgggcgtggtggtgtgcacctgtaatcccagctactcaggaggcttgaacctgggaggcggaggttgcagtgagcggagatcgtgccattatactccagcctgggtgacagagcaagactccatctcaaaataaaatcaacaaaagaaaaaggtgcatagggcagagtccgggagagaccggcctcaagcttccagttgtcatctcctggtagagtcttacagacacacttaattttcccagcaatgatatgtgacaacacgtactaaatattaccagccagaaagctcaccctagccttggggtctaggtttttattgcatgtcagtcacatagggcaatcacatgaccgactttagttacttaatcaccagctgctccagaggtcaaaatgatacagcatggcccaaggtccccaccataaatcacattattagcacaaactatctggcctggtatggcccaaggcctgaggtatacaaagacacccctacttgggaggatattccaaggacttagaggttatctcccaggagcccattaaggccagttttttctttgagatgtgctgggtttggacacttcaagcctgctgagttaacccttatagcacagtccccaaatgctgagggaccaactgggcctacaataagtttgtatctttaagggttaaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacagaatctcgctctgtcactcaggctagagtacagtggcgtgatcatagctcactgcagcctcggtctcctagggtcaggtgatcctcccatcttagcctcctgagtagctgggcatgtgccaccacacctggctactttttaaatttttttttttctgtagagacgaggtctttctatgctgttcaggctgaacttcatgggtttattggggatggctaatggatgacattggcggtggtccttgataccagataagccctcagtgtgaagcagctcttatttttccttgtcttgagattgctctggaatggaaattaggcttttttgaaggtgtgaccctttttgttcatttcttcagcagttactttttattttttaaatgtttgacacacagtctctgataaatgatcattcaccaatcaccgattactctccttgctctgttaagtgtgacactgtccctttgagaatctggcgacagctatgtatcccatcaccacacaccccaaaaaaaaaatttatgtctggttccaggagttaccttttatgagaagtccatctgtgaagaccctggatgttcagagaacttcctgggaaaacactgaaagaaaataaagaggccgggcccggtggctcatgcttgtaatcccagcactttgggaggctgaggtgggcagataagctgaggtcaggagttccagaccagcctggccaacgtggcgaaacccc

SEQ ID NO: 16684 - DNA, 5041 bp, Human
ctgtgcttggccttaaacaaaacaaaacaaaaaaattaaaaaggagggagatgggagagaagggagaaagcagcaaaggagacactgtgggcaggaggaggatgtgatgtggagagagccccctactgtggtcctcacacatgactcactggctggacagacaaatcatagcttctcttggggtgggcttgctggtctcagccgtcagatggggagacagagagaaggaagggacagagtggtgggggagaccctggccaccctagggagagcaaaagccttgcctggcagggcaggaacagggtgaggcaagcagggcattgtccttgagcacaaaaactcaagggggtgccaaaaaactcagtaaccaagatcaataatgtttcaatgcaatcttttttagattagtggaaaaaaatccatgacaaacaaaaaatataaagtgtttaaataggacaagtgatgttgcgctgtgctaagccacactggagccaaggcagaaagaaaaaaatcagtaatactgatcctgacattatttacaatttttatatgttgtttttcatggatatttttgcatttagattgtttcataacagctttactgagggacaatgcacatatcatataactcacctatttaaagtgtacagttcatgggcccggcgcggtggcccacgcctgtaatcccaacactacgggaggccgaggcaggcgatcacctgaggtcaggagttcgtgaccagcctggccaacatggtgaaactctgtctctactaaaaatacacaaattagcagggtgcagtggcagatgcctgtaatcccagctgctcaggaggctgaggcaggagaatcgcttgaacttgggaggcagaggctgcagtgagccaaaatcgcgccactgcgctccagcctggacaacagagcgaaactccatctcaaaaaaaataaaaaaataaagtgtacagttcaatggtctttagtataatcacagggtttaatatattcacaggtttctagtatgtgcagagtagtacactcacagagttttcgtatagtcatagtcaattttgctacattttcatcacccaaagagaaacctcgtacccttacgtatcaaactgtaactcccttctcctcccagccccaggagaccactactctactttccgtctctatgagttcgcctattctgaacatttcataaaaatggaatcacacaaagcatgttctttaatgaccagctttttccacttagcacactctgttcaaggttcatccgttagttttgatttttcaaattttgcattaaaatattatcttgatcacttgatcatcccctgctgcctagggctctcccaggtcaaaccctggtttctgcaaacccccacttaacagcatggttctattcacaccttcacgcagaagccagggagcttggggctgccagaaacctcctagcctggacagcagggccttctaggagcctctgaggaaatccacatggtgtgacagaccgggtatagaagcatatcatatcaatgtatatgtatcatatacatatcaatgctgtaatacgatataaaataagagaagatgatttctagatttgatgcataactttgggtccttgagctcgggaatgcagagccagcagtggcctcggagaaagcctgggcgagctcagaaaggagagtgtggccaaggtcacacagcaagttaatggcacagccaggcctgaacacctggctgggttcttcccatgtacccagaggccttctctgctggcatcatgctggcttgctctcctaacaagatacggtaggatggtctcctggttaaagtgtggctccggagtcaggctacagatgctggctacagagctacatgactttgggcaagacacttaacctctgtggtcatcaggttcctcatttgtaaaatgagaatcatattgcagcagtgccatatgacttttgtaaggattaaataagatattgcgcattgcagtacactgagctccacagagacagcgccggggcaagtgagagccggacgggcactgggcgactgtgcctcgctgaggaaaaataactaaacatgggcaaaggagatcctaagaagctgagaggcaaaatgtcatcacatgcattttttgggcaaacttgtcgggaggcgcataagaagaagcacccagatgcttcagtcaacctctcagagttttctaagaagtgctcagagaggtggaagaccatgtctgctaaagagaaaggaaaatttgaagatatggcaaaggcggacaaggcccattacgaaagagaaatgaaaacctatatccctcccaaaggggagacaaaaaagaagttcaaggatccgaatgcacccaagaggactccttcggccttcttcctgttctgctctgcgtatcgcccaaaaatcaaaggagaacatcctggcctgtccattggtgatgttgcgaagaaactgggagagatgtggaataacactgccgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagacgaagaggatgaggaggaggaagatgaagaagatgaagatgaagaagatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctgatggtattttcaatagccgctaaccttgcctggtacagtatgggggctgtaaattggcatggaaatttaaagcgggttcttgttggtgcacagcacaaattagttatatatggggatgatagttttttcatcttcagttgtctctgatgcagcttatatgaaataattattctgttaactgaataccactctgtaattgcagagtgttttgttgcaagaaaaagttgcagctgttttgttgacattctgaatgcttctaagtaaatacaatttttttattagaaaaaaaagatattgcatgtgaagcacttagttccacacctagcaaacagcaggtgctctaggtcttatcatcattattactattattagtatctggaatctagcatctcacggagagtcctttgtaggacatggaatgctatcccagcaggcacaggaaggaaaatttaggcttaggtactagggagccacggcagatgtttgagcagtgggtgagcagcatgactttgaagctgcatagggctggccgccagtccagtacccacctacagggaacatctttgccaaggtccttcctcgcaggctccaaatccctggcagtcctcccagtgctgctgggcaaagccagagcacaactcccacaggctacaccccgtgacatttccagccttgtttgcttcctgggtgccagccgggctggtgaacaccaagcagtcaacaagctgggggacttgaagcagcccacacagcctcaatccacagatacaaagaccaggaggcccagcggcccggcgggggccgcagggtggcagaggagaaactgtccttattttggagtcatgaaggcaagcctagctcctcctttgctgtgtgaccttaggagagtccctttccctctctgagctccagtctgcccatatgcgagaaggacttatctgcttctgtatgcttaggggctgctggagagatgcaacacaataaaacaacaatggtgtcctttggcagcacccccactatgagccagacactgtgctgaacattccaggtgtgtaacttcactaaaccctcacagctctacaagccagtccatgtgccatttctacttttaagatgcacctaattgctcaactcattggtacaacctctatattacaaactggagggagaaggcataagtctctttggagtaaaagatccaatcctatgttcttcccccttttctaagatgtaactgctgttgattagtttggaggggagccatctacacttgctttttcttttcttttcttttttttttttgagactgactctcactatgtcacccaggctggagtgcaatggagcgatctcagctcactgtaacctccgcctcccaagttcaagcgattctcctgcctcagtttcctaagtagctgggattacagacatgtgccatcatgtccagctaattttgtacttttagtacagacaaggtttcaccacgttggtcaggctggtctcaaactctcgacctcaagtgatctgcccgcctcggcctcccaaagtgctgggaccaggggcgattttgccattcagggaaccatcggtaatgtccagagatagttttggtgttacaattagggatcatctcatgggtagagcccacggatgctgctaaacatcttacaatgcccaggtaatccccagcacaaagaatcatccagtcccaaatgtcactagtgccaaggttaagaagtcctggattctacatagcctcctgaaactgactgggttcactgaacacgaggtctttccgtgtcagcatgtttgttctatcatccagtaaacattgcttgagcacctactgggtgccaggccttgttctagcaccggggccaaatcagtaaacaagacaaagccccagcctccagagggcactgatatccttccagaagaaaagacacatcaacatgcaacaccttgatggacctccttccctccctcttcttctttttttttttttttttaagacagagtctcactccagcccaggctggagtgcagtggcgtgatctcagctcactgcaagctccgtctcccgggttcacaccattctcctgcctcagcctcccaagtagctg

SEQ ID NO: 16685 - DNA, 12703 bp, Human
ttatggagccaatttattttcttttctttttttcttttctttttttttttttgcattgtcctgtactcctcagtataaggatgaagtctctgggattaaccccaattacggataaggaaactgaagcaactccctttccttcctctctctcagccactttctcataaaaatggaaatgtaagataaaattggaactcacatcttctttactcatgaacccaggctcttaaaaactatgcacccctgctttttgatcaacaattaataataatcatctttcttattagcaatggtgatgatgaagatgatggaaataccacaatattttttatgttgcaggagcaattccagctgctgttcatgtgctattcacatttatcctcacaatccccctgtttcttagactaatcccaacttaccttgttacacccattttacacacaagtaaactgaggctcagagtgcgtaagtaacatgcttaaaagttacccagccagcaccagtgggatgcaaacccaggcagtctggctgtagagggtgcattgttaacctttcattttcatgccaacccttcatcaaagtcatgcattccttttttttttttttttttttttttttgagacggggtcttgctctgtcacccagggtcaagagaaatggcatgatcttggctcactgaaacccctgcctccaggttcaagcaattctcctgcctcagcctccctagtagctgggattacaggcgcccgccgctactcccggctaatttttgtgtttttagtagagacggggtttcaccatgttggccagcctggtcttgaactcctgacctcaggtgatccacccacctcggcctcccaaagtgctgagattacaggcgtgagccattgcgcccagcctaaagtcatgcgtttgatagagctgcatttcaccctcttaaaaggaaactggtgtggccactttacaggtcatgagcaggactcaggtgtcctccaggtcacacggatggtaagaaagaagcagggctggatttcatctcagatgatctggtttccagtcatgctgttttcctatgcttgttacacccattttacacacaagtatgtatgtatgagggacctcttaggtccctcatacgccaattcagagggcagggtttcgggacaagaggcacacagcaaattgtacaagtcctggatatttggcaagtgtgccacagtttgcaaagcatgtttgcaactaacagctcctctatgctgcccacagtgccatccggattcatcttcaggctttgtggacccagcaggccctggcctagccctcttctcctgcctcacttcccttcaggtcccctgagctccaggccaattgggctaccagctctttcttgtacatgtgccccaagttcccacctctgaactttttcttagaatgcctctccttccatctcactctgtacatatcttcctcatccttcagagtctagttcaaatgcctcctctaacggcaagcctatctggattgcttcaactggaagagaaaggggaaagagagaaggaaaggaataggcatttcctgaatgtttactctgtaccaggcatgttatgtaacctcacaacaactctgtgatatggtttgtttctgccccattttataggcagaaattgaggggaaatgactcgctggagctcacatagctaggaaggatgcttctggactcctcatctagtgctcattctcctgctctagtcaggaaccttgtggggctgatgagggccaatattccacctctctccttcttcgtggctgatccctgggggtggtgatctggtcctttccctccctgctaaagccagagctgctgacggcttgccattggctcttcagccagggctggcttttgtttctgtggcccagttgctgagtcggggctttgtctcccaggggcccctcttccctccctgcctataagagcccgacctcggctggtctcagatctgacatgttccctgggcctatctcggtaagtcccaggtttggaggaggggtgggatcagagttctgagtgagcattctgggaggcgaggaacccaggtccccagtcctagggatgtcactgtgtcatcctgaatgccatcctcatcctaaccaaggatgagccccaaccatcaagaccagcacctgcttccctcatttaaaaacaaattattcctgtagccctattgcctaaatttccaccatcagagctacctctttgagctaggtgctgtctttggaagggctctcttatgctgagcatttcagcactcgctggggtgatgcacccacccaccagcagccacaaaaattttcccataacaagcagataagagaatacagagtggggctcagagtcaatgagacccagcaagggtgagttttgagatggggataggatggaagatggcattggtgacagatggaaaggacaggagagggacaggccaaagccatgcattgcccctagcccagtcactcctggactccctatgtggatcctgaccaggtccaagccagccatctgcataaagaggagagcagagggtcagggtggaagattataatgttcttctcttctgcaggaaggggccacaatgaccctgcaatgcacaaagtcagcgggaccctggaaggtaggaagaggcatggggagggggtgttcagggggtatggggagggttcaggtccccatgaatcctaggaggggggcattataaatgcctatttcacagaggtgcaatcaaggctcagagttgagaagggacttgtatgtcacatacagggaggttgaatgtgaatttgggtcttctggttcccaaagttgacctgttacactctttggcagaggttgcagtctttgggcatgatttctttgaccatctctgtgtgtgtttgtttgttttataaagcttttggatttatcatcagcctttaaaagcctggaagaaccacataaaagtccagatctagtgattgtcttgagaaattggaaggtctggcctgcattcccacttggcaaccattggtggcactgggaagaggccacccatttacctggcacctgtgctgtctagtgtctcacatttatcactgctcttgccttcctggctcctggaggaatctgagtttgcaatccctgctttacctgccagatcctggggcgagcccccaacctctcacccttcacgggactctgatgcggatctccaccttttttttttcctggcacagatggtggtgtgggatgaggacggcttccagggccggcggcacgagttcacggccgagtgccccagcgtgctggagcttggcttcgagactgtgcgatctttgaaagtgctgagtggagcgtgagtctagggggacactgagttggggtagagggtggacaggaagggacctagagacgggtgctaggacttttagatattctaggtcccctctccctaggctcttactgttgtgccctcctgaagtactgaggagtgtgcaggactgccatgtaagattatgcaggttgcgcactgcccaacagtaggagggtgccatttacacagaccctgcccactggatgaggcagttctgcaggagatccttagaatccagtgttggatctaaaaatgtccctcccagccgtaaattgaaagccaacatcacccgcctaaagtagaaggtaactgtaaaaataaacataatgttttaatgctattaatttttagctaaatagtcttgctgctaagcatgtggcctgatcattttttgtaaaaaaaaaaaaaattaaaaaacaaaaaagagagtgagagagagagattagtgagacacagagaggtgttaaggacacactaataacacaccaagactttctagaccagtgtcattcagtggacctgtctgcaatgatggagatgttctacatctacaccatccatttcagagccactggccagatgtgaccattgaggatttgaaaggtagccagcatgagtagagaactgaatcttgtttaatcttaatttatttaagtttaaatttaattagctacatatggccagtggctaccatattagatagaaggttctagaaggttggaaagcaggtagaaaggagatgtggccagtagctaccatattggatagaaggctctagaagtttggaaagtagttggaaagatgtggccagtagctaccatattggatagaagtttctagaaggcaggaaagtaaatagaaaggaggtgtggccagtagctaccatactggataaaagttctagaagtttggaaagtagatcgaaaggagatgtggccagtagcttccatattggatagaaggttctagaaggttggaaagtagctagaaaggcaatgtggccagtagctaccatattggatagaaggttctagaaagttggaaagtagatagacaggagatgtggccagtagctaccatattggatagaaggttgtagaagtttggaaagtagataggagatttggagtcacttaatgctacacctgtgagtgccacctgaggtcatcttgggtgatttttgcacatctcatgctttagtaaatactcttttagcttctgatttgtgcaggtggggaatgggggtcagatgggaacagaggctttctaggggtatgtccagcaggctgacagactcagccagtaagcagacaatgagcttggatagattcagacagtttattacttatacagacagtaaaggcaaggtgcagcctcctgtgtcccttgtcctactggacgacaccaaaacaaagggggctgaatgacaggcattaggaatggtaggaaccccgtggctgaagagctgcttccatgcttcaacgatagcttgctgctgtcgcctgtggggaggcgaggtggaaagccccacatctcagagtggccagagaggcagatgaggggctgcctcgtggcagcctcccacaagagagggaggaaaatgagagatggccatgcggtcgctccttgcaagactgcccgtctcccacaccctggcaggatcacggggaattccaccaaggtgagatcagtctgtgatcagctttgcctccttggcctctgtggacacggacggaggagcaaggttgtcagggcacctgtgtgaagcagtttccctacctatgggacacacagcaagtgaggtctagagctgggttcctcaactctggcgctactgatgtttcgggctggatcatcctttgcagggaaggctggcctgtgcattatgggatgtttagtggtatccctggcctctacccgatagatggccttcgcagtccctcccctagtcgtgacaaccaaaaatgtctccagccatcgtcaagtgtttcctgggggcacagtcacccctgaatggttgtgactgtgaccgttctagacccaattgctggtctagaatgcagggtgagggggacgcttacctcctgcacgctctaccctctgtctgcaggtgggtgggcttcgagcatgctggcttccaagggcagcagtacattctggaacgaggcgaatatccaagctgggatgcctggggcggcaacacggcctaccccgccgagaggctcacctccttccggcctgcggcctgtgctgtaagttctaccactgctgcatcccggggaggcccaagcccctcatgtgggcacttcggaatcaaaggttccagagttgaaattctcatgtcgccacttcaagctgtgtgacaagggctgttcagtctctttcctctccaagcctcggtttcttcatcttgaaatggggcaatagtaccaatgttcttgggaagaagaacgtataacatctgaccagagcctgccttaaactctctgctcacagcaaccctggttgtgataggagcccctgccagttttgtgcccttttttttttgtgattcagggaccctgagagaatctgggtaccagggatggtagggccaagtggagaggaaaggtttcatttcttgctcctaattcagcatcagtgctcctgatcttacattttactgctgtttttggagtgtgggtggaggtgggcattattattcccatctcaccaatgaaaacattgaggctcagaaaggtgtattttaggctgggcatggtggctcacacctgtaatcccagcactttgggaggccaaggcgggtagatcacttgaggccaggagttcaagatcagcttggccaacatggtgaaaccctgtctctactgaaaatacaaaaaaattagttgagtgtggtggcacatgcctgtagtcccagctactcaggaggctgaggcaggagaatcacttgaacccgggagacagaggttgcagtgagccaagatcgcaccactgcattccagcctgggcgccagagcaagactctgtctcaaaacaaaacaaaacaaaaaaacaaaaacaaacaaacaaacacaaaaacaacaaagtgtgttttatttttcaattcttattgatttaaaatgacataagtcaccatatttaccatccaaaattctgaaggaaaatcctgctatggtcagggttgagtatcccttacctgaaatgcttgggaccagaagtgttttggattttgaatattttccccagattttgcaatatttgtaatacttacagttgagcagcctgaatccaaaaatccaaaatctgaaatactgcagtgagcattctttgagtgtcatgtcgtcactcaaaaagttttagattttggagcattttggatttcggatttttaggttagggatgttcaacctatacatttgtgtctctatgtatatacacatccaaatcaacatctacatctatatctgtataatctatatatcttatctatattgcacacataattttgtcataaaattggaatcataatgaatctaaggcttggaaactagcttttctcactgagcaaatgtgtcgcaatcatcagtccaggtgattaaatctcacttccatcgtttttcatagctccctagtattctgttttgtgaataagtccatttgttcatttattctgcaaacagtctagatattgtgctaatatagggacccgtggcgggctgcaacagaaacaatccctcattcccagcagtttgcaactcctgatttcatttagtcctcaaaagaaccctgaaaaatgggtagggttagtttcattttatagatacaggaacagaggctcagaaatcctgtctaacctcagtcagttggtaagtggcagctgcctcctagcaggaaggatttgagatgatatctctacacctcctttctttccttcttttttcttttcttttcttttcctttcccctccctccctccctccctccctcctttctttctttctttctttctttctttctttctttctttctttctttctttctttctttctttctttttctttctttctttctttccttctttctttttctttctttctttctttctctttctttccttttctttctttctttctttctttctttctttctttctctttctttccttttctttctttctttccttctttcattctctgtctttctttttctttctttttctctttctttctttctctttctctctctctccttccttccttccttctctctctctctttctttctttctttcttttgatggagtttttgcttttgttgtccaggctggagtgcaatgccacaatctcggctcactgcaacctctgcctcccaggttcaagcgattctcctgcctcagtctcccaagtagctgagattacaggcatgtgccaccacgcttggctaattttttgtatttagtagagacagggtttcaccatgttcgtcgggctggtcttgaactcctgacctcaggtgatccaccctcctcggcctcccaaaatgctgggattataggcgtgagccaccgcgccgggcctctacaccctttttcttaaccacagtgtaatgcctcagcttaccactggatccccaattttggacataaaagttgactcctttttttgtttgtttgtttttgaaaaaactgttatgatgaacattcttgcagcctatttattccatgattattttctttgtggaaatttctggaagggcaaatggcaaggtttctggtacctgttgccttattgcccttccaaaaggtttgcaaggaaggctgatttgggagacaagggcagggagtgtggaggccaggagaggctcctgggtttccaactgggagcctgctggtctgactgtgttccctgttcctgtagaaccaccgtgactcgaggctgacaatcttcgagcaagagaacttcctgggcaagaaaggagagctgagcgatgactatccttccctccaggccatgggatgggaaggcaatgaagtagggtccttccacgtccactctggggcgtaagtgtattcaaggctctacctggcaggggaggggctactgggaggggtaggtgtacctcctgtgaaaactgtgtgctggggacttttgtgctctgatgcccacattccagaggagaacactgaggcacagggaggtatcaggcagaatttgagggactgaaacccagatcaaactggtttgagcccagaagatatttatcagcccctgtaattagcttcaagcatagctggatccaggtactacagcaggtatctctctccccccacaacccccaacctgttgccctgcctgcctctgtgtgactatattcttagacaagctcttcctgtgtgaaggcaaaggtggcggcttcatcgttacatccagccctagggaaagacagtgtccaggctcagtgattctattaaaggttccaagaaaggtgctcattggtccagctgggtcctgtgctcaactctgaaccaatcatcatgcccataggaatggggtgttctgattggctaggtttggtcatgtggtccattgctagattcagcctcattttctcaccttggctgagagtgagaggccacaggctctttggctagaagaggggagaatgaatgcccctagccataaaacacaggtgtggctccagcaacctgctcaaagtccatcagcaggtaggtaacaatccagcttcaaactcagcactgactggccctttcctttccacccaggaggtggcaggtgaaggctaaggtgtgagattcttatttagggaggacatcagaaccactttctgaggtgccccttggctcctggtaggcagggggcaaagatgggaggtagggtttttcatcttttttttttttctttttttggctttagttttctcaggaaccaccaaagaatcatgttgttttagagtaagagggaccccttgtgattcttgagttcacttcctcttttacagaaagggaaatggaggcttggaaaaccagacaccaatccttgtcctgaacagagtagaaatcaatgagttgggccagacacggtggctcacgcctgtaatcccagccctttgggaggctgaggtgggcggatcacctgaggtcaggagttcgagaccagcctggccaacatggtgaaagcccgtctctactaaaaatacaaaaaattagctgggtgtcgtggctatgcctctagtcccagccactcggatgaggcagaattacttgaacccaggaggcagaggttgcagtgagccgaggtcatgccacggcactccagtctgggcaacagagtgagactctgtctcaaaaaaaaaaaaaaaaaaaaaatcaatgaattgaaatgatagctttttttcttggaagtgcctctggataaggaaggagggagaaaggggaaagaacaagacttcccattccttcacttgttcacttattcagcaaatatttaggaaccccttcttccttgctagacttttatatatttatgcaggtggtgataacgatgaacaaaacacacgttcctacactcaggagcttgcctgctggcaggggaggctgatattttacaaataatttgaaaactatcgaattacatgagtgctacaaaggtataataagggactgtggcctgatttggggaacgagtcagattgccctcataattaagatgagccatgaaggacaaatacaacttgtctaggaaaagaaaggctgggatggtgcttctggcaaagggaatggcatgatcaaaggccctgtggtaggggagagagcatggcacattgtgagcactgaagaaaggccaggatggctggaattgtgtgcgtgtgcatagatccctttgcccctgtgttgatcaccatgctggtgtctctgtagagtaactgtctgccttttctcttttccagctgggtttgctcccagtttccgggctaccgaggatttcagtatgtgctggaatgcgatcaccattccggtgactacaaacatttccgggagtggggctctcatgccccgaccttccaggtgcagagcatccgcaggatccagcagtgaacaggggtgcggcacggaggagcgcatgcgtgcttatctgcaatggaggcgctctggaggctgtggtgtgttctctccttctgcctccccctgtaacctgtgtgaacccagcacccatgtgaactggtccgtgcacagtcagcacaaaaaactcaaacgaataaaaaagagaaagtctggtattagttgtgcttttcaattttattaatcttttcaaagaaccggtttttagccttgttttctctatcattattccactgatttttactcttaacttcagtatttcctttcttctatttacttcaggcctactttgttcttagtttttctagcttttttttaaggcagacttctgggtcattaattttaggcctctctttcccccacccagtacggtcatttagctataaatttccctccaagtatggctttagctgcttcccacaaatattaatttgatgtgttttcattatcattcagtttgatattttctagtttcacttgtggttttttttttttcttttgacctatgggctatttaaagggatgttatttaaattccaaatactttaggattttctaggtgtttattgttattggtgtgtttttaaagaccaatgtggtcggagaacatattccttaagatttaagtcttctgcaatgaattaagacttattttatggcccagcacatggtttttgtattttaattttattttttgtttgtttgtttgttttgtttttaatgagtcaaggtttcactcgtcacccaggctggagtgcagtggtgcaatctcgtctcactgcagcctcgacctcccaggttcaagcaattctgccttagccccacaagcagctgagattacaggtgtgtgccaccacacctggtaatttttgtatttggtagtgacagcgttcgccatgttgcccaagcttgtcttgaactcctgagctcaggacatctgcctgcctcagcctaccaaagtgccaggattacaggcctgagccactgctcctggccacatggtctatctttgaaaggcttggtagtacacttgaaaactatttatattctgcagttattgggtacagtgttctgtaaatgtcagatcaaatttgttaacagtgttgatgcgatttttctatacccttgctgatttttttttttttttttgagacaggatctcattctgtcacccaggcaggagtataatggcacaatcatagttcaccgcagcttgtttttaaaaaatcaattttagtgaattacatagaaagaatcattgattatttggatttatctgtttcttaccttagttttgtctatttttgcttcctgattttttttttccttcaggaattgtgatgctctgttgttaggtgtacatatatttatgattgctatgtcttcttgataaattgttcctagcttgtggttttcaaagccacgcatggagagtcagatctctcccctagcaaaacttcttttcacgcgcgtccgtgtgaagagaccaccaaacaggctttgtgtgagcaatatggctgtttatttcacctgggtgcaggcgggctgagtccaaaaagagagtcagcgaagggagataggggtggggccattttataggatttgggaaggtaatggaaaattacagtcaaagggggttgttctctggtgggcaggggtggatctcacaaagtactttctcaagggtggggagaattacaaagaaccttcttaagggtgggggagactacaaagtaccttcttaagggtgggggagattacaaagtacattgatcagttagggtggggcaggaacaaatcacaatggtggaatgtcatcagttaaggctgtttttacttcttttgtggatcttcagttacttcaggccatctggatgtatacgtgcaagtcacaggggatgcgatggcttgggctcagaggcctgacacttctcataccttttttctctcttcccaattctctctctcacacatactaccctggagtttctcatttaacaccctccatgctccaaagaaagcctataaaacaaagaaacccctgtttcacttgaagactaagtggcaggattggtctcttctatctctctttttctcctcccctccttactttctcctggttctgcattttataggttgtctaaacctctctcatga

SEQ ID NO: 16686 - DNA, 22634 bp, Human
tacaggacaatgcaaaaaaaaaaaaagaaaagaaaaaaagaaaagaaaataaattggctccataagacagggcaaaaaagaaaaagatataatgaaggatacaataataataataaatgctcagagtggagccaccaacatggtgggccatcccccttctctgcccccaccctctggcagacagcccattcctggggctttagggggggcacggaactgccccagatgacctggctttgaagcctagactggtgggtgggccctcaccacaggcgtcttggccccagttccagtggctaccccatcttgcagttcctgcccacaccccacccaccaagtcttggcccaggatgaaaggccaaggagaggctaggaagcgagggggtgctgggtggtggagggacagaggcaaagctggctccaggccagggagagttcaagacagagctgggctccacggggagcctagaaccccgaaaaagaagagacaggagcctatccagatgcccccgcaatataccctgcctgggactggggagccgactgcaggtgacctagctgagcagctccccaggctccttctgaccccagctgtactgtgagttcccgccatgtgactatgttgaagtcatttgttccacctgggcctcggtttctccatttgtgaaatgggaggattgggccctgtgatttctggcgtctgttcctccgtcctgaggcttgatcaccccaacttgacctctgtctctccgtctctcgctccttcactgtccatgtcccctgtgcctctctgtgtctctgtctccacctctctctttgtctgttacttctatctgcctccttacttctctctccttgccttggtttccctatctcctccgtaccctaccttctgttccgatccattggaaccaccattgagtcaccagttattgactgagaacccatgatgtgccaagctctacctagccaggcccagctaggtgctggggccagtggtgaacaagatgtggtgggcatctggggcttgccagggcaggaggctctgggacaggcagtcatatttctggccaccagcactgtcctccaggtcagataacgtggcctgggtagaggcggggaactggggtggcgagagggatcactgtcgataggtcaggaaaggatggggcccaatgtggggaaaagaaaaagacccaggtctccgatatccaacccagctgagcacagtgcgactctcccattcccaccccaacctacaaagaggaagtcaggccagggggcctcaggccaaggtcaaggctggacagcaggagaagaaagcacacaggcccagagctggctggcctgggctggctctgacctctctgtgccttcactttcctcttctgtgaaatgggcataatgaaagtaccaaataaggcagattgtcccggggactgaccgagataacacgggttcggcacacagtaagcactccgtaaaaaaggctgtccatatcaaacccacatctgcctttacaaaacgcttctgtgctcattgtcaccttcttttctatatggcatccaacagggacacgtgcccaccttataattgcagacacagaggcccccctaggggtagagacctaccaaaagccacacagcgcgcagtggctgagtcaggattcaaactctggtctcctgcctcccagggtctccccttttccctgccccatgttggcagccagcagggacccttttgggggcccatccctggctggggttgttgagaaaggagtcagggtagggttggaaggtgaagctgctgtggccagggtttctgctgtgtgtgctggtctcacaaaggaaagtgctgctgtctgcagtgatccaggcgaggtcagggccccagtcccccactccctgcccaggcctgctgagccagcttcccctttgtgccacagactatagggcctgatgtctgccagactataaaatggggggtcggactctagtcacccatagcacctgcccgcctgcctgtcctccagcaggaagtagcaagtccccaggtaagagggaacccacagcccagctgagagctgaaggggaggggaagagaaaagggagacagagagagggaggcagagatagcagtgccatgagagtcagagagcagggccatggagataaagacggaagtggagagaggaagaaagggagggagagggagaggggagagagtgagaaaagacagaaatagagagagaagtaaatataattaaaaaggacagatagagagataagcaaagatacaatgagggagagatagtgggggagagaggaacagagagggagagaaacagacaggcagataggcagaaagagggagagaagtaagaaacagatagagaggcaaagacagggaagagaggaggaacagagggagagggtgaagcagggagagagagagaatgagaatatctccaggaaggcatgagtccagctgccagccctgggggagtgtttaaagccacagatgtggtccagatgtctggcctcacccctggtgaacagggggcaccccagaatatgcacagccttcctggaggaggctgggggagggatgtgcttatcccaactagctccgccttacagaatgtgttcgggaatcagcttgaccagagggtcttaatctgtgctagcagggggtcctcaaatcccttaacattgtctccaaagttaaagagagcattatttttgtccggggacaaagttgaggtattcatcaaacattcaaaggagtccacgaccccaaagcaacaaggaaccactggaattgaccaaagccctctccacccaaagcctacccagccccagtcctcattttcagaaccctccacatgcagtaaatacatcctcttgggtcctcccataagcctcagtccccggcctgtatttgcacccatacaccaacccctcagaggaagcagacggggaaaggagctgggagcatgcattcattcattctctgaacaaatgttaattgggcatctcctatgtgccaggtgcagagcaagtgttagggatggacggtgaataaatcagattaagcaaatggcagaatactttaaaagcccagttgctggctccatttccttgagttgaaatcagagccctaccacttagtagctgtttgggcctgagctgggccccttccttctccagccccctgctgctcagaggggatcatgatagcagctactccatcgggtgaggttcatggtcagatgggttaattaatgtatgtcacagtgcctggcacaccttaagtactcccaaatgggacttcttgttattagtctagggaggcaaattggagttgcacaagcaaatcagtgtgataagcagtgtggaaaattgcagggggctaaggaaggacctagcggggtaatggagggtggaacagctagtggagggaaccgcatggtcaaaagcctggaggaaggatatatgtgggatgagtggcccccagacgggaaggtcttggctgggaagtagggatgaaagaaaaacttccaggcttaaccgtttcagaaggagatagagaggaaacgagctccaaggaggctgaaagcacaggatgtggggctatgagggcaggaggcagtttgggggtgtcatccctgaaggccagagtttctttacagacttttgcaggcgggaaccatgtctcaggctgcaaaggcctcggcctcggccacagtggcggtgaacccagggcctgacaccaaggggaagggggccccacctgcaggaacatcccctagtcccggcactaccctggccccaacaaccgtgcctattaccagcgccaaggcggcggaactgcctcctgggaactacagggtaaggacctgggggtgcagtggctgggtgccatgccttctttccttccttccctcctcctccttcttctcctcctcctcttcctctttcacctcttactcctccgcacctctttctcctcctttttcttggcttattttctctcctttctatttactctcccttttcttcttctccacctccccagactcttatcctctgtccctattctctttttccctcaccttggcctcctcctccctcctccttctgggacacaagtgtggcccagccaatctgggagcccataaaatagccaggggttctgacacacttggagaaagtggggccgggcgcagtggctcatgcctgtaatcccagcactttgggaggccgaggcaggtggatcacctgaggtcaggagttcgagaccagcctggccaacatggtgaaaccctgtctctactaaaaatacaaaaattagccaggcgtagtggtgggcgcctgtaatcccagctacttgggaggctgaggcaggagaatcacttgaacccaggaggcggaggttgcagtgagctgagatcatgccactgcactccagcctgggcaacagagggagactccatcaaaaaaaaaaagaaaagaatagaaagaaaaaggggacctatagttgagttgtgcaataacaacaaccaaaccataccgcttcacagctgaagggacacctggcaatcaggctacacctgcacacgcacatgcttagagtttatcgaaagcaagaaaaaaaaagaagaaaaggaagtgggctggcttagcagcagggaaccagctgtccttggaggctcactggggcagcaggatggcctcagaccctcaaaattgctcgaggtggtctgggctgaaaggcatcctgtggagcaaggtgtccagtcccctgggatttggtttggtgtggtttcaacctcaggtcacagaagtaggccattttgcaacccctagttcatgacacgctctcatgtggtcagtgcgtggcaggtttttatttatgtacctatttaatcattagttttatttaatttctaataatgcaatatgcacctacaaacccaccacccatataaaagccaggacttggttaaaaactttctacctaactctaaggtgtctcccttgagtccatcattttcctccccaactccaggaaatactgtcctatcctcaacctgtgtctgtaatctgcttgcttgcttttgtatacaattttatgcattattcctttaaaaatgtatacacacatacacatgtatatttatttacttgttttatttattcatttattttgagaccgaattatgagacgggttttgccatattatccaggctggtctcgaactcctagcctccgcctccccaagtgctggaattataggtgtgagccaccgcaactggccgatttacttgtttttaatttattgaaatatgcaatgtgattattctgggcttttctttgtacttttcacttactatgagatccctaatatccatccatattgttgcgcatgactgccggccattcattctggctgctgcctgatatttcagagcgtgaccatctctttcctgctaagcacgatttcagtggttgctagctttgctctcgtgaacagcatggcttggacgttcttatccctgtctcctggtatcggggaacctgccccgatattcacatagattcttttctatttttcctaagcgtcggccagcttgagaaataaagggacagagtacaaaagagaaaaattgtaaagctgggcgtccgggggagacatcacatgtcagtaggttccgtgatgccccacaagctgcaaaaaccagcaagtttttattagggagtttcaaaaggggagggagtgtgagaataggtgtgggtcacagacatcaagtactttacaaggtaatagaatatcacagggcaagtggaggcagggagagatcacaggatcacaggaccggggcaaaattaaaattgctaatgaagttttgggcaccattgtcattgataacatcttatcaggagacagggttttgagatcaaccggtctggccaaaatttattaggcaggaatttcctcttcctaataagcctgggagagctatgggagactggagtctatctcatctctgcagcgtcgaccataagagacgaccacgcccaggggggccagtttagagacctaaccccaggtgcgcattctctttctcagggatgttccatgctgagaaaaagaattcagcgatatttctcccatttgcttttgaaagaagagaaatatggctctgttctgcccggctcactggcggtcagagtttaaggttatctctcttattccctgaacaattgctgttatcctgttcttttttaaggtgcccacatttcatattgctcaaacacacatgctgtacaatttgtgcagttaatgcaattatcacacggtcctgaggcgacatacatcctcctcagctgacaggattaagagattaaagtaaagacaggcataggaaagcacaagggtattgattggggaagtgataagtgtccatgaaatctttacaatttatgtttacagattgcagtaaagacaggcataagaaattacaaaagtattaatttggggaactaataaatgtccatgaaatcttcacaatccacgttcttctgccatggcttcagccagttcctccgtttggggtccctgacttcccgcaacatcccggggcacacatacaggagtttctcttgggcaaccaaaggtagaagtggaagtgctgggtcatggttatatgaacctcccctcctcttacagctggggaaactgaggctcaaagaaggcagaaaattgtgccttggtccatgtgaatggcaacgttgtcccaacttggaacagcaagtggacaaggaaccaaacatgaggcttagtgaggagagaagattagctcaagttttcccctatgttgtggagggttggatttgcaagtgtctcctgagcatcagctctgtggcaggtactggggctggggctggagatacagaaattgatcaacctcaggccctgccctggaggagtccttggtctttggaggggctgggtaatgggagagagggagtgcagagagagagggagaccccaaagcaaaacagcagtgactgtgtggtgggttagttgtgctgctaatggggagaggacagtgggggatgctcaaccaaggccgatggaggaaggggcaatcagagaaggcttcctggagaaggtggcacctgagcctaaaacagaataacgagctggaatgcgtattagggaacttcagttaggcagtgggagctccaagctggatatgtgtggtggagaaggcattccaggcaggaggaatagcacaaagaaaggcctgaaagggaggttcataagttcctaatgatggcgcagatcttagcttcagaattagggcatgaggccaggtgcaatggctcatgcctgtaatcccaacactttgggaagccaaggcaggccaatcatttgagctcaggaattcgagaccagcctgagcaacatggcaaaatcctgtctctacaaaaaatagccaggcatggtggtgggtgcctgtaatctcaactactcggaggctgaggtgggaggatcgcttgagcctgggaggcggaggttgcagtgagccatgattgcgccactgaacttcagctggggcgacagagtgagactcagaaaaacaaacaaacaaacaaaaaacaaaaatcagtaaagaattgggggatgggaggacaggatcatttcacaaactgtggctcatcacacttttatgtgactcctgcactgctggcttttatttatgtagatacttaatgaatttttgactcccccctcactctgcccttggcatgggggcttctctcctgcagctggtggtcttcgaactggaaaacttccagggccgtcgagcagaattctcgggggagtgctcaaatctggcagaccgtggcttcgaccgtgtgcgcagcatcattgtctccgcgggaccgtgagtactgggcggcggaggggcacactctctgccacagtaaaatgaccacacaacagtagctgccatttctccagcatctgctctgtgcctgcggccgttcgtactcctggcacatacattatgtccaatcctcatatcaaactgaagagggaggaattgttctcaatctcattttacggatgaggaaactgaggctcggagaggtgatccaattagcataagatcacactggcagtaagccatggttctgggctctggagaaatgctgcttctactatagcaaaaactctagcccggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtctgcagtccggcctgggcgacagagcgagactccgtctcaaaaaaaaaaaaaaaacaaaaaaaaaaaaaacaaactctagcccattaccgagggctgagagaggtcaaagagtgaagtgtccactcgctgtcccctctcctgggcgtccagctgcctgggagtaatgataagcatctgtggcacacccaccaggtgccaggcactgactcgggaccacacctagatgattcacagtgctgtaggaggcagaggctattcttatgcccacttgacagatggaaagactgaggctcagagggggtgagtctcttacccaaggtcacctattggtaagtggcacagccaggattcaactcaggttgattgagttcattcctaaagctcttaatcaccatgcttcactgcctgttcctgtctctgtgggtgtctctgggccttagtgactcccatataaaacagggatagtcatccttgggcagagtggttgccctatgtccagcctgtgtgtgctgaggtcagggtggaggggcagccccaggacaagatccacgcagctcgtttgctcttgtctcccccactttgaaagcctgcaagggttccagtcatcctgtattctgagcccattccgagatgagctttgaggtcagacaagcctgggtttgagtcctgacttcccctgtttgccttgttcagtgtgcaagcctcagtttccccatctttgaaatggggagaaggatggccctcaccactcctcacaggattatgctgaggtctgagggagatcatacagcatgggcctgttaccttgtgggcacccaaacatggcaggtgactctgatggtcacgtacccacctccctgcccggtgaatttagccaacttatcctggaggctacccgggaccatttctacctcctgcaccctcagtgtggtcaacgcagcctcagctccaccctcagccccaaaacccagctggaagcagaagctaccggatgtggccagcatgggttttcaggctttttttggtaccagtgactcaaacccagagtatttctcctcaaacaaagatgcagctggtgtctgacgtgtgccttggagccgtgcctgatgggcatggaaacgggcctgtggtccgggggcctgggtctgtgtgggcgctggcagggccatgggaaaaaaagaatgaagagggtgaggtaggcatggggaaagtgaggaggcctgcctgcctgaaacccaggagactgcagcctgacacccaacaccatcatgtgaccttaggctggggacttaacccctcttagcctcagtttccatatcttataaattaaaattcctgccctaccctctctccctgcttgcgggttgaaatgagccatgggagataagaaaaggcatagatataaacatttaaaatttagatcctcactggtcctgctgaagaagataggggagattttagggggaccttgggcatggtggcaagaccacatcagtgtctgtttttccagaagcctagacctccagtttccttctccctttaatcaggaacagtattaatttggaggcttactctgtgctgtatctgttccatgcattccctcttttaggccctcataatctcccaacaaggtagatgcaacaaagtagatgtatcatttcttctctgttactaaagcttagcaggtgtaagtgctgcccaaatgcatgcagcaaatggcaaagcttggattagaattcaggtctgtctgtttccagggtctgtcctcttaactcctacatgaaaccaccttccaaggctcccttcttattcacccatgcgtctatccacccatttattcatcatccatctacttacccatgcatctacccattcgtctattgatctatccatacatacatccattctccatttatacacacgtacccaccatgtgttctccatcacccacccatccatctataaatctatccatctacccacccatccatctacccatctagctatccatcaattcaaccatcccttcatccatccctttatccatgcatccattcatctgtccatctacccatccacctatccatctattcaaccatcctttcatccacccatccatccacccattcatctgtccatccatccatctattctcccatttatttctcttctactccagaccagacagggctgaggcaaatgcaactctattctgggaagacaaacatatctttaatttactccagtgtggttaactcatctctcagacaaagacctgaggctcctgtgatgcattctgtctcagcccatggtgatagcccatcatccttgtctccttctggggagagcagggtcccagcagccccctgggagaagatgctagtgtcagtgtcccctcatccgtctcttttttcctaagaactcttgaacacacggggagcaaaggtcaaggagttccttagtctcagctttctcatctacggaatggggattgtcttatctaccccacctgcactgccacaatccctggtccctgtaacacaagctcacttcttgtccttaatcaatcttcactgggaaagccaggaaaatcttccatctaatttcaaacttctaattagtccatgtaaggaacctagcatcttcataagcgctatcacattatattaccataggtatctgagggtagatattaccatcattcccttcccattgcctcatactagttactgagtatctcccgaataccaggccagtatttacccagcaaggatgcaaacacctgtatcaatttttcccttacccctgtacctccgagactgtcgttcatttaatatatttcatttaaaatgatcctgctaaccacaaataaacacattttaaaagaaccctgacaccactttttacaaatggaaggctagtattatttcctataagtaaaaggtatccatacaaaattaacaataaacacaaaagtggtattattatgttgctattacaccattgtctgctggaggttctgggctagtggtcttttctctctttgttacaaaagaaaaaaaggagagattagtaagtgttaaaggcacattaacatcaaacgagcctttctcctagctggcgtcaagtttcaaatgtctatgtgttccttggctccaagtcctgatagtacttgaagcatgtatgaaccttacatctagagaaacagtgtgctcagataatcacacacatttatctcacttaatccttcaccaactccaaggaaacaggcatatgagtgtagatgagaaacaaaggctcagagaggtaaagtcacttgcccatagtcacacagcctgtaagtgtcagagcctaaaatcaaacccagacatgttcagccccctttggactttcctactgtcctcagggctgccttgccaggggagagagaaaggcaagtagggagtgggggcttctactaaccatatgtctcctgtctgcctcatggtccttcttgtatccagctgggtcgcctttgagcagtccaacttccgcggggagatgttcatcctggagaagggcgagtaccctcgctggaacacatggtcgagcagctaccgcagtgatcggctcatgtccttccggcccatcaaaatggtgagtggctctccggctggggctggagaatcagccaggcggggcagggcaggtgtaagtctgagatctgacaagggcaagaaggagatgatggtgggtagggaggcgtggcagcctccgagttgtcaaaggaccgtggattcttgagctcatcaattcatcagtgtccttaacacactcactacatacccagctaggaaccctgggcaaatgataagcacaaaagcttccaagttagagctaaaaacttcagcatcttccttgattctcttgatatccctggctgcacatttagaccttactgggagctttttttttttttttttttcccaaagatggggttttgctgtgtcccccagcctggtgtacagtagtgtgatcatagctcactgcagccttgaactcctggcctcaagtgatcctcccgcctgggcctcctaaagtgctaggattacagccgtgagccaccatgccaggcctgggaaaacttttcaaatttcagtgcccattcgaaacaccaaacatgctggttgcagatcatgcaatggctaagaagagggatattgtagccgggcatggtggcccatgcctgtaatcccagcactttgggaggctgaggtgggtggttacccaaggtcaggagttcaagaccagcctgatcaacatgacgaaaccccgtctttactaaaaatacaaaaattagccgggcgtggtggcgcatgcctgtaatcccagctactagcaaggctgaggcaggagaattacttgaacccgggagccagaggttgcagtgagccgagatcatgccattgcactccagccggggtgacggtgccagactccatctcaaaaaaaaaaaaaaaaaaaaaggagagggatactgtagaaacgcagcttgaacctcttaataataagacaatatactgaattagtttcttataatatttaactaagtcaacttccagaagattcaaggtcaaaatggtggcgatatctccaagtgattcacagttttttccagaattaagttgatgatgagtcatgaaccagctacatcttactcaccaatgttagttgctgatggtaaccgacttttgtcttccatgatgggaacatttataagaattttcatgaatgtgcatttgaggctatcaagtgccaaccaccagctgttttgacatcaccaaatttatcttaatggattattcaaacagatcattcccaacacttttcgcagaatgtaagactgaattatttgccttcatgatgcactctctgtaagaattcacagatgtctctctcaatcattgaatggttcttatatgccaacctatgttaaggggtttgtttggaagagtgatcaaccagggcatttccagtagcttctagaagcttgctattcaacataataggcagtagccatatgtggccattggacacttgaattttggctaaatggagatgtgtcataagtgtaaaatacatattaggttttgaatacatagtaaaaaaaattttaaagaatgtcaacaatgcattgatatcattatattggttacatattgaaattataatattttaggtatatttgtttaaataaaatatgttattagaaatgtttagaaatctcaaagcctagaccccaccccagaccaattaattctgaatctctagggctggaactccggcactgctatcttttctatgccctctaagtagtccgtctgtgcagccagggctgagatccaaccatctaattcaggggtgcccaatattttggcttccctggcccacgctggaagaattgtcttgggctacacataaaatacactatcactaacgatagcggatgagctttaaaacaattgcaaaaaaaatctcataatgttttaagaaagttcacaaatttgtgttgggccacattcaaagccatcctgagccacatgtggcctgcaggccgcaggttaaataagcttggtctaacccttcctctctctgccctgccacagtcctggtccaggccaccatcatctctgacctggtcatcttcagctctctccctgctgggttccctgactcctttccagccccctgtcgtgggaagttagagggatcttttcaaaataaaaaaaaaaaataaacctgaccatcttctacttgaacccagacattttggttggcctgtttctattttcctttttttttttttttttttttgagacacatctaactctgttgcccaggctggagtgtagtggcacgttctggctcactgcaaccttcacctccctggggcaagcaattctcctgcctcagcctcccaagtagctgggattataggtgtgcaccgccacgcccagataatttttgtattttttatagagacagggtttcatcatgttggccaggatggtctcaaactcctgatctcaagtgatctacccgcctgggcctcccaaagtgctgggattacaggcatgagccagtgcgcccaaccagttggcctgtttctgccaggctctggttctaggctctgagtgcaaaactgtgcatcaaacagactaggtccctgtcttcatgggacttaagctacccagggaggcagctatcaaaaagctaatcataaaaatccatctacaattgcaaactgtggtaggtgttacacaaaggccatgcaatctaactaggaaagcagaagcaggaactgggggctcagatattgttagaggtgggagtggtcagggggtcatcagggaagccagctcccaaagtttggaaaccaactcagccacgtgaagagcagatggtaaagccttccagggaacagtgtgtgcaaaactcctagagcaacgatggactggtgggaccaagaaaattaaaggtggccaacaaagctgcagcagagggagtggaggaaagagggaggcaagatgggaggggaggtggtggtggagaccagggtcttgtagggtctcataggtggtggcaagttcagtcttgacccctctagcagtggggagccattgactaacaaccttcccaaggccctcaagaccgtaacagtaataagtaatcattgttgtacttttaccactggctggtaattgcactaagggcatttgtcttgccatgccccaaagggtcccctgtgcttacatccctgcctggcaccttgcacttgccttcctgcaccctggccacacagatattgtcttgcacattcccacctcccagcttttgcctatgccttctctgcctcagtgccttccctcaaccctccttcccttctcagctttgtgcactcctccttaacctccaaggtccctctctagtgtcacttcttccatgaagccttccctgatctgctctgcttttctctggaagaattaaccagttctttcttcatctataatctcctactggagtctttcacagaaggatgcacttacgttctgggctcctcttcctcctagtggtggtgaataacagtagataataacagtagataatcacagcatccatttttaagcaccaactacgtactgggtatattacctgccttttacataatccctacaactgtcctatgctacaggctatgataacatgcattttaaaagcaaggaaactgagactcagaagtagaaaatgactggcctaaggccacacagctgggagttgctggggctgggatttgaaccaaggtctgtgggtttgaacctagacactgaggtccggcatcactctgctatttcctgttcatctctttggctcttcaaacccttgggcctaaaacagtgcatgatgacttttgaaaagatggatgatccctgccctcagaaataacagacgaactttaaaaacaagatacagggtcatgaaagcattaaaaataagtgcaagccagaactgaatcatgtgcccacattcaagggtgggcctggttgtttgtttgtttgttttttgagacagagtcttgctctgtcacccaggctggagtgcagtgacacaatcttggctcactgcaacctctgcctcccaggttcaagtgattctcctgcctcagcctcctgagtagctgggactacaggtgcgtgccaccacgcccagctaattattattattattattattattttgtatttttagtagagatggggtttctccatgttagtcaggctggtctcgaactcctgaccttgtgatcccacccatcttggcctcctaaagtgctgggattacaggcgtgagccaccgcgcccggccaggcctgttttatagttggactgaaccgtgagttgagtagccatgacaatcccacgaagcaatagtaaccccattcttttttgttgttgttgtttgagacagtcttgctctgtcgcccaggctggagtgcagtggtgtgatctcgcctcactgcaacctccacctcccaggttcaagtgactctcctgcctcagcctcccgagtagctgggattacaggcacatgtgattgcacctggctaatttttgcatttttagtagagatggggtttcaccatgttggccaggctggtcttggactcctgacctcaggtgatctacctgtctcggcctcccaaagtgctgggattacagatgtgagccaccatgcctggcaataaccccattctacagatgaacaaactgaggctctgaaggaggcagagtaaaatgtccaagatcaccagtgcataaatgtcagaggcaggatttgttttttgtttttttttttttttttttgagacggagtctcgctctgttgcccaggttggtgtgcaagtggcacgatctcggctcactgcaagctctgcctcctgggttcacgccattctcctgcctcagcctcccaagtagctgggactacaggctcccaccaccacgcccggctaattttttttgtatttttagtagagacggggtttcatcgtgttagccaggatggtcttgatctcctgaccacatgatctgcccgcctcggcctcccaaagtgctgggattataggagtgagccatcgcacccggcctagaggcaggatttgaacctagatctgtgttccaccaatgttccacgtttcacctggtttgtaagaagcatttacaaaagggcaattggttaaactcctgatggcacagggacactgcttaggaatgaagtgtttctctgaaaggttctgcccctccctggctgtgtgatgttgatcaataagcttgacctctctgagcctttttgtccctgatcataattttaaaaataataaatactttttttttttttgagacagggtcttgctctgtcacccaggctggagtgcagtggtgtaatcatatctcgctgcagcctcaacttcctgggctcaagcaatcctcctgcctcagccttccaagtagctgagactacaggcatgcaccaccatgcctggcaaattaaaaaaaaaattatttttttgagagacaggatcttgctatgttgcccaggctggtcttgaacccttggcctcaagcagtcctcccacctgggcctctcaaagtgctggaattacagacatgagccatggcacccggccaataaatgcatttattgagcacttgatgtatgccaggcatcgtgctcagtgctctatatggatacactcatttcatcctcacgaggaccctatgacgtgggagttgtcatcccattttccttatgtctccttccagactagacagcagtggtccctggagagtcccccagcagcctgaacaggctcatctctctcgctccacacccagaaggccccgctaagtttcttctctttgtcccatttgtacttcacacacctgacccggcctctctttccccaggatgcccaggagcacaaaatctccctgtttgaaggggccaacttcaagggcaacaccatagagatccagggggacgacgcacccagtctctgggtctacggcttcagtgaccgcgtgggcagcgtgaaggtctccagtggaacgtaagcatccctcctgccaggtccgcgtcccctgcttcaagcacaggcagaatcagaggctgctccccttacaggttataacatcagattcctagagaaggccatggccccttccacagtctcccagtgctggttcctgggatcagccaacagagctctattcctctggggaatagagtcacactttgaggaattccaggtcagtgtaaacaaatcagctctaaaaagctgttagatggagaaaataggagctgctaagcctagttggggttgaaggagtaatcaactaaaagggccggcgctgatgtggatagatgaggctggatgcatccaggagcagggaatattcagggaaatcagaagcttctgggagaatgaacagaatgagttctgagcagtgaatttgcatcataagatggccctgaccctgctactgacatgctgaggaactcgagtgagcctaaacacctctctgcctctcagtcttgccagctaggcaatgggcacacaaaattccctgatccaagagtgcccttcctgctctgaacgctcaggatctgaagctatcaaaacggagccccatgaccttatgtcatgagaatacatggaagggccagatcaaaggagtcactttatccatccccctgcctccaaatgaccatgccagacacccttgatctcctctaggtaaacgtaaggctctgtctctccattcccagacttgttctgagctcctgtaacaccatcatggctatggcctttttcttgttcctttctgcctccctgaaacctatatccctgccattcaagccatctgaaatatacggagccttgtctgtgagccaggcactgtgctaggtacactggggaaagcagcgatgaatacagccaagttcctaccttcaaggaacttacttggcctagcagggaaacccagatatacctgtgagatggtgtccaacaatactaggtaaagaatgggccagccagggcaactgtgttgtaggaggtcagaggaggagaggtttctaggatttggctgtgtatgttagggcagagggcaggtcaaaggtttatctgcagaggatggaacttaaaccaggctttacaatatagggagggggtctggcagaagcctggaaagaccctctcagcaaagacaatgagagaagttagaaattaatcactgatgataacttctattgagtgcttactatgtaccaaggactgtgctaaccactttaaatgaataactattaaatcttcataacaaaccaaggaggtgggtgcattatcatccccactgtacagacagtacattgaggttctgataccttatccacctagattctcacagctagtaaatcaatggcagagctaggatttgaacccacatatatttgataccagagtatgtgttcccagctgctacgcactgatgcacttacctacaaagaaaaccaatttttttttttttgagatggagtctcgctctgtccctcaggctggagtacagtggtgcaatctcagctcactgcaagctccgcctcctgggttcacgccgttctcctgcttcagtctcccgagtagctgggactacaggtgcccaccaccacaccctgctaatttttttgtatttttagtagagacggggtttcactgcattaaccaggatggtctcgatctcctgaccttgtgatttgcccgcctcagcctccctaagtgctgggattacaggcttgagccaccgcgcccagccaagaaaaccaattttttgaaataacacttcctctctttcatttgcttcattgttaaccagtccctaagtcctattcttgcttccttggatttgttctctgagccctgcatcatcacgtttaatgggatgtgtattcatattcctaccatgcacaggcaacatgcttagcaaacacttgaggtgcattctccatttggtcccccccagcactcttaataaaaccaggcaccgtgaccatgctcacttcctagaaaaggaaaccgaggcctatcagagaggcaaagtccttgccccagggcacagagcaggaagggatatagccaggacagaagtgagagagcagccgactgcagggatcaatgaaggacaggctggtctggcaggggtctgggtgccaggcaacgagacaggctgtctccactctgtccttctcacttttctctcagatgggttggctatcagtatcctggctaccgcgggtaccagtacctcctagagcctggtgacttccggcactggaatgagtggggagccttccagccacagatgcagtccctgcgtcgcctgcgtgacaagcagtggcacctcgaggggtccttccctgtcctggccacagagccccccaagtgagtccacacctcactctgctaccttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactgaaaagttctttctgcctgttatgtgagtctaccaaatgtgtaggcagaaatgaataaggccaagttcctgccgtcaaggagtttgctccacctagcaggggaaacccagatacacctgtgagatgctgtccaaggatactaggtaagagatggtccagccagggcattcgtgcagcaggtcagaggaggcaggttggtttctgggtcctgaatggatgtgttggggtggaggacaagtacttggccttactcattatgaagactgctccaggaggttggtatgaggaaattgaggttcagagaggggaagtgattttcccaaggtcacacagttagcaagtcaagacttgaattcaggctgtctggctccagagcctgtactcttcaagacaaatctataaatttttttcaaactgtagccagttgagcatcccccctcaggattttttgcactgtctgcatgccacctggtctacttttgacatatttttatttaaatagacttattttttgtccttaaatgcactgatttgtaaataaatccttataatgctccaagaagtggaaaatcagcatcatatacatagaaagcaatcacacaggctgggcgtggtggctcacccctgtaatcccaacactttgggaggctgaggtgggtagatcacttgaagtcaggagttggagaccagcctggccaacatcgcgaaaccccatctctacaaaaattccaaaagttaacccagcatggtggcgtgcgcctgtaatcccagctattcgggagactgaggtggcaggatcacttgaggctttagcctgggaatttgaggctacagtgagtcgtgatcatgccactggactccagcctgggcaacagagtgagatcctgtcaaagaaagaaagagagagagagcgagaaagagaaagagagaaggaaggaaaggagagagagagaaaggaaggaaggaagcaggcagtcgtataaataaatcaaatacaatttaaagaaggccaagtatcaaatttccagcagataccactgcctgcaacctgttcactcttcgacaaaatgggagattagccagtgttgaaaagtgtgaaagaggaccgggtgcggtggctcacgcctgtaatcccagcacttcgggaggccgaggcaggcagatcacttgaggtcaggagttcgagaccagcctggccaacatggtgaaaccccgtctctacaaaaatataaaaaattagccggctgtggtggcgggtgcctgtaatcccagctacttgggaggctgaggcaggaaaatcgcttgaaccgggaggcagaggttgcagtgagccaagattgcgccactgtactccagcctgggtgacagagtgagactccacctcaaaaaaaaagaagaaaaaaaaccaacaaaacaaagaaaagtgtgaaagatgtttgcaccaaactgagacttttttcctccttgatttaatcaataaaggttgaaaagagcatcgttttcttgtatctgattcagtgttactcaatcctggagctggggtacatcaggaatcatctcatttggaaatctgtgccagacactattgtttcccatatcaacagttaatattgattgatgttattaatcattaatctatgcagacagcctggtggaacggggtgtcggggttgctatggatatcttcctggaggagggaatatctgaagggggccttgaaagatggagcaggagcttgcttgatggagaataggggagatgatattccaggcagagcaaacagcagtgtccccgctaccccatatggcacctttgtgcaaatgataaaaagatgtctcttcctcaagacattttactgccatctgttagaaattattggtataaatctg

SEQ ID NO: 16687 - DNA, 13518 bp, Human
cctttaactgttggaattccgagtcttgctatacctttctctcgtgccccacctttggaacgctggctactcattatgggatgccacccatcctagccgtcgcctgcatatattgggtgctcattatgacgtggtcgtaagtgctgtccatccgccatcattcatcttcatccagtgagatgaacacgaaccccatttcatggataaagaaactgaggcagccaggcgcagtggctcacgcctgtaatcccaacactttgggaggctgaggtggacggatcacctgagattgggatttcaagaccagcctgaccaacatggaaaaaccccatctctactaaaaatacaaaattagctgggtgtgatggcgcatgcctgtaatcccagctactcaggaggctgagataggagaatcacttgaacctggaaggtggaggttgtggtgagccaagattgcaccattgcaccccagcctgggcgataagagtgaaactccgtctcaaaagaaaagaaacaggcttaggaaaagcgatctgcccaaggttgggatgaatcctcaactgggcccatctctaatctggcttctctctgctacgatgctgcaagaattttcaggccaaatttcagtccctgggtaaagggagggtacaacttttccattttttaagctgtgagagggtagagtacaaaagggatatttgaaattgtgctccctgagtatcagacttgtagaagcagagacctggctgttctcattgtattagaagaagcaggatgaacaaaaggttttggagaatgctgggaaacacggctggggtttgagagacttaggcagcatgacattcaggcccttttaggttattaggacaatgagagttccgggctctgtccctaacccccagctaggtaagtggcaaagcacttctggctgttttggagatgctgtcagctgtgggaaactgaggcagaggcctggaagggcttttattttcattctacctccctcattttcctttcatgaccctatgggtgagaccataggtagtctccaggtgggtagacagaaaatgccctttgccgcaggcatgacctcaagagtgcctacttcctcttccaacttggtattagcccaacctctgtcagaagggcaacagaatgaaataaggatgatgaaatgcttgcaaagagaaagtgaaatggagaatatgcagtttttaagtccctttgccatttttaagatgcttttgaatccaggattcttttgaattaaaggtacagcgatcacaggagtataagcattgattaaatacctatgatgaaatagcacagcaaaatgggtagacatgggccttgaagtcagatggggtttgagtctctgccctggctgtataactctcgtgagttatgtaacttctctgagcctcagttttctcatctgtaaaatggggataatagcacctcctatggagggcacaaagcagatgggaccactgtaattataagcagtacctgatgcagatgaaatactactggccttttgggaaatgggagtggcagtagaatggggagggaatacacaagattgcaaagtgtgacccccaccaactaggatcctacagaacgatctaacactttacatttcagttgaggacttttccaggtgtaaaatttatgctgatttttttttttccatcccaggtttggttttcctaaacaaatcctttcacagggaccgacggcacttgataatgtgacaaaaaccagcctcttccaccccactgcagtgacttttgccggaaagtggagcagtgggcacggccaaccttgtcgttcatcaatgccgcccctggcagtatctgaggatcggtggcagccatgcctccccctgccccagccgctccttcccccccacgctaatctgcatggtgtgggcgcccttgggacccccgaggactgattgtctgaccttgcttcacacgcccagtaaggactcccccaagatgtcgctcgagtggctggtggcctggagctggtcgctggatggcctgagggactgcatcgccaccggcatccagtccgtgcgggactgcgacaccaccgctgtcatcactgtggcctgcctcctggtcctcttcgtgtggtactgttatcacgtgggcagggagcagccccggccctacgtctccgtcaactccctcatgcaggctgccgatgccaacgggctgcagaatggctacgtgtactgccagtcccctgagtgcgtgcgctgcacccacaacgagggcctcaaccagaagctgtaccacaacctgcaggagtacgccaagcgctactcctggtccggcatgggccgcatccacaagggcatccgcgagcagggccggtacctcaacagccggccctccatccagaagcccgaggtcttcttcctgcccgacctgcccaccacgccctatttctcccgggacgcacagaaacatgatgtggaagtgctggaacggaacttccagaccatcctgtgtgagtttgagaccctctacaaagctttctcaaactgcagcctcccgcaaggatggaaaatgaacagcacccccagcggggagtggttcaccttttacttggtcaatcagggggtttgtgttcccaggaactgtaggaagtgcccacggacgtaccgcttgctcggaagccttcggacctgtattgggaacaatgtttttgggaacgcgtgcatctctgtgctgagccctgggactgtgataacggagcactatggacccaccaacatccgcatccgatgccatttaggtatgttgcagggacaggggtctcccggcatgcacatttgcaagctcagcccctctccatcaaaacatcgcgaaagctcaaatggtcagaattgcgccttttcgcattgttcacttttagcaaaaactgatgaattgcatgtaaacaatttgacagcagagattgagtcaaaaagaaatcttgtgatcagtgcaaacctaatttctgacagcagctctgtgcaaagaactttctgcagtgacagaaatgttctccatcttcattgtccaaaatggtagccactagacacatgtgactaattgagtgcttgaaacttgtctcctgtaactgaggaactaaattttaatttaatttaaatagcagtgacacatacggctagtggctaccgtatggggacagtgtcgttctagagccaaagacttgttaaaatgattaccgagcttcataatgatgtccaggaggctgtgaaagatacttaagcatctttgcagtcatcaaggatgaaatgatccttggtgataagcttgttttactccgattctgagaaaattggtcgtatgcgtactgtgtgtgcggctgtggttttgcaaacaaagactggagttagacagcctttgtttgcatcttggccccaccacgagctgtgctactgtaggcaagtcatttcacctctctgagcctcaatttcactatttgggaagtggaggtaaaaagatcttctcctaaagagttattctgaggatccaatcagataatgtgtattgtatgtatgcacacagagcctaaaatagagcaagtattcaataaaagtaggcttaaaacaacttaatcatggaggtattagttccccagaatgccttattcctggtgagtggcgataaaaagctcgtctctgggatggtggcatcaccggttagtatctcagattagagtgtgcagagacagccttggcagcgtccagctttacaaagttcacaacgctgcttcagcttcagtagggaggaaggaagagcagcaggaggaacctggtgcatgggttggagtgggagtttcataaccacgttctgcagaggagcctcagggctgcctgggaaggagccggagctgggggcccccgagccctcttcaccctcagcagctctgcttctcctgctgtctgtgtgggggttctgagtaagatgtggtttggatggaggatatcactgcactaaaagaaaagaaaagaaaagaaaagaaaagaaaagaaaagaaaagaaaagaaaaatataatgagatttgagcaattgacatggtaggaatttcaagagtaaagggcggactgggtggaggctttgggggaggtggcctgaattcctggtcagcagtcagccgtgagactttgagcaggtcactgagtctctctctgcctcagttcttcatctgtaaaatggggagatggtacttacttcacaggattgttgagaggattcaatgagtggcatcttacatggccccttggcaggattcctggcacgtgacagcatttgatgaatgggagctagtagctattatcaaggactgtgttggaccatgtgaaaaatgatccataagacatagaccctgcccccaggaaacagtgggaaaggaacaggcttcggaagcaaacagatctggactcaggtcctggcctcgccccatttgctgagtgaccttgggcagggctctgaacctccttaagcctccgttttatcttctctaaaacagagatgacgattcccacttgctggctgttttgaggagtgggaagtaatatgtgtaaaatgcttggcaggtagagggcagtggacagtaagctaatctaagtgatgggatgataatccaggtgatggtcattagcaaaactgctgtgcgaggccccaagcctcacttggctgcagacggggtgccctggggaggtgggtctgacactggaggatccccacacagaaatcaggtgccgccagggtggagcgagggagcggaatcatcccctggggcttggggaagccgggtctaggcttgctggggaggccagtagtgtgggctgaggttggacaggtcaggtgggagcaaacctcagaggcccttgatgccaggcttgagaatggaggccgtgggcaatggggagtgatgctcttcttttgaaaggtttgcctttatgtattgttttaaaacttcagaatgacatctggggaagggcatttgaggactgatgtggtagaatttcaaagaggtgtgagtaggaagtgatggtagcaaggaaaatctggggtttgctttctgtagattaacacttgttgttcatctgtatgatatgcatgcatgtgtgtgtgtgtgtgtgtgtgtgtaaaacatgcccacgctggctcacactgtggcctgtggcctgtcattcctttctcagcccagctaggtacttgccagaaaaagtaggccctccatgttcctgtagatagcaggaaaccttcttggaagacgtcccactgtggcgtggcttgttctccacggccaaggcgagctccctggttgggttttctcagcgtttccttctttacactatcatgcccacattaatatccacccaggaaggaaacaaaggtgtgtcggatttatgtgaccttgtgtgttgacagagagggagtccagagaatgaggtcagaagcaggataagcctggtgcgtacctggtggccacacctctgctggttacctggctgaaggtagaggcacctgcagttccagaaccgtgctcttgaaatgccaatgcttgcttttcttctgccttctgcctgagctgtgactgatggaattgtccctgtggaccactgaagacccagccactgctcctcactaacacagcccatttgttcgagacatatttgctgagccctgctgtgagctacttctagaggtggcatcacctagtcccgacttcatatgggaccacaggacagcttcaggcccaccccctactcagcattgtacacaatgctgggatattccagatgcactgccacaaacttccagaaaaccacctctgaaactcaccaggcagatgttaccagggaggcagatacttcatgaaaatgcatgaatatgttcagcaaattctagctaaagaagcacagttagactcttgtttttcttttctgcatgtcatcagatttctaggtggtctagccgggtggtaacagtagatcagctcatgttccccttgcccaccctgagtgcccggttgccagccgcctgaagtgggggccactggtggacacagccctttctctaccctccttcctgcctctttcagggctcggtagggacagagcagcaaagcttgagccatagaggagcatatgggactatctgaggccatgtgtgggacctgtcactgtcctcaagagccactggaatgatctgtttagggaagaattgagctcttctgccaactaagctggtttgtgggcaacaggcaggaatgggggcaggagcagaatgaaggggaggcggagaacaagaagcaggggggtgtcaagccagcaggccaggccatttttctatcgcaccgtggcacgtggcgatgaatcatttagtggcccagagaaaggggagcttctttctgaaaccccggggtggctgtccctgcagagaactgcccattcctaaaggccttcgccacctgaaccagccagtaggggcacacgccaaaggaaaacgtagcctctgagtccctccatctgggcgtctttacagccctgactcccccagctgctgttaaccatagtgggaaatcatggcttctgtcaggatgagcagtctcagctgatttaatgaaatgtactattgagagttgaaacatattagggtcctcttagagggacagaactaataggatatatatatacacacagatatatacacacatacatatatatacatatatatacacacacacatatatatacatatatatagatacacacatacatatatatacatacatatatacacatacatatatatacatacatatatacacatacatatatatacatacatatatatacatacatatatatacacacatatatacatatatatatacacacatatatatacatatatatatacacatacatatatatatatacacatacatacatacatacacacacacacacatatatatataaaggggagtttattaagtattaacccacatgatcacaaggtcccacaataggctgtctgcaaactgaggagcaaggaaagccagtcagtttccaaagctgaagaacctggagtccgatgtttgagggcaggaagcttcgagcactggagaaagatacaggctgggaggctaggccagtctcacttttttatgtttttctgcctgctttatatttgctggaagctgattagattgtgcctgccagattaagggtggatctgccttccccagcccactgactcagatgttaatctcttttggcaacacccacatagacacacccaggattaatactttgtatccctcaatctaatcaagttgaaactcagtattaactatcagacatgttaactacaagaaaatcagcaatcaggccaggcacagtggctcaagcctgtaatcccagcactttgggaggccgagtcaggtggatctcttgaggctagaagttcgagaccagcctggccaacatggtgaagccccatctctactaaaaatacaaaaattagctgggcacggtagtgcacacttgtaatcccagctactcgggaggctgaggcaggagaattgcttgaacccaagaggcagaggctgcagtgagctgagatcatggcactgcactccagcctgggcgacagagcacgattctgtctcaaaaaaaataataataaataaagaaaaatcgaaaactccacaatcactttaattcctctgttaatagtataacaactagcatttatatcatcatgtccagttttataacagcctgttctttggagtcaggctgactcagcaacactaaatggtaactttttagcaggtcatttaacttcttagttaccccatctggaaagtgggtgaagtgatacctgttaagtgtgtatttagcacaaagctgagtaggaagacacagtaggtcttcagttattggtaacaaggatagaagtcccatagcagccctggaaggttcagtatgctaatgtcccctctttacaggtgagggtatggctcagagaggctgagtgacttgcccaaagtcacacagcacataagagtcacaaccagtcgtctgtccccaagtcctccgtccttctgtctcctccatgtggcctctttatttgaattattactgtgaacgtacttcctggaaccattatttctggttcaaagaatacattaaaatactctggctgctggaaggaaagctatttcatttttatgctaaaggacattaaatcagaggggaatgccaactggcccagggtcattgtggtcacagtgagtcactgaagacagatgagaccaccacccatcccagctcctcttccaggactctgcttccccctgggtgggccttcctgagagctgttgggctgacccaaccccttctgaaatcattagatggccacggtggccccttcttttctggacatcaaggtagtgatgggggccaagtgtttctgcagacccttgtgttggaaagggcgactgagggtcacacatggcagtgttccaaccggaccccactggcctttgaagcatacggcttattttttattttttatttttatttttgagacagagtctcactctgttgcccaggctggagtgcagtggtgcgattcgcccaggctggagtgcggtgatgcaatctcggctcactgcaaccttcgcctcctgggttcaagcaattctcatgcctcagcctcccgagtagctgggattacaggcgtctgccaccatgcctggctcattttggataattagtagagagagggtttcaccatgtttgagaccaggctggtctcgaactcttggcctcacgcgatctgcccacccctcagcctcccaaagtgctgggattacaggtgtgagccactgtgcccagccaagcatacggcttcttacaaagctgccagtctatttcctcttgaacctaagccattaccttagaagtgtcctccagtttcccagaatgagggcagacgaagagcacgccattctccagcctcaaaacggattaaaaggctagaacccaaggaggagaacactgtgtgagcctttgattttttaatcgcaactgagatagtcctagaggggagactacagtaaacacagttactgggtaaggcaaggttctaaacccaacctccctggatttctgggggtcccctggttaggcttcagagtgtagtgcaaatgtcagtctgtgactttcataaaaggaatccatgacccagaatagatgaagccaatgaaggaatgaatttttgccaagagtgcagtgaagatctagatggtggcttataaacaacaaaaatgtagaactcacagttctgaggctggaagcccaagatcaaggtgccagcagatttggcgtctggtgaaggcctgcttcttgttcataaatgacaccttctcactgtgacttcacatggtgaaaggaggtggccaggagcagtggctcttgcctgtaatcccaacactttgggaggccaaggtgggaggatagcttgaggccaggagttcgagaccagcccggtcaacatagcaagaccccatctttacaaaaaaaagtttaaattagctgggcatgatggtgcacacctatagtctcagctactcaagagggtgaggctggagcatctctagagcctaggaggtgaaggctgcagtgaactatggtggagccactgcatttcagcctgggcaacagaacaagaccttgtatctaaaaaaaaaaaaaaaaaaaaaaagatgtcaggccaggtgctgtggctcatgcctgtaatcccagcactttgggaggctgaggcaagcaaatctcttgaggtcaggagttcgagatcagcttggccaacatggtggaaccccatttctattaaaaatacaaaaattcggccaggtgcagtggctcacgcctgtaatcccagcactttgggaggctgaggcgggtggacacgaggtcaggagttcaagacccgcctggccaagatggtgaaaccccatctctactaaaaatacaaaaattagcctggcacagtggcaggtgcctgtaatcccagctactcgggaggctgaggcaggagaatcgcttgaacccaggtggcagaggttccagtgagccaggatcgcgccactgcactccagcctgggcgacagagtgagactctgtctcacaaaacaaaacaaacaaaaaaattagccgggtgaggtggtgggtgcctgtaagctactccagtgcctcccagctactccggaggctgaggtaggagtatcatttgaacccgggaggtggaggttgcggtgagccgagatcacaccactgcattccagcctgggcaacagagagagactccatttcaaaaaaaaaaaaaaaaaaagggaaaagaaaaaaagatgcaaaaggaggtaaagaagctcccttgggcctgttttataaggatgctgctcccattaggaccccaccttcatgatctgatcactttccaaaggccccacctcctaacaccatcaccttggggtcaggtttcaacatgggaatttgcagggacacaagcccacaagccttcagaccatagcacaggctccagaggtgtgaggcaggtcaggtgctttagaagtcaaaaactctcagtaaggcaaatcaccccctatctcctggccttccctgaatcttgcctgccttcactctcctttctctggttttcctacaaggtctgaaaactccaaatggctgtgagctggtggtggggggagagccccagtgctgggcagaagggcgctgccttctctttgatgactctttcctgcatgctgcgttccatgaaggtgagtggctgcctttcccacttcctttttttcaatgaatagacttttatttttttagagaagttttaggtttccagaaaaatcaggcagaaagtaccaaggaggccccttcatatcaccccataacacatatacacacacagtattgatgcgttattattacctaaagttcatggttgacattaaggttcactcttggtgttgtccatccattctgtgggtttcgccaaatggataatgacacggacctaccatgacagtatcatacagaatagtttcactgccgtaaaaattcccacttaaagatccctccatctccccatttccttttgtccaccctgctcagaagcccatgaagccaggtttatgctctcagtgagagaggaggtggtccgatccgagccgagggacaggatggggtccctgccccgaagctgagcacgtagggtccagccctgcctggatcctgggtcctgactccagggtggtttgaacctgtcctctcacccctccttcccccccaggttcagcagaggatggcccacgggtggttttcatggtggatttgtggcatccaaacgtcgcagcggccgaacggcaggctcttgatttcatctttgctccgggacgatgagagtatttcccatgctggagtcggcgagaagggccgaggcggggcctgggcagactgtggtccggtccagtccctaccggtgttgtttccatgctcagaaacctgcctcagcggaaagctcttatttgggattttatatcatgtcgggtccctctttcccttggttattgtaaatggaaacttttcggcttgtatttccttagattttttttttttccttccaatcatttgcttcagagactcctttctggcctaacagcgcattcctttgattggtccttgagtgaccagagacttagtgcccttgtaagtctgtcttctgttgctacttgtttttttcagtgctctgaaatagagtaactaaatggttatttgtctgaatataataatgtaaaacttcttgtggtcatcttaaaaaaaaaaaaaaaaaactaaaaactgcaaaccagagagctagagaacttggcctctgatgctggcacactggggacccttcagccacctgacggcagggggacagtctgcagcccccacacctgactggcttcagtagccaggtggaggggctgccagacacagtcagggtggcacacagtgtccaggcccagggatactgtcaccatcgctcacctcattctaaaccttgtcaggtccctgatggcaaaagcattgggccagtaggactggaggctactctttaaacatggctttcctgcaaagctgaagctggtgtcccccagcaccaagctgcggctcacacagatcagccacggaacgtgtgatccgcttacctcactgcctacagaagccctactgccaaactgggcctggaaaattcccagttttaggtgttttgagtccacagtgatgaacgttaaggccaccaggttggctgataggagctgtagggggataggaccgcgctcacccagcgacatttggggaaagcctttctctggcaaaactggaataatagatctgaccaaagtttctgttttgctttggagttctgttgcctatgtttttttttttttcatttatttgtctgtacataaatgttcaaacactagacttggagatagtggaagagttggccctgtgtctttgtcatggcacaaaggtgtgcactgcgtgacaatgacccaagccagtgtgtgctagtgaggagacagagaagacctacatgcccagaggacccgtggccgttgtgctggttttctggtctcctgtgaagaacatgtggatctcttcccgaaggaaaaggtcccaggagaccagtttgaggcactcactctagaaatagcctgtgttagctgatgtgtgaaagcgtagccggccagccacactagagatgccttttctgaataatgtattatgagcagtgtcagatttataaagccgaggagtggtttggaatatacagctggtcgcaggtgcaggtccagtgtttagatccaaatggaaaacagcagcttctaagaggtacaactgttggaagaaaacacagttgaaatgcaccaggcaggtactagcaagtgtgcaaagagcacgtctacatttgagtaaaatgtctacacagatatttgtcagtgatgagaatgcaggaaaaggcagacatttcaaacatacctgaagtctttttactcattatcttgttaaagaatcactgaggtgcatgatttctacacatcgtgactgctctgctctgcgtttacaaaaccaacagcccgcgcaggtacctagctacctgcattcatgtgacatgtctggggaacagaagataaataaaggatcttgctgaaaaccagagtgaagtggtgaggtcatctgttgtaaagaaagacttaggccaggctcggtggctcacgcctgtaatcctagcactttgggaagctgagcggggaggattgcttgagccaaggagtttgagaccagcctgagtaatatagtgaggcgttgtctctaccaaacaaacaaactagctgagtgtggtggtgcac

SEQ ID NO: 16688 - DNA, 49971 bp, Human
  misc_feature (1)...(49971): n = A,T,C or G
aatttagataaatagaaaaacctctcctgtagtagaacagttcatgttgaaaaataaaaaaacaaaacaaaaccatctttgtggaggcagaagtaatgagggggaaatgctttttgtgtgtatatcctgtggttttctcattctttttttttttttttctttttttgagacggagtctccctctgtcgcccaggctggagtgcagtggcctgatcttggctcactgcaacttttgcctcccgggttcaagcgattctcctgtctcagcctcccgagtagctgggattacaggcgcccaccacagcgcccggctaattttttttttttttgagacggagtctcgccctgtcacccaggctggagcgcagtggcacgatctaggctcactgcaacctctgcctcccgggttcaagcgattctcctgtctcagcctcccgagtagctgggattacaggcgttcgccaccacgtccagctaattttttgtaactttagtagagaccgggggggggggggtttcaccactttggtcaggctggtctcgaactcctgacctcgtgatccgcccgcctcggcctcccaaagcgcctggattacaggcgtgagccaccacgccaggcctaagttttgtatttttagtagagacggggtttcgccatgttggccaagctggtctcgaactcccgacctcaggtgatccacccgccccagccacccaaagtgctgggattacaggcgcgacccaccatgcccggccaatttcctcattcattaattcacatatctcgtctattaaatgtgtaatacattgacaataatctatttcactcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacgggcgaaaccccgtctctactaaaaatacaaaacattagctgggcgcagtggcgggcgcctgtagtcccagctactcgggaggctgaggcaggagaatggcgtgaatccagaaggcggagctggcagtgagccgagatcgtgccactgcactccagcctgggcgacaaagcgagactccgtttcaaaaaaaaaaaaaatttttttccttctgagctcacctttatttcgtaccaagggcttgagaattagattcggttcaaatggttttcaaattctaggtaaagtacttcgtctgcgaacattaaaattgttaagcaacaataaaagggcctctcagattgatttttttcactaacactaatttttcttaatttgtttgtgacgtgcgctgtatgtaaaaagtgacgacactcctttccgtgtgttttcaaacaccaagcaagtctgctgtgctccagggcgtttcgccctttgccaggtcgctgtccccattcgccccctctgagagcctccatttctcaaggcaatccctgtgacacaaactttttactttaccaagatataaaagaaccttgcttgtttattttaggcgtcactcttccccatgattgtctctcacggttgagcggcgctgacctgatgacacctgctcactgcgttttcgttaaactcagcattttcacgtagccaagacaggcgattcccaggctggatgggaccttactgtaactgcacgactccgcacaagtcgctttgaaaaccaatctgcagacgtttgcttgttctccagacagaaactctgaccccacactcacccttcccaccctaattctcgctcgaagattgaagagcctgtgaactgtctccctaacgctatccaggacaggcccaagacgggaactggaccttgcgcgcctaggactccggcgccgccacgtctgtcggcgtgcgtgacgccagcgcgcttgcgcgcacggagacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacggtgagtagctgatcggggcgcgccgggctggggcggcccgaggcctccgaggtcgagagcgcgggcctgcttcccactgctccgccgcccggcccgcgcggggagaggagaccgatgcggcctgcccgccgctgtcccagccggtggttgggcatgggtttccttctcactctatcgactggggtctgggaggcgcgtagcccggaaccgtcgccccaggggcctttccttccccctgccgcctccgggtgcgtcgcggggaccgcagcccgggagacagcccctacccggactggagctccctccttgctgcctgcgtcctctggctctccaggtccctggggctttggtctgcttagggcccgcgtccccggccgccatctgggagtgccggggagtaagaaacatggctccctcccggggacaatgcacgcgagagcctcggctccacctcctgcccgggccgggagccctacggacccacccccggccttcccgcagccacccccgctctccaagccgcgctcagtgctttgctgggtcggcgtccacttaccctttacccagctgctttatatccacttaggggcctctgacccatttaacctgattcctgttgttttgttttgtttttgttttttcatttttcctggcattgattagaagcagtcctaaagcctgtttcgaatcactggaagttggaatagagttaatgtaaagggacttcaggtcgcctcttaaagataacgaaacaggcctagagagaggtttccccaaggtcactccgggagttgttgagccaagagacttaaaaccaacgtctcttgacatccagatcagtccttttttctctttttttctgccacagtgctgctgtctgcgatttctatttctatatgtgtacttcagccattggcgcttgagggaaaaacttgtgtgccccgatctctccaaggcatttattacattggcgttctggggatgcacatgttcttggctaggctctgggcttaagaaactttgtgtagggtttttttttttccctctaaccggacaatttttctaatcgttagggcatggatagctcttattttcatccttccttcaccgaaatagaagtttcgggttttacccatgttgtagatgaatataccttgtgagttacagttttatgtttggagagcttattttgttagcttctttgaaaattcatcttatgaaaatggcagtttgagtcagcacataaactgataatttggcagaaccagagatatgttggtcatatactttttaaagtaaaagtaacactttttgtcggggagggaactggtctgtggaataggataattccacattgtgtggaatggagtaattgttttaaaaacctattgaaactacaacatagatgtgagcactaattcattctaatgataaccagtgatctaatggttagaacagacaagcagttttaggatgtttattaatacatcggaaagaagagattgaaatggaactttgtcactataaaccaaactgtagcaaagtttatgacttttcgtcgtttcgaaagttagaatttgtagtatacaaaatgatttgcatgaaattactactctgcatggctgttgtcgatgttttacagtcatttgcatgctttgcccaacaggtatttttttttccccgtgctagtaggccaaagcattataatggcctacatattatatatttggtgtgttcgggtcttgtttcctttatcgcttctctttttggaaccttcataagaacttcatatagaaaagatatgtaatgtgcatcaaacatttttttcctgtttctaaattgacacaggcttgattcatgaagggcaggttaaggaaaggatctgaaattaaagtaggcaagatgagggacactgggggggaaacttgagttttgtttgtgtagctttttaaaaaagactgtggtcccttgcagccctttgaagctgttggatggggatgcatgcgttcccttcagagtagaaactcatacctttggattgtgagggatcccttctcaaagtgagcagatcgtggatggtccagggcactgcttccaaaacataagtgaaggatcaaagggcattcccctaattggaaataatctcattttatctaaatgttttacatgtaatatttgtgatcctaacaatatttagacctaatttattgcattgtcttaataaaatgtaaataaatttaagtagaatagtcgttcaggtcaccctaagcatatatatgagcaatttttgggggaaaaattatagtagtcattcaggaaggtgagaacttggaccagcagttacaggcaagaatttcgtatcctgtaatcatttggagaaggcccctttttcatattatatcattagtggtgccacactaactgctgctgaccttattatagtttatgttctacaaccagtgcctttgaaaaataaagctattaaggccacaaattgagtaacatagcatatccatttggtctgttgcacaaataaactagcaaacatcaagggctgatgtaaacttctttatacatactttcagtaatgaatttgaaaggtatgctccaaatgctcacccatccagtaaggtttataattctagattttaatttttatttctataatattaatctggaagtcaatatttaagtattgaaatagaacctttagtttatcatagttctttccagtctcaaaagcttcccccggccactattaaataattcagaggaggccgggcgtggtggctcatgcctgtaatcccagcactttgggaggccgaagcgggtggatcacaaggtcaggagatcaagaccatcctcactaacacagtgaaaccgtctctagtaaaaatacaaaaatattagcctggtgtggtggcgggcacctgtagtcccagctactcaggaagctgaggcaggagaatggcatgaacccaggaggtggagcttgcagtgagctgagattgcgccactgcactccagcgtgggtgacagagcgagactccttctccaaaaaaaaaaaaaaattcggaggaactaaattcttgtatataaattaggacaaaggcagaagactcactgtcatggattatgaaaaatctgttctcattccaactatttatttatttatttgagacagaatctctctctgttgcccaggctggagtgcagtggcactatctcggcccactgcaacctccgcctcccaggctcaagcgattctcctgcctcagcctcccaagtagctgggattacaggtgtgtcccaccatgcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattccatgtcaaaaaaaaaaaaaaagaaaaaaaataagttattttgctttgtattccatttttttccctttttttttttttttttttttttgagttggagtttcgttcttgttgcccgggccggagtgcagtggcgccatctcagctgaccgcaacctctgcctcccaggttcatgtaattcccctgcctcagcctccgcaggcatgcaccactacgccctgctaattttgtatttttagtagagacttggtttctccattttggttaggctggtcttgaactcccaacctcaagtgatctgccctcctcgtcctcccaaagtgttgggattacaggcataagccaccgctcccggccccatttttctatttttttatttaaaaaaaaaaagaattttttagagcagtttgagatttccagagtgttgcaaagagagtgcatagtttcattgacaccacacccactttctcccatgttgatttttattggtaacaactaatgaaccaataccgacacattatttattttattttttttttttgagacacggaatttcgctcttgtcacccaggctggagtgcaatggtgcgatctcggctcactgcaacctccgcctcctgggttcaagtgattctcctgcctcagcctcctcagtagctggcactacaggcacataccaccacgcctggctaatttttgtatttttggtagggatgggtttcaccgtattggccaggctggtctccagctctagacctcaagtgattggcccacctcggcctctcaaattgctaggattacaggcatgagccactgcgcccggcctggaacttttaaatcacagtggaatacagtgaaattcagttttacttgtagatcatatttcaacacagtacaggtctttctgttgttttacttttgataattatggcatagctttagaagtcaaaaataaatgtaacttggtaaaaagttggtaatgagttggggaattgaaatagctgtttaaaaaggtaaagtttagactcttgtatagtgtacataactaattttaattcttctgaatttttcagaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtacaaacggaactgggttgtatatttttaacaagtgtttttagtaatctgccgaagaacttacctttcgaagtgaatatattgtatttctcttaaaaatttgcctttaaaacatcttatggttcaatggaaaaataagttctgaagagtttttgtttttttggattaggtgaacataaaatctctggaggatgttgttagggcatatttgaaaatggcagaggaaaaaactgaagctgctaaagaagaatctcagcagatggtcttagatatagaggatctagataatattcaaactcctgagaggtatgtgggttagacctctaataaatgctttgatagttaacttggtgttttcttttacatgggtcttcatttccttttgaggtagatgtttatcagaaaaaaatgcaaatctttgaagttttaaatgcatagtaaccagttaatttatgtaggtaataaaaattcatagaagtggaaaatgacagccttaagatagaggggcaaataccaatttaaatgaacataatgcagattgggaattcagggagtagatagtgacacctttgcagtgtgtacaaattgtgggaagaatttgcactgttttctgatgaacattgttttggtttttaatcacatggcaaagtaggaaactgtctaaaattgttttcaacatttttttctttgtagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaaggtaagatgagaagatcaaatctgagtgaagtgctttgaaattgactgaggagtaaattttctgaaaagtacttaaaatgaactagtttttatccttattgaaatgttggcattcacatgagtattaaatgactgcggccggatgtggtggctcacacctgtaatcccagcactttgggaggtcaaggtgggtggatcacttgaggtcaggagttcaagagcggcctggccaacatggtgaagccccttctctactaaaaatacaaaaaatttagccgggcgtggtggtgtatgcctgtaatcccaactgtttaggaggctgaggtggcaggatcgcttgaacccaggaggcggaggttgcagtgagccaggatggcactgttgcactccagccttggtaacagcaagactctgtctcaaaacaaaacaaaacaaaacaaaacaaaacaaaacaaaaccaaaatgactgagtaaggaatttgttttactctttaaaggagttttgtgtgaattgtattttattgatatctgaaagatctttttttttctttttacacaaacatcagtaataatgaaagacattttaaagttattttggaattctctgtataactgaaaaaataaacttttccattttttttttttttagtgaacttgagttctctacttttttttttttttttaatttatttttagtttttaaaaaagagctgggatcttgcattgttgctcaggctggtctcagacttctggactcaagtgatcctcttgcttcagcctcccaaagtgctgggattacagctctgcccagcctgaattttcactttctttctttttttctttcttttttttttttttttttttttgagacagagtcttgctctgtggcccaggctggagtgcagtggcgcaatctcggctcactacaagctccgcctcccaggttcacgccattcttctccctcagtcttcccaacagctgggactacaggcgcacgctgccatgctcggctaattttttgtatttttagtagagatggggtttcaccgtgttagccaggatggtctcaatctcctgaccttgtgatccacccacctcggcctcccaaagtgctgggattacaggcgtgagccatcgcgcccagctgaattttcactttcatacaagtaaatttggactttttgatagctgttgatacaaatattaacttgaagttaaactgcatctctgttttaggcctgttaaaatagacataactatttttaaggggaaaggaaatctaaaaaataatctaatagtgcatatgtgacggtaaaaaaattaacgtgtccagttaaatgacagaacaagtagttcatctgtaatcagttgaaattaggttactataagccctcaatttgtattatgtagttttaattagtacagaaccttgtttcttactatgtaagttagatatcaaagttcattatatttcatactagatttttttactcctaggatttaaagtggtgggtctttgaaaggtgacccctagatctaaattctagtttcccatttgtaaactctgccagcaccacattttagttgtaagcaaggaccagtgattatgtctttggttttgttagggctcactcaaaaaggtagtctggatgaaataagttgattctcattgcatcacaaagactaatgatgagtttggtgaatcctgttaaaacaactgatcttaatgtgtgaaataaaacctattcaaatatttaagtagatagtggaaggtacctaatatattttacaattatgcttatagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggtatgttggagctattagcttttcttcctagaaataatagtctgtgttacttttctccccccttaatgaatagcttcatcttggtatgcattggttaatttcaataaggtaaggaattaaagttgcctaatggactgggaaaagttctgaacaagaaatctcagaatattttgtttctagttgccttctatgaattctggaccaaaccatataatctctttcagacccagtttcttgacatataaaacaatacattgccagtgctgctcgaagtgtggtttcatgactggtgtcatctgtaaactatctggtctgtgatgaaataagtatagagtagaaaagcatatgcaaagtttcttagtagcaattttattgtacattttgtgtgtttttactctgataaaaagtgagctttttctgtttcatttttgtggtaattttgtattttatattcttcggtaagaggtcagaaatttaaaacaaaccgaatcctttactactgattgtttggagaagtgctgctgtagattattctagatttcttagtggtgctttagctgcctgtcttgcattggagatcttgatggtgttaggaagctagtcctctccctggccctttttctctaagaatcctacaaagacgttccatataattttgtagtcatgtgaccttgaagtcttttgtatatttgacggacaatatttgattgaaattatagaggaagaaactaaaaattgggagtctttgagccaagtgaaagtgtgatttgatgtcttgttcttgcccatgtttccttttctatagggacacccatcttaaaatactacctgtagaagataagtaaacatgcccattatagaaaaaaatccataagttaaaagaagagaaatattcatccattatcttatcactcagaaataacctgttgtatatccttctagattttttctttatattgcccgaagtgatgggataatatgcaaatattttcttgagtctgctctgtctacttcccattatttcctaaagaactttaaaacgtttaaggagttagtgtttttgtaattatggcagttttctaaaatagatatacatgagtaaagagaaccacacaaaggtattttatttgctatttttatgttttctgtgttgtaggtttcatagaaatttgaattagatttttttcgtgttatagaatgcaatgactttaatttatactcctaattttaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaaggtaaaaatgttatacttggataatgttgaaattctgtaacaaatatcgtctattatatgacatggtatattttaggccatggtttctcagcctctgcactactgacattttgggttggataattcttagtcatggggctgtcttgtgtactgcaggtggtttagcagtttagcagcatcctcagcttctacccattagatgccagtagcaaccaccgccagttgtgactattaagacgtctcaagacattgcccttcctgaacagtattcttggactttagtagttggtcttgaactcctcacctcaggtgataagtaactccgctaaaagcccaattgagaaatttgaatattaggaaaaacacatttaacggatgagctttctatccacatagaggtggagtctattctcagaacaaatagaaaattaagaaaaatacttttttttccttttctttttttttttttttttttgcaagacagagtcttttgttgcccaggctggagtgcagtggcacgatattggctcactgcatcctctgcctgctgggttcaagcgattctcctggctcagtctctggagtagctgggattacaggcacccaccaccatgcccggctaatttttgcatttttagtagagacagagttttaccatattggccaggctggtctccactcctcacctcatgatccacctgcctctgcctcccaaagtgctgggattacaggagtgagccaccgcgcctgacttgtattttattttattttattttttcttgagacagagccttcgctcttatcgcccaggctggagtgcaatgatgcgatctcactccgcctcctgggttcaaacaattctcctgcctcagcttcctgagtagctgggattacaggtgtgcaccaccatgcctggctaattttttgtatttttggtagagatggggtttcatgatgttggccaggctgtcctcgaactcctgtcctcagatgatcctcctggttcggcctcccaaagtgctgggattacaggtgtgagccaccacgcctggcagggtaaatacttctatcaagtcatttttcctgattgcaaaatattaagtgtagaaatttgggtcatgtttattctcatataaatacatatgaatataaaaggaagggtctataacccaacaacctatagcccaattttttcccctgtgctccacacgttcagagaaactatgctagcaacaaactatagaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagcctggacgatagagcaagactccatctcaaaaaaaaaaaatgctattggacttaggcaacacacataccacctgttttcttgtattggtccaccaattattttgttatccagtagaattatgtaaagcaaattgtctttcttatgtaaaactattttagagcaattcatgggaccaattaaatgagtcccactagtatattttctttctttctcttctttgttctctatgtctttgctttctgatacggtctttctttcctttctcatagggtcttgcttccttgctccggatggagtgtagtagtgtgttgtagctcactgcatgcatccttgaactcctgggctcagactattcttccacctcagccttctgagtagcagagactacaggcgagcgcgaccacgtccagctaatgtttaattttttttgtggaggcagggtctcgttatgttgcccaggctggtctcaaagcttctggtctcaagtgatctacctgcctcaggctccgagtgtgttgggatttataggcatgagccactgtgcttggccactagcatattttcttagaaactcttgaggatggtgtccgttatggcatccactgtcacttatgtaattcacatcctttttttttttttgagacagaattttgctcttgttgcccaagctggagtgcaatggcgcagtcttggctcgctgcaacctctgcctcccgggttcgagcgcttctcctgcctcagcctcccaagtagctgggattacaggcgtgcgccaccacgcctggctaattttttttgtatttttagtagaaacggggtttcaccatgttagccaggctggtcttgaactcctgacctcaggtgatccacctgcctcggcctcccaaagtgttgggattacaggcatgagccactgcgcctggtccacatctgtttgttttaaggaaaaacatgttcttccagacacataagcttgccttcagagagtactacaataatagtgagcattaggctgtctagctcttagtacattatttggtttaatctttgcagtagccttatgactcagaaaattaagtatcttgcctacggtcacagtcttggaaatggcgaaggggagatgctagcccttcagctccagggctcgcagtctttggggtcctgccatgctctgaatgcagcctgacttcttgtctttcagggatgtgaaaatttagctcctggttcttgtctccccctctccctcactaccataatagtgttcacttctgattcttaaaatttttttctgccttattgccacttacttccttaggtttttttttttttttttttttttttttttttttgacagtcttaactctgccccccaggctggagtccagtggcataatcttggctcactgcaccctccgcctcctgggttcaactgattctcctgcctcagcttcctgagtagctgggattacaggcgcctgtcaccatgtctggctaatttttgcatttttagtagagatggggtttcaccatgttgtccaggctggtctggaactcgtgacctcaggtgatccgtctgcttcggcctcccaaagtgctgggattacaggcgtgagccactgcgcctagccatttccttagtttttaaacctgccttaattttgtaaggaagtctggggtatatgaatgtgtgttttctgtcatttaatcacaatctttttctttctttttttttcttttttgagacagagtctggctctgtcgcccaggctggagtgcagtggcgcgatcttggctcactgcaagctccgcctcccgggttcatgcgattctcctgcctcagcctcctgagtagctgggactacaggcgcccaccactacgcctggctaattttttgtatttttagtagagatggggtttcaccgtgttagccaggatggtctcgatctcttgacctcgtgatgtgccccccttggcctcccaaagtgctgggattacaggcgtgagccaccgcgcccggtcaatcacaatctttttctgaagctagaaaacactgacagtactgagtggatagatgaagtcctgattctccaagtattcgtttaaacacagcccatttctcttactcccatgctttgatggaataatatttatgagtatagtgcaccatggtgatgtacacgttctgtcactagcacgccttaccgtaagattaaagagaagtgcttttctgcttaccaagtatcatttacaaacctaacagatttaaaactttgttctccatagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggttagtattaatttgaggatttttgtagctttgggcagaaaactttgtggtcaggtttaataactcatgattaaatactgggaattctgattcagtgccaagggttctgatgtatggacagggaagcactggtgtcaatcactgttcacttgaggcagttccgcgccagtgggtgagcaggggttaaattggtgggagttttgatctagcaggacttgggttggctctggggaataccgtgggccagttagtaagagaagaagtaatgatgggcaagaagagtcatggcttatttcatggaaggctctaggaaaactaattaagctgtgtgtggtaaatatgaagaggctaggtgtattagtatgttctcgcactgctatatatacccgaggatgggtgtggtggctcacgtctgtaatcccagcactttgggaggctgaggtaggtggatcacctgaggtcaggaattcaagaccagcctggcaaacatggcgaaacccggtctctcctaaaaataacaaaaaattagctgggcatagtggcacacacctgtaatcccagctacgcaggaggctgagtcaggagaatcgctggaacccgggaggcggaggttgcagtgagctgagatcgtgccgctgcactccagcctgggcgacagagtgagactccttttcaaacaaacaaacaaaaaagaagtacctgacactgggtaatttataaagaaaagaggtttaattggctcatggttccacaggctgtataggaagtatagtggcttctgcatctggggagacctcaggaaaattaccatcatggtggaaggggaacgggaagcaggtatggcttatacggctggagcaggaggaagacagagggggaaggtaccacacacttttaaacaacaccagatcttgggagaactcttatcatgaggatgggcctacggggatggtgctaaatcattagaaattgcccccatgatttagtcacctcccaccaggccacactccaacactggagattacagttgaacatgagatttgggtgggtacacagatccaaaccacatcactaggggagaaggtaaggtagacttaccttcagtgtctgatgttcaatgtctgaagaactaaaatattttcaacttttttctcttttaaactttcatttgatgttactaaatagtatggacttaattagggttattcagtgaaattgtatgtgaaatactttttaaaatgcagatttctaggttttacccagcagatataatacaaaagttttagagtgtggagcctaagacgtgttgttgttgttttttgagacagggtctagctctgttgctcaggctggagtgcagtggtgcgatttcagttcactgtaacccccacctcccaggttcaagtgattctcctacctcagcctcccaagtagctggaattacaggcacgcaccactacagtggttttttgtagttttagtggagacgggattttgccacgttggctaggctggtcgtgaactcctggcctcaagtgaacgatccccctcggcttccctaagtgctgggattacaggtgtgccaccgtgccggccagatttgtgtatctttttagtgtttcgcattgatggaatcttccattcagtggaaatttgttgagtgcctgttatgtgcctagcaagtgaaactgaaggcagaagttgtattctaggggagctgagattctagggattcttatcataatagtctgacttggttattagaatcacctccagtagattactttggggtaagagaaagagggataagtacttggctgtatgtttaccaaaaacggaatttaaatcattaacagtccctaattcatgaatagagcaataaagaaatcaaaaagataatggcaggctctctcagatatttttgaaatgtattctgaggaaacacctatattcactctgataaaagctagataaaaggcctaaattttctgcagtagtcaatttaagaacaaataacttttctagatagtggcatttttcctttgtgacatagtaatgcagattcactttgtagctaacttttgcaaagagttcctgcagagcagctttttttctactttgtattcctccatgtttttttctgctgccactgcccacagagttcaactttctgtttatggggccgatgtaggactcaatgtaataaagcaacagcagtgtcttgagaaagaagtttcattagcaaataaaacatttgctaataaaaaatttgcttctaatttttaaagctgaagaaacgtgccacactggaaggataatccacgtcaccttgttaaaggtgatcttggctaggcgcggtggctcacgtctaatcctagcactttgggaggccaaggcgggtggatcacttcaggtcaggagtttgaaacgagcttggccatcgtggtgaaaccccgtctctactaaaaatacaaaaaaaaaaaaattagctgggcattgtggtgcatgcgtgtaatcccagctaatcgggaggctgaggcaggagaatcgcttgaacccgggaggcataggttgcagtgagctgatatcgtgccactgcactctagcctgggtgacagagcaagactccatctcaaaaaaaaaaaaaaaaaaaaaaggtgatctcttagacttagatttaatatactgcaatatgttgtcccagaagcgaaagacatttacaattggctggaagtagaatttgagccactaaaactctgtgagcaagtcattcggtgatcactgatgggtagcattggaccaacaactagggcatctagattagagtcctcattgtgcccacagagtgtagacttctagaaggataccagttagtgtcaagtgaatggattagctgactgccaagaggcatttgtcaacttcttgagttgaccatatatccaaggtcaatacctgagcgttaggcttccataaccaaatttatgagacagagtgattccattatctcaggaaaagactcaaacattcctaagagtgacttttaaatcggaaagtaaaccaatcatgtattttagtgagaaatataatttagtagattatggcagcctttcacatttccctattcggaaggggactgcatgaagaatctaaaataacttgataggaatgaaattagagctgggaatttttttttttctcttaaaggcagattctaagttagggaattttatttgtatgcatataccacaccttattgcagtaaagatatatggatgcttataaggaggaagtgttagaatgttgtaggatttcagccttgtacccattttacattagagttaaccttagacctgagtgctcccatgtgtgggtgccctccttgcttggggatgcgatctgccaatatttgcctcagttttgtcacccactctctatgggtacacacttctgtgctttgctctatcccagcagttattttgtccttgggttaacagttcctaaaaaaaatgacatattccatggtaaaattgaagtccatataaatggggtaatatgtgaaattcttttctcaccgctatgtttgtgagatttattcatgtgttctatgtagctgttcttttttgagcatttttgtttattttatgaatacaccatatgtgaattctccccagtttggggctattagaaatagtgctgccatgataatttttgtgtgataatttatataaaagtaaaactggtattttccttgttattggtaataaaatattctattggccacagtagttgtctttgtgaatatttaattggttgtagttgtgttttttagagtttcatttcctttttacatacttgtggggcttttcacggtaggttaatgtgcatagtgtggggcaaaagacccagcatagttgtactttggattcatttttggtaaatttagaggaggttgaggcttgatgattttttaaatcattttccagatttccaatgctatcatttatactaagttcagaattttagttggaaaatttcctttggcagttacatcttttgttttgcttactgtaggtcagatttaatgtactacaatatgttgtcccagaagtgaaagacctttacaattggcttgaagtagaatttaacccattaaaactctgtgagcgagtcacaaaggtaagcctttgtatttaagttctggttgttaccacagagttggccttcttgcagttttgggttgtattcatatttgttaagagagaagttttgtcctatgtgttggaattcagtgcacatttcattgtcttttttctttatttcaagagaaaagatatatctgatgtgctcagcaaacctttggaggttaattagcagcatgactaatttagccattgctgccagtcaccttcaaacaagtatcagtagcttcatgatacattttgtatttctttgcattggatgatgtttttgtatattaaaaaaaaaagagttttagatgttttagtatctcttatgtagaaagtgtgattctctttcaatttaatggattttataggttctaaattgggttagggaacaacctgaaaaggaaccggaattgcagcagtatgtgccacaactgcaaaacaacaccatcctccgccttctgcagcaggtaaaaataaaaaaataaaaaaagttttgtgattttatgtgctcatcatgaaactaaaaactggaaaaatctagaactgcctaggaagtgagaacctccccaagttctgcccctggcaaaaattagtctatttattaatttgaaaatcagaattattatatttacatattttgtaacggacgcttttgttttttggctgaacactgtctttgggcatttttccttgttagtaatgtagggctaccttattccatttaaggtactgtggtgtatttattcagactctcttgatgaaaacctgtattcctagattttttttttccctgttagaaatcttgtagcattgagcatctttcatacatgtatctttgcatacttctattactttctgtggcataagaagtggaattagtcatagggtttatggatttaaagctttaatagctattcagaagcctggattaatagaccccccaccatgagtgaatgagacagccttttcatatattttagtccaggggcttaagtcagtaagtgctcccattttgttttccatttgttgcatttgggaaggagggcgttttattatattttcatctcagtatttgtgcacatttcattgacctgctttcttttatgtgagtagtgttatttcttatgtgctatacaaataattgaaggctaattagcagtataactataaatagtaatgctgccagtctccttcagacaaaaattctataagaagtgtttaaatatattcggtaagtagcaggtttttaggcttttttgttttacaacaactaggatttgaaaagattataggtttgaggaatagtatgataatggttctcaaagcatggagtttagagtcgatggtctgggattagcattctggctttaacaatgtactgctaacataaattctctggcataatttctacttcccatgactgtcatgagattgcacataaaaagtgctgaataaacagtggctagtgttattaaccctttgttttctatgcaggtgtcacagatttatcagagcattgagttttctcgtttgacttctttggttccttttgttgatgctttccaactggaacgggccatagtagatgcagccaggcattgcgacttgcaggtaggtatgtgctgtaaggagacaggagaaggcccttgagggctagaaagacacataccttctgtttctcagcttttggtacagtgataccattttaaagtttactgagtgaacttttccagcttttgtatatgacattcttctgttactttttgacttcatgcttacttgtggatttaaccattgataatttaattttcaaaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactggtatgcatcttcccggggaaataaatcccagaagttttgagggactcttaacgccatgccatgtcttttacaaaaaggtttgagacaatatctgagagaagggatttatgatatgtttcctatagaattgtacttggtagttttgttatttgatcaaatacacaaatcattgagctttcttccattgaacaaaatactactctgtgtaggtaatgtaatagggtggattatgttacagaaacaacagagtggacataggattcctcaaatagtgaaatacagtgactggatttttccctcctgcttaagttatttcttttttttcttttttgagatggagtctcactctcacccaggctggagtgcagtgatgccatctcggctcattgcaatctctacctcctgggttcaagcaattcttgtgcctcagcctcctgtgtagctgggactacaggcacgtaccacgtgcacagctaatgttttgtatttttagtagagatggggtttcaccatgttggccatgctggtctcaaagtcctggcctcaagtgatccacccgccttggcctcccaaaagtgatggggttacacgcatgagccactgcctgtaacaagttatttcttgtatgtgagctctgttaatgaacacctaaggtaggtttggtgcagagaaaagttgtcttatctaggagagcttctttagctgcgtcattgctattaaaagactgaataggagcaacaccatagcatttaataccgaaaacaaacagcttggatagtgtcatcttccattatcaaatgcagatacatagaaaggcagtacatcaggattattttgtaatttctttgatgcctaataccagagaatgttaattttggtcatgtaaaaaaattcatttgtttttgaagcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagtacgtagcatcttagtcattaaaaaattagttttatccaggtattttgtactcttagaaccacagtcctttaccatttgttggcttactgggttatttcatgcattttggtacagctggtcatgactaaatctgtgagtaagcatatgtttattgctctgtgaagttttgtgttttttttgagacggagtattatcttgtcgcccaggctggagtgcagtgacgtgatctcagctcactgcaacctccgcctcccgggttcaagtgattctcctgcctcagcctcccaactagctgggattacaggcgcctgccaccatacctggctaatttttgtatttttagtagagacagggtttcaccatgttggccaggctggtcttgaactcctgacctcaagtgatctacttgcctcagcctcccaaattgctggggttataggtgtgagccaccacacatgacctgtttcatagacaccttatacacatagcctgaaggtaattttgtacactattttacataattttgtgcatgaaacaaagttttgaatgcattttgactgacctgtcacatgggtcaggtgtggaattttacacttgtggcaccatgttggtgctcagaaagttttaaaattgggagcatttcagattttgggtttttggattaggtttgcttaccctatttagtagagtctgggtagatgtaggttggaggagtgagaaaaggatgtatggatatttttttccttatggtcaaatggaaataaggctattgtataatatttttacatttcctaaattatcacccattgtaacaataaaagcaatgtaggattttattctagaaagcagtgagttatgttaggcattgcttgtttctctttattaacaattgtgcatttgtattacctttcaggaccttgaggaattggatccagattttatcatggctaaacaggttgaacaactggagaaagaaaagaaagaacttcaagaacgcctaaagaatcaagaaaagaaggtaaatgaaagggttggtaaacctttaacataccaagttaagagagattttttaaaactacgtgtgttttcgtgtcattcagattgactattttgaaagagccaaacgtttggaagaaattcctttgataaagagcgcttacgaggaacagagaattaaagacatggatctgtgggagcaacaagaggaagaaagagtaagttttttatttaattgtaatatttttagattgtaataaaatcctctgccagtaatggaaccaaggattcagaattgctttattttgtattcttctgctagaaatggtgctctaatggctgcctatgaacagattggtagaaagagggaaaatttcacaatagagattacaaacgaaacttggaaaacaaaggacaactgaaaagcccattttataaaaaactgctttatatacactttaaatgggtaaattgtatggcatgtttatacatctcatagttttcattttacttgcagaattgtgcagccatctccacaatctaattttaaaacacgtctcaaaaagaagttctaaacccattagcagtagtcatccctattcttccccaccaccccagccctaggcaaccgctaaactactcctttctctagatttgctgattctggacattttatataaatggaattgtgtactgtgttgtctttcgtgactaaacaggtcattccatagttttgttaacttatagtatattttatatttacctaatgatacaaaagcatggtttacaaatgcttacggcaccaaatatgtaataaaagtgagtaagcagatctactttaaaaaagtaaccataagcaggaggcaaacatcggtgtagggtgtgataggagaatgcagccttttcttggtttaatctgattgttgtcccttggagattaatgggcctaggattgccagcccttcccatttttttttctggaaaagttggaatttttgtgataattctcttaacatgtaaataattaaaaactaattagaaaagtgctgcagaccaaattgggttgatttggagccttcagtttttcatgtagggtagaaaagaaatagccatatatcatcttgcattgatttccaggtgtttttaaggatgaaaatgcctttaaaaattaaaccatggtgtttgttgttaccatgtcatatttattattttattttattatatataggcacaccttgttttattgtgcttcactttattgtgcttttgtgttacccaggcaggtctcaaagtcctgggctcaaacgattctcctggctgggcctcccaaagtgctgggattatgggtgtgaatcacacctcccccagccccccatattattattatttttattcttatttcttcttttacatattaaaagtttgtggtaaccttgcattgagcaagtctgttgacaccatttttccagcagcatgtgctcatttcatgtctctgtcacattttggtaattctcaaagtatttaatactttttcattatatttgttgtagtgatcagtgatctttgatgttactgttgtaattattttggggtgccacgaaccacactcatagaaggcggtgaacttaatctgtaaattaagtctcttctgactgttctaccgactggccattcccttactctctgtctctccctgtccttgacccttcctattattccctgagacactaatatgtatatatttatttgagacagagtttcattctgtcgcccaggctggagtgcagtggcgcaatctcggcacactgcaacctctgcccccgccgggttcaagtgattctctggccgcagcctcccaagtagctgggattacaggcgcctgccaccatgcccggctagtttttgtgtttttagtggagatgaggtcaccgtgttggctgggctggtcttgaactcctgacctcaagtgttctgttcgcctcagcctcccaaagtgctgggattataggcgtgagccactgtgcccagctcctgagaggtaatattgaaattaggctaattaacaattccacaatggcttttaagtgttcaactgaatagaagagtcacctgtctcactttaaatcaaatgctagaaatgattaagcttagtgaggaaggcatgttgaaagctaggcctcttgcactaatcaagttgtgaatgcaaaggaaaagcttttttttttttttgagatggagtttcgccgttgttgcccaagctggagtgcaatggcgcaatctcagcccactgcagcctccgcctcccagttcaagtgattctcgtgcctcagcctcccgagtagctgagattacaggcatgtgccaccacacccagctaattttgtactttttttttttttttttaattagagacggggtttctctatgttggtcaggctggtctcaaactcctggcctcaggtgatccgctcatctcggcctcccaaagtgctgggattacaggcatgagccaccgtgcctggcccggaagagttcttgaaattaaaaatgctactccagtgaacacataaacagtgagaaagtgaaacagccttattgctgatatggaaaaagtttcattggtctggatcaaaccagccacaacattccctttagccaaagcctgatcgagagcaaggctataactctcaacagttaataatacaaatagctgagagaggttagaaagccgcagaaggccaggcctggtggctcacgtctgtaatataagcactttgggaggccgaggagggcagatcacttgaggtcaggagtttgagaccagcctggccaacatggcaagaacccgtctctactaaaattacaaaaattagctgggcgtggtggcagatgcctgtaatcccagatactcaggaggctgaggcaggagaattgcatgaacctgggaggcagaggttgcagtgagctgagattgcgccactgcactccaccctgggcaaccatgggagactctgtctcaatcaatcaatcaatcaataaaggaagctgcagaagaaaagtatgaagctagcagaggttggttcataaggtttaaggaaaaccgtctttatgacataacagtacgatgtgaagcagcaagtgctgatggaggagctacagcaagttattcagaagatttggctgagatagttgatgaaggtggctacacttaaacaacagactttcttacttttttgagagacagggtctcactctatcacccaggctggagtgcagtggcgtgatctcagctccctacagtatctaccccctgggctcaagtgcccacttcagcctcctgagtagctgcgaccacaggcatgcaccaccatgcctagctttttttttttttttttttttgtatttttagtggagacaggctctccccaggcttcccaggctggtctcaaactcctgaagtcaagcagtctgcctgcttcagcctcacaaagtgttgggattacaggggtgagccatggtgcccagccaatagattttcagtgtagatgaaacgaccttctgttggaagaagatggccagctaggtctttcatacctagagggaagtcagtgcctagcttgagagcatcaaagggtatgctcactgtttaggggttaatgcagctgctaactggaagttgaagccaattctcgtcattccaaaaatcctagggtccttaagaattatgctgcatctaccctttctgtggtctgtacatgaaagaacaaagcctgaatgacagcatatctgttaatagcatggtttgctgaatattttaagccccctgttgagacctactgctcaaaaaaaaaagttttcagaatattgctgctcattgacaatgcatctgatcgtatgacagctctgacagtgatgtataagagagattaatgtttgttttcatgcctgttaacacagtatgcattctgcagcccgtagatctaggaataattttgtctttcaagtcttattatttaagaaatatatttcataaacctgtagctgccatagtgattcctttggtggatctgggcaaagtacgttgaaaacctgctggaaggaattctttattccagatgccatttgtgattcgtgggaggaggtcaaaatatcagcattagaaagagtttggaagaagttgattccaagcctcatggatgacttggaggggtacatgagtagagtggagaaaataattgcagatgtggtgaaaacagcaagagaagtagagttagatgtataggctgggtggggtggctcacacctctaatcccagctctttgggaggctgaggtgggcagattgcatgagtccaggagtttgagaccagcctgggcaacatggtgaaaccctgtctctacaaaaaaacaggaaaattagccaggcatggtggagtgtgcctgcagttccagctacttgggaggctgactgaggtgggaggatgcagaggttgcagtgagctgagatggtgccattgcactccagtgcttgggtgacagagacagaccctgtcttaaaacacacacacacacacacacacacacacacacacacacacacacaaaaccaaaaaagactataacctgaagatgtgactgaattgctgcaatctcatgataaagcttggatgggtgaggagttgcttcttatggatgagcaaagtaagtggtttcttgaaatctcctggtgaaaatgctacgaacattgttgacctgacaacaaaggatttagaatattccataagtgtagttgataaagcagcagcagggtttgagaggattggatcaaattgaaattctactcttgagttaaaaaccgtcaaccagtgccacatgctagatgaatcttttgtaagaggttgcaatcagtgtggcaaacttcattgttacctattttaagaaattataccatagtcaccccatcctttagtatctgccatgctgatcattcagcagtcgtcaacattgaagcaagactccactagcaaaaagattatgactcattgaaggctcaggtgatcattagcattttttagcaataaagtattttttgttttgttttctttgagaacaggagtctcaccatgttgtccaggctgatcttgcactcctgggctcaagtgattctcttgcctcagcgtactactgcatctgacttacagtattttaaaattaaggtttgtacattggtgttttagacatgctattgtatacttaatagactgcaaacttctatatgcatcggataaccaaaaaatctgcgttgcttgctttattgcaatattctttattgtggtggtctagaaccaaacctgcagtgcctccaaggtgtgtccgtgtatcataatttttcctttataaagttcctggtatcatggggctaaatgaaaactgtctctcctaaatgcctcaggattactttgtctacctcttgcccgtaattgccttctggggacctattgacatggatgtagttaacgttttcatttttatggcatgacagaaggggcagtggagcagcttctaatttttcaagagtatttctcagtaatttggggttaatgagtaaaaaaaaaagtgcattgaaatttcacaatatttgtacttgcagattactacaatgcagctagaacgtgaaaaggctcttgaacataagaatcgaatgtcacgaatgcttgaagacagagatttattcgtaatgcgactcaaagctgcacggcagtctgtttatgaggtgagcttgctgatttttgggaaatgtttattcatgagctttctagtattggcctaagggttctcccttaacaaattggtatattctttattgagttactatgtgtaacggtcattcaaataatagaaatttttggatgatatttcataagcaaaacaatcatcaaaattgttctaaaggtgaaagttgaatgcataatttaatacaagttttgtttactgtttttgttagaaatgaaaaaactagatcaaaatgtcctgggcttagattctaatttgaccattgaattattttgtataaagacaaacccactggaggtaggtaatatcaacaatttaaatgttttaaaatttggcctgctgacaagttaatggtcatttggaagttagagtttttgtgctgagaggttgctttcgatgattctgatacacttgagagtcttttgtaaacctaatagctttctgcgagtttgttgctcttgacaaagtgtgccctttttgggttgggggttacttcgattgcaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaaggtacacaggtcaaacaggattggaggggtgctaatgcaaggttggtgttaagatctagtttttagtgatcttatgtagaaaatacaggaatcaaggtaattggccttttagcactgtaattaactggatctcagaacccagtttgctgtatgtgaagttgttacatcgtctgccagcatttccccacacatttgatgttcttctagaaattaatactttttttaatcaccgtattctgtgtattaacatttattgaggaatacattccagatgatggctgttaaatgatgctatatctggaatcccagattgctcagggatgggggagggattctagtatcttattacaaaactatagttgaggggtgtagtacttattttcttgactatgttctgtcctgtagctgattacaaactattttcaaattcttttacttgtacattatgctacctgtttaataccagaaaagtggaactagcactagggggaagatatggctgggaggcacacttagtaacctaatcaatggtctagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggtgagtatagggtttattgattttattttgttttaatgtgactttttttttttggttgaggcacagtcttgctctgtcgcccaggttgcccaggctggagtacagtggtgcaatctcagcccccgggttcaagtgattctcgtgtctcagcctcctgagtagctgagattacaggtgcataccaccatgcctggctgatttttgtaattgtgatgtatttttatcacccagttctcttccatgatacctatgtaaatgtatttaaatcagttattttcacatctctttctcttttttttttttttttttgagacagagtctcgcttcattgcccaggctggagtgcagtggtgtgatctctgtctcggcttcctgcaatctctgcctcccaggttcaagccattctcttgcttcagtcttccaagtagttggaattataggcgcccaacaccatgcctggctgatttttgtatttttagtagaaaatacaaaatttactactaaaattagaaatatggtttcaccatgttggccaggttggtcttgaactcctgacctcaaacaatctgcttgccttggcctcccaaagtgctgggattacaggcgcgagccaccgcacccagcccattttcaccgctctttttaatgtggtagttttcccaaagaacagaaggcacctaaggggggaagaattatacttgtcttagcaaagatggaattttacaggcttaagcatacttttgcgcatgcgtgtcatgaaagttttgtccatagcactgctgagtttgctacagaagagagactgttgctgagttccatgaaagacatcatcgtttggccgggcgtggtggctcatgcctataattcccagcactttgggaagccgaggcgtgcggatcgcgaagtcagttctagaccagtctggccaacatggtgataccctgtctctactaaaaataaaaaaattagctgggtgcggtggcagcacctgtaatcccagctacttgagaggctgagggaggagaattgcttgaacccaggaggtggaggttgcagtgagctgagatcgcgccactgcactcaagcctgggtgacagagcaagactctgtctcaggggaaaaaaaaaaaaagaatcgtgaatttagaggatgatgaattctgtagctccttggtacttaaagacatgtttggtggtcagcagctgtcagcagcacctgtcaacttgttagaaacgcagactttgaggtccagccccaaaacttctgaatcaaaatatgcaatttaacaggattcctaggtgattcaaactcagctctaaatgctgatttttaattgcactcaggttcaaaacggacctgtgttcccatctctgtcttgtgtctggaattccctctcctgattggtgttactggtatctgctttgtcacagctttgaacctactcttccttctttcttttcctacattactgccttaattcagatttttcttgcttgcaatacttgttggtctacttactcgtcttcctcatcatcatcttcctccagcttcagaccttcctctatgttgtggcctgcttgatttttcataatacagcatgtttgatcactgtgcctgctgttggatttcagacctttcattggttggtactcattactgagagccaaaggttttaaaacacgcgttagtagtcttccgtgttgctgccgtttcatcagtttcatctgacactattttcttcttagtcacctgtgctgtagccattggggagcaagttttctgctttattctgtgtctgtggcatctgtctgcacgctcttccttttgcttgggaggtgccctgtttgccccttaaagtattgcttgcttacttttcactcagaaagctcaaggatatcttgcatgccttttctctgctcctctatttttgccacacctgtatcaaatgcttatctgtatgcctacacttgatactagttatttatgtgtcttcagtttgtgttattcttactgctaatttgtagttctaattccttggtattaagtaaatgtggtctgtatgatttacaagtttttggaatttaagaatacattttcccttgtgttctatgaatgtttttttctgttgagcacaaagttgtgtgtgtgcatgaaatcagcgctgttttgtttaaatctgctacatcttgttagtttatgggactgtctccttaggaacatgaggaagcttaccttctgagattatccttttcttttagttagcatttgcaaatgtgtctgtccacccttttgtacattttcagcctcttgtttctgttttatgcctcacccccttgcccacacacaccttcccttttttttgggagagtttagtttaatttacttgcatttaacatggtaactagtatatttggttttattcctaacacttgctttggagctttttatttgcttctatgtccctggcaccccttcctttttctttaagccaaatttgaagaacttttctaggttctttttgtgtgtgtgtgtgtgtggagacagtctcgctctgttgcccaggctggagtgcagtggtgcaatctcagctcactgcaacctccgcctcccagtttcaagcaattctcctgcctcagcctcctgagtagctgggattactggcgtgtgccaccacgcctggctaatgtttgtatttttagtagagatgggatttttcactatgttggcctggctggtcttgaactcctgacctcgtggtccactcacctcagcctctcacagtgctgggattacaggcgtgagccactatgcctggcctttaggttcacttttattttctctattccattaatttttttgccctttttgcccgggctggagtgcaatggcgagatctcggcccactgcagcctccaccttccaggttcaagtgattctcctgcctcagcctcccaagtaggtgggattacaggcatgtgccaccatgcccggctaattttgtatttttagtagagatgaatttaaccatgttggccaggctggtcttgaactcctgacctcaggtgatccacccacctcaacctcccaaagtgctgagattacaggcatgagccactgtgcctggccaccattaattttttcctaagtttttaaaaaaacttccacagtataaattacaactttcctttgcctcttcagaacaaaacaaaatcatgaccataccttaacttatattttattgcagtggactgggtatttttgcttctagatatttacacattatctttcctcttagtactcacttaacagttactttaagttttccatccatattagcgaacattatttagtctcaagtatgtttacactgcatcatgttttcccctttgtgagtactttttgtttcttgatcagtagttttcagaatgtctttgtgtgtctcataagttttttctctcaccgttgaacaataaatggttcattatttggccagttcaaaatcatcttttcagaaataatagagacctttgcttctgtttttagtacacagtgttacagaggggaggattttggtcttactctgtagatactgtttcattcctcggaaacagaatttttctctattcttgcggtaaaggaagttaaaactgtccctaagactgtgtttagatacctgagtgtatggtatctttgtttctttttggccttttgcccttttggtctaaggattcagtctccttagagcagacaaaaatctacttaatttaaggaaacttttctcctttttctctgttcttgctctgttaaagttctctttatatctttaatgtttcttttactctcttcatctctttgtttgtttgtaccaggttctctgagatcgtggttcagtttgtttgctcatcagccagggccattctgctcttggatctgctgggccgggcacattggttcacgcctataatctcagcactttgggagaccgaggcaggcaagcggatcgcttgagcctgggagcttgagaccagtctggcaacatagtgagaccctgtctccacaaaaaatacaaaaatgagctgggcgtggtggtgcatgcccagctacttgggaaactgaggtgggagggagtatggcttgagcccaggaggcagagttacttctttttgtttgtttaatggctataagagccatccttcaaaagtctttggaggttgtaatagttgtactatatcctctaaaaccttgcattctttgttgagtataaattgcaaagcaggcatgggggtgggagaagcttggccttctggctgtatttgttccctcaattgtgttgcccataaattcctttgactgttatgtttctattttctctcaaggtgtttacttgggaaagtctcttagaacaacccccaccttaagagacagcccagaatcattagctgtgatgacccgggacgaatttattttctgaccattcttgtctttcactgcttctcatctctagttgttattttagagtttcattgccaagacatttttttcaaaaattcaaataaaggggcaggcgtggtggctcacacctataatctcagaactttgggaagcctaggcaggtggatcagttgaggtcaggagttcgagaccagcatggccaacatgttgaaatcccatctctactaaaaatataaaaattagtcgggcatggaggcaggcgcttgtagtcctagctacctgggaggctaaggctcaagaatagcttgaatgtgggtggcagaggctgcagttagctgagatcgtaccactgcactccatcctgggtaacagagtgagattccacctcaaaaaaaaaaaaaaaaaaaagaaaagaaaattcaaataaaggttctcttattcacgcattgtttgagactgtagcttattcttagctttgtagattcttttatttttatttttttgagacagaggcttgcgctctggtgcaggctggagtgcagtagtgtgatgttgggtaactgcaagttttgccttctgggttcaagcgattctcctgcctcagcctcccaagtagctgggactacaggcgcctgccaccacgcctggctaattttttgtatttttagtagagacagggtttcaccgtgttagccaggatggtcttgatctcctgacctcgtgatccacctgcctcggccttccaaactgctgggattacaggcgtgagccaccgcgcccggcccatcagagtactttgaatagagaagtactgttaatttaaccacccccattagacattaaataaaatgtctccacctttctttgcttcgtaggcactgtgatgtccatttcagggcatgtggcttttttcacattcttcaaaggggatttctaggttgaaggaaatctgtagaggtgtatgttcccaggttgctttccagcacagtgttatatcggtttgtaaggccacctacaatatatgagactaccagtttccctgtagcgtcagtctgatctcagattaaaaaataaatgaaattttaaaacttgcttatttaagggcttcatattgttataagtacaaaaaatatttgaatggtaataccagtagttgtaatagtaaatggttaccaatgtaatgcttctttttcactttgtcaatggaggactctcgttggggagatagagattcagaaggcacctggagaaaaggacctgaagcagattctgagtggagaagaggcccgccagagaagtaagtagagttgaggaaaataatgccgctccagttcctgttaatatcttatcagtggttttaaaatttggttcattttgtagaggcagggaaaggagagccatgaagaattgtgtgcatgtctgattgcgtgtgggtttgtattttgtttttttgggtctgctgcccaggctggggtgcagtggcgctatctcggctccctgcaacctctgcctcctgggttcaagtgcctcagcctctcgaatagctgggattacaggtgtgtgccaccacacctggctactttttgtatttttagtagagatggggttttgccatgttgcccaagctggctttgacctcttgacctcaagcgatctgactgtctcagcctctcaaattgctgggatgacaggcatgagccactgcacttggcctgtgttgttgtttttgttgttgttgttgttgttttgagatggcgtctcactctggagtgcagtggcgcgatctcggctcactacagcctcaacctccctgggcttaggtgatcctcctgcctcagcctcctgagtagctgggaccacaggtgcgctccaccatgcctggttaattttgtttgtttgtttctttgtttttgagacagaatctagctctgtcacccaggctggagtgcagtggcgcgttctcggctcactgcagcctccgcctcctgggttgaagcaattcttgtgcctcccaagtagctgggaggcacttgtaatcctcccaagtaggattacagacatgcaccaccacgcctggctaatttttgcatttttagtagacccgaggtttcactatgttggccaggctggtcttgaactcctgacctcaagaaatctgcctgcctcggcctcccaaagtgctgggattacaggtgtgggccactacgcctggtgaatttttatattctttatagtgatggggttttgacatgttgcccaggctagtctcaaactcctgggctcaagcaatcctcccgccttggccttccaaagtgctgggattacaggtgtgagcgactgtgcccagccgcatgtcttacaattaagtagagatgggttttgccaggccaggctggtcttgaactcctgacctcaggtgatctgcctgcctctgcttcccagagtgctgggattaaaggtgcgagccactgctccggcccatactgaagtttttaaaaagcatgtgaaaaaaaaaatccccaaaggatcatatgcttttttattttatatatttttaattgttcttgttgctgtgtagggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtaaaattctatttcctagaatatgcttaagtgttcacctgtaaaagtgaaattctgatggataaatatcagggctgtattgttattttccagataaactggtctttcatctttccttcagtatcatttgcagtgacttcgctgtcaaaagtttgccttcagaataccaccatccaaaacataaataacccaacccctctcttctttagtgatgtgctctttgttttccttctgcttcgatgactgcttctttgaaggctcttcctgtactcatgctttcagtattggtgtatttttcaggttttactgggaaccagcctccttttaaaaataaataattgaaaccaaaatgtactttatatatttatttttgccaactgagagattatgcaaggaggaactcattttactttactttttttgagacagggtcttgctctgttgcacaggctggaatgcagtggtgcagtcatggctcactgcaaccttgacctcccggaccctagggagcctcccacttcagccttctgagtagctaggactacaggcgcatgccaccacaccctgctaatattttattttttggagagacggggtttcgctatgttgcccaggctggtctcaaactcctgggcccaagttatccttctgcctctccctcccaaagtgaagtgctgggataacgggtgtgaggcgctgcgcccagcctcattttttttcttagtcctgggcctgcttattgtttcacactttattattcgtgagcagttgtatacatgtttgtgacatgcgtctattaccattttttttctttttgaggtggagtcttgctctgtctcccaggctggagtgcagtggtatgatctcagctcactgcaacctctgcctcccaggttcaagcaattctcctgcctcagcttcccaagtagctgggactacaggcacatgccaccatgcatggctaatttttttttttttttttttttttggagacggagtctcgctctgtcatctggctggagtgcagtggcgcgatctcccctcactgcaagttctgcctcccaggttcatgcccttctcctgcctcagcctcctgagtagctgggacaacaggtgcctaccactatgcctggctaattttttgtatttttagtagagatggggtttcaccatggtagccaggatggtctcgatctcctgacctcttgatccgcctgcctcagcctcccaaagtgctgggattacaggcatgagccaccacgcccggccatttttttgtatttttaatagagatggggtttcaccatgttggccaggctgctctcgaactcctgacctcaagtgatccacccacctcggcctcccaaagtgctaggattacaggcgtgagccactgccccggccagttttctctaggtaatttctgcgtactgcacacaggtgacagctgcttactgcatatagcacatctccacttggtagtcttactgaatgtctaacacagcctatccaaaactggactcattaccatcacatacacgtgcacttgttcacgcccacccatccctctgattctcttcaggggcatcactgtccatctaactgtctgagctaggattctgggagttgttttgtctctgtttcatcctttatgttaaatctttagttcagttctgcctttttgatgttcctgaaatccaccctcctctccattcccattgcttgtacttggtcctgggtcagcatcattttcctcacccgctaactggtttttgctgcctctcttactcccagttttaattttgggtgtcagggaaataaccagagcagttgttgtaagtgcagatctaagtgagctgcttccttgctttccccagttgtttctgttgcctacttcgtctcttctagtctcacttcattctgctgttcggctgttaccttgtgtaagacatttaatttttcttttcctcatgttaaatggggtaacagtatagcagattcttactaatttgctaattatattttatacagttgccatgaatactgaactcatgttcctagggtaaatacaaggttaggttcttgtaagcttctagtcatgatatttttgtcaaccaatcaatacataaaatgtcttttatgtgtttgtgtttaaagactccctatttctgatatgttgttgattcattaccattgaattcatggtcaacagcattataactcattcatgaacaaagcttatctaatacatgtattttctccttaaggcatatcatagccaccttgtgcttggggccactaaacagcatttgttttttctctttttgaggtggggcctcactgtctcccaggctggagtgcagtggcgtgatctcagatcaccgcaacctctgcctcctgggctcaagagatcctaccacatcagcctcctgagtagtagactataggtgcacaccaccaagcccagctaatttttgtatttttttgtagagatgtggttttgccatgttgcccaggctggtcttgaactcctgggctccagggatccaccctcctcagcctcccaaattcctgagattacaggcatgagccaccacgcctggccactagacagcattttagcactacacttggaggccattttaaacagtgaggtcaccagcaaatttacatctctatatgtactgtatataaaatgttcctagattcatatattccatgcataagtgtgagccactgtgcagggttaaaggatttattcatgattaatgactagataatgggtggcaaatggtggaggacaggaatataaaaggaaagattgttttttggatatgaagggcttgaaaacgttgcaaggtataaatacctcaaaattgggactcagagaaaactcttgaagtttctgcttaaatgagtgatctgtgtaacatcagaacagatactatgctgaaatctgcgtgcaataggaaaaattctaaaattttcagtgatacttttgttttatggaacacttaacacagatcatttaaggtttttggtatttttttttcttttcctgtttgttttttgagacagtctcattctgtcatccaggctggagtacagtggcactatcttggctcactgcagcctctgcctcccaggttcaagcagttctcatgcctcagcctcctaagtcaagtagctaggactacaggcgcaccaccacacctggctaattgtagttttagtagcaacagggttattaccatgttggccaggctggtctcgaattcctgaccttaagtgatccacctggctcggtctccaaaagtgctgggattacaggtgtgagccaccatgcccggcccattttaagtttctcatataagtttaagatactgttaatgatgtctgtgcagtgatgtacacagctttagtatttttttaatcagtgtcttaaattagcatttagaatgatgatgaattaatgccaacgtctattcatgattgccaatctgtttcttcttttaaaaatattttaaaaatgttttgctttttcaaaaaaacaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctaggtgtgatgctctaattaaattatttgtagaggccgggcgcagtggctcatgcctgtaatcccagcactttgggagggcggatcacctgagttcaggagttcgagagcagcctggccaacatagtgaaaccccatctctactaaaaaatacaaaattagccgggcgtggtggcgcatgcctgtaatcccagctactcaggaggctgaggcaggagaattgcttgaacccgggaggcagaggttgtggtgagccgagatagcgccattgcactccagcctgggcaacaagagcgaaactccgtctcaaaaaaaaaaaaaaaaaaaaaaaaaaattccctcttaaagtaagaaaatggaggcccaaacttcgtggctgtccaaaggctgtgtgacccgttgggcattggaaccagtccagccatctttgtcagtccgttgcttttacccctgtggtttagggcagtcagttttcttgcccttaaattatcaaaagccctttgattttattagtagtagaagttctagcttgttcccgctgccaaagtgtccttgtactgacaaatgtagaccagcagtgttcgatgcaattttcttcaaggaagaaaatgtgtctgctggccagtatggtagtcagcagtcacatttggcagccaagcacttagaatatatggttgatggtcctaaggaaatatctccgttttactttaaatgtaagtaaccacatatgggtagtggctaacgagtgggacggcacagatctgggtgttctcatttgttctccacgccccaggcatcaggtaaggtcaggttatgagtttaaactgtctgttatatttgtaaactctaagccccagcttggactggatgtacttataattatccatttggtctaacagtaagaacctgacctgtcattgtaaatggctacagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaaggtatagaggttacatacaactgaagtattggagaactgtcgtttctggggggggggggatttgggttatttaattatatcataaatttgtatgaaggccaacaataagagagttgatattctatttagaattcatgattttcatacagttactcaatggtcatgttgtaaagtgcacttatctctaaattcaaagtacagtagtagactaaattggatagcaggcaatatatataaagtttacttaataaaaatgaaaaaaattgttatttaaaagcagcttcctggcagattaagcacaaagtagaaacattttctctgaaattgtaacagaagtttattctgttttaaaatatatgtatttttcatttttaaaatcctcatttttctcttggtttttaaaaattaattttccgtatgtcttgacatcctgttatgagagaatttttctctcatagccataactttaaaaactcctgtattttgtatggttaatttgctgttaaaattcttcaagagccaaaaatcctttcagttataaaattttcattcagccagatttttgccaccttgtcttacgggtttatactaactgtagtccttcccaggctagtggtttctgcctgttttcagattttgagttttatctgtacatttgtatgttaaagattgtcagaaattgtatgagctttcattatgatttctgtatttaacaatacagaatttaacagaatttctgtatttaacaatgatttctgtatttaacaatctttagtacaggaattttgagtaatttgagccaatagaatatagtactaacttaattttttttttttaattaaactttttagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcaggaattccttagtttccttgtaacgctgtcctctgagtttgtgtgtgcatgtgcgtgtttgaagtaccaccttgggttttcacctgaaattagaaaaatcgtagttaatttgagaaaatgttacaaattcatcatggctgtaggcacttatttctgttattgagtagtggtgagaattcctattggtacagctgtagggccagaagagggagtattgatgctttttaacttaaccagatgcagctatttttgtttgatgttaccaatgatagaaatcattttaaacaccttagtatctggtatttcaaatacgtagaagtctttaaaggtctttcgtggggagaaggacttttctttcataacaagagaatttcagatcagtgattacaagtggggcagtaacttgctaagagtttgcttcctggagagtagatctgtatgtgtgacatcacaggtaagccccaagaatttatttaatcagatttgttcagacgagttactgctgcctacgttagagttagatttcaaggcgagtcagcaaacccatcctttctgctcagtctcccgtactgttctcccaagttctttgttctgggagtcagaacccaagtgcaagaggagggcagaagagtctgatgctgttactttgcgatcctgctcttggtttccactgtccaggccatacaactctgtctactcccattagtatttaccaacaggtgttaaaggaaagctgaacaagcagcctactcaccgatctgctaggtggtcttccatgttcatggtggcttctgcagtttcattgagagtaacattgctgttaatacagatagatccagtagtagagacatcatcggtccaaaagactttgcatctcattagttgtccatagtgactaccaggaggtggctggcatctataacgtgtgggacgtttttatgtaaagaactgcctgtgttttttttttttttaaccaaagacactgaccatagattgacttatacttttataagtctaattgaaatacttggggtactatgaaaggactgttccttgagtggctacgattagaaaatcaggactaacaaacttttctttgtctggaagcatatatatttgtgatataattttaatatgtataattttggtttaataaatcaaatctatgacaaaagttgttctcatcaaagctaataattctgcaacttccaaaaaggactttgtaggaaaattaaaatacaaagaaaaataaaagccactagaaattttaagtctgtacagaaaagaacaggttaagacaatctgtacctctacagttggagaagcccttttgactcttccctgtattgttttgctactaggcaagtatgcagcatgttcttatgaagataattttgtcatactttgtatatttcttaaactttgaaaaattgggtttctctaaatgtaattttgcaaaatgtttaaagttccacattgagttccaaggatttttaaatgaatgtgtttacatatacttttcataagagaaccctagaaaattaactatagtaatactctgcgttttaactcccagtattcattgtcagctggaaaacctaggcaaatttggcacaggggctgaacatggggtactttttttcttttttggatacagagtcgctctgttgcccaggctggagtgcagtggcgtgatctgggctcactgcaacctccgcctcctggtttcaagcaattctcctgcctcagcctcctgaggagctgggattacaggcgcccaccacaccacccggctaattt

SEQ ID NO: 16689 - DNA, 15442 bp, Human
aaatacaaaaattagttgggcgtggtggcaggcacatgcaattccagctacctgggaggatgagacaggaggatcccttgagcccaggagggggaggttgcagtgagccaagatcgcacgattgcattccagcctgagcaacaaagtgagacttcatctaaaaaaaaccccaactttttccatttgaatattataagaatttgatactgtcactcacctttttaaaactatttgaatacttcctacagccctaagaaaatccttaagaatccctaacatagcttgcaaatcccttcccatctggcccctgctgagtttcctatctcttttatttttttcatttttattttttgacagggtcttgctctattgcccaggctggagcatagtagcacaatcatagctgactgcagcctcaacctcctgagctcaagtgatcctcccacctcagcctcccgagtagctgggactacaggtgagcaccatcacatccggctaattttttgtatttttttgtagagatagggtttcaccatgttgctcaggctggtcttgagctcctggcctcaagcaatctgcctgctttggcctcccaaagtaccatatctggcgaatttcttatattatttcttacactcctcgttctccctgttacctgccgtgctggattttccatttctcttcctcatctctggacttcaaacatgctgctgcctctatctggaatgctttccactccacctggttcattgctgttcctccatcaaatttcagcttagatgtcacctgctcagggggaccttctcttccccatcccaccccagactatcttagatcccttctatcactcccacagcacctgaacgtcttttttcttagcatcaatctcctgaagttatctggggggttttttagagatgggatctcactatgttgcctaggctggagcgcagtggctattcacaggcacaatcacactcactgcagtctcgaacccctgggctcagtcagtcctcctgcctcagcctcctgagtagctgggaatacaggtgtacaccatcatgcggggcatggttattggttatgaggttatctgtttaatctccacatttccttttttatccaagaggactatttatcttgtttctcctgtattactagcacccagcatataactacagtacagtagacagaaaatatgtattaaataagtgaatttcatcaaaatgttttctagagtcccagctctgtaatctgcaacttagataacctgcctgagccttagtttgctcaagtataaaatggaaataaaaataaaaataatacttaccttagagggtcgttttgaggattaaataagatatatcagaaaagctcttagaacggtgcttggatatagtaagcatttgattaatgcatgcttaaacataaagaaaggttacatcaattcacactcataccagcagactttgacactatcactctttaccctgttcaacattgagtcttgtgtttttaaatatttttgtaaagaatataggtaaaaagtggcattttttctttggatttaattcttatggatttaagtcaacatgtattttcaagccaacaagttttgttaataagatggctgcaccctgctgctccatgccagatccaccacacagaaagcaaatgttcagtgcatctccctcttcctgtcagagcttatagaggaaggaagaccccgcaatgtggaggcatattgtattacaattacttttaatggcaaaaactgcagttacttttgtgccaacctactacatggtctggacagctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatggtgagtctctctcttataaagccctcctttttcatcctagcattgggaacaatggccccagggtccttatctctagcagatgttttgaaaaagtcatctgttttgctttttttccagaagtagtaagtctgctggcctccgccatcttagtaaagtaacagtcccatgaaacaaagatgcagtcgggcactcactggagagttctgggcctctgcctcttatcaggtgagtaggatggagtggaaagggtggtgtgtctccagaccgctggaaggcttacagccttacctggcactgcctagtggcaccaaggagcctcatttaccagatgtaaggaactgtttgtgctatgttagggtgagggattagagctggggactaaagaaaaagataggccacgggtgcctgggagagcgttcggggagcaggcaaagaagagcagttggggtgatcatagctattgtgagcagagaggtctcgctacctctaagtacgagctcattccaacttacccagccctccagaactaacccaaaagagactggaagagcgaagctccactccttgttttgaagagaccagatacttgcgtccaaactctgcacagggcatatatagcaattcactatctttgagaccataaaacgcctcgtaatttttagtccttttcaagtgaccaacaactttcagtttatttcatttttttgaagcaagatggattatgaattgataaataaccaagagcatttctgtatctcatatgagataaataataccaaaaaaagttgccatttattgtcagatactgtgtaaagaaaaaattatttagacgtgttaactggtttaatcctacttctgcctaggaaggaaggtgttatatcctctttttaaaattctttttaattttgactatataaactgataagtcctctctacttcacagattaagaaattgatactcaaaaaagttaaataacttgttttaaaccacatagtaagtgccgaagccaatctgtgagaccaggactgtttgtactctaaatggctgcaccacatgaggcaaaatggctcgtgatggttttatttcaaagacctagaaaacactatcacagctggtgctcccgtctcagacccacagcaacgatgtctccacttcctgcttcatcttgggtttctcacgtcttgaatgtgcacacaaatcacctggggatcttgttaaaaatgcagcttctgtttcaaaagacccagactggaaatggagattccgcatgtctagtacgctctcaagtttattaatctgctgctggtcctaggaacatattgagtagcgaggggcaggatgtgactcctgtaaggagtggccaggcattttcttagagacctgtgttataaagtatgcttttccttaaaaaaaagaagaaggaggaggaggagaagggccaggtgcagtggcttacgcctgtaagcccagcattttgggggaccaaagtgggaagatcacttgagctcaggagttcaagaccagcctgggcaaagtagtgaaaccccatttctacaaaaaattaaaaattagccaggcaaggtggcacacacctatagttccagctacttgggaggctgaggtggaaggatcacttgagcccaggaggtcgaggctgcagtaagccatgatcaagccactgcactccagcctggagtgtctcaaaatagataaataaataaataaataaataaataaataaataaataaaagagacagtatcaaagacccaatcacctctagacatctggcatcataggaatgtgcccagtctgctctggggataggaaagtggggatcctgtctccccctgtgtagaggtttcagtaaaagaaaggcctaggtgtgcagaaagctttcaggcaatgccagggaaactgatcattgtaatgaatccagggtattgctgagtgagggcatcctggagggcccggtggaaatgtggtcaggctcttcaatgcacaggccctagttgatgagtaatcagggtttcaaatatttccatctctgtctcaagcagaaaacaaatggaaaaactgaaccaccagaaaagcagagccagagatggaacaagaatcccagtgtttgtacccaaccaagagcgtgtttttcttccacagacaccaatgttcaaaatggaggcttgggggcaaaattcttttgctatgtctctagtcgtccaaaaaatggtcctaactttttctgactcctgcttgtcaaaaattgtgggctcatagttaatgctagatgcttccttcctctatttccccccaaatttcctgggaacccctggtcaataccagcagtaagttccactgttctagggtgtagaaatggctgtgacccagcagcaagagggaaggacatcagatgtcatcagtggtcatactgcaacacagccctttttctgtttaggaatgcaggtacccacaacatttactaacactttttttttcttatttattttctagttggcgtttgggggcaagatggtgagatatgctttctttctttcttttttatgaaatcaccccatcattctttgtagttatgaatggagctttctcttaggcctcccacagaacttccacagaggtcaggaaaaggagtttctgccatctacccctttgactttcctcacaagtctggagatatttctagcccagaagagggaagcaacagaggcaggaaataatgagtcttaaccatacaaaagaaaaattgagacttaaatgaagttgaaagcactaacagttttcatttgtttgcatttcatatttgatgtgagattctgcagaggagacgtagccagaatgcatgcacagggttactctggataagctgctggggcaacatttggatgtgtgttcagaatcacatgtctgaatactctgaatatatgtgtgtacatgtgtatttatgcaagtgcacatgcatatgagtgtgcccggcctgaacttactctctcaaccacagcggtagagtcaggagtgttccaacattggaagcccctctattcaatcagctcttccaaactgagtgaaccaatgttgtatttaatggcaaccatggctggacaccatggctcacacctgtaatcccagcactttgggaggccgaggtgggcagatcacttgaggccaggagttcgagaccagcctggccaacatggcgaaaccccgtctctactaaaaataccaaaatcagccagacatggtggtgtacgcctgtagtcctagctactcgagaagctgaggcaggagaatcgcttgaacctgggaggcagaggttgtagtgagccgagatcacaccactgcactctagcctgggtgacacatcgagactgtctcaaaaataaaataaagacaaccattatgccagcctagattccgccatgctgcctaatttgtagtgtccttaggagccatttttgtaaatagtcatcagataagatgtaaggcccataacagctttttctatgcagctgagggaattggaagatccattgtttcctaagagttgagggaagagtcccaacccacgggagcagggtctgatcttcattgccgatagaaacattactaatggcttcttactgtttccttttcaggtaatgaagaaatgggtaagaagatttccactctatctagcaaaagttttcaaatatggaatgaaatgctcatagagtacaatcacagtaacaaaccctgagaactaaaactattaaagggaaaatacaagtatctttcaatgggatccgtatgaaacttgcctgtatttgttgctagctgtcatgtcagattatagctgtgcatatatgtatctctgatcatacacatatggatgtgggttggagctaccatgtgtttttgtataagccatgaaatctttgaaggcagacagagacagtgtctcatttacctagcccagtgtctggcacatagtaggtgctcaatgaatattttttgaatgaataaatgaacaaacatatgaacacattgctaattacctcccctcaagaagctgatggtcttgtgtgagagacaaataattgaaaatatagtgagttgcatgttataatatgggtagatacagagtaaaatgaagtataaagaggggagtggtcaactctactgagtgtcgttgggaaaggttccctgggggaggtggtccttgagctgaattttaaaggataagcttatgttttagggaagaaaaatattttatgcagaagagataaagctgtatagtatgaggataagagtctaactgagctagatcagaatgtttgaatcttggctcaactctctacttgctgggtgtgtttgagtaatttacctaacttttctgtgccacagcatcatcatggtacaatggaaataatagtgctacctaacttgtagggttattatgaggaccaaatgagtaattcatttaaggcacttagaacattatctgacataaaaggcagtaggagggccgggcatggtggctcacacctgtaatcccagcactttgagaagccgaggtgggaggatcacctgaggtcaggagttcgagaccggcctggccaacatggtgaaactccatctctgctaaaaatacaaaaattagccaggcatggtggcaggtgcctgtaatctcagctactcaggaggctgaggtaggagaattgcttgaacctgggaggcggaggttggagtgagctgagattgtgccattgcactccagcctgggcgacagagcaagactctgtctcaaaacaaacaaacaaacaaacagacagtaggtgaattttagctattaatacatggaaagcatgctgactatagatgataagcattaaagtttactgagcatgtatgttttaggcattgctctaaatattttacttgaatttcctcatttaattcttccaacacccctactgtacagttaaggaaacaaagcctcaaataaatacagaaataaacaaaaataagtaaacaatccagtcctggggatataaatgcagatttaggccaagtgccatggttcatgcctataatcccaacactttgggaggccaaggcaggaggctcgcttgagctcagaaggttgaggctgcattgagcaaagattgtgccactgtactcgagcctctgtggcagagaaagaccctgtctctgaaaaaattaataaatagaaatttaaaaataaaaaaattttaatgcagatttatatgataccgaagttcattttctcaaccattatgaaatactgtttctggatatgtataaaatctttgtgagcacacatatctttttttaacttaactttcattttaaattcaggggtacatgtgcaggtttgttatataggtaaacttgtgccatgggggtttgttgtatagattatttcatcacccaggcattaagcctggtacctgttagttatttttcctgatcctctccctcctcccaccctccaccttctgagaggtcccagtgtgtgtcatttccctctgtgttcatgtgttctcatcatttagctcccacttctaaatgagaacatgtggtatttggttttctgtcactgtgttagtttgctaaagataatggcctccagtcccatccatgttcctgcaaaggacgtgatctcattcttttttatggctgcgtagtattccatggtgtatatgcagcacatttttttatccagtctaccactgacaggcatttaggttgattccatgtctttgctattgtgaatagtgcacaatgaacatacgtggagcacatttctgtctaagcacagacatctagacccttgtgtgagcatgagttaagtctaagctctgctactgaatttgtgccaataaaagttgtgagcaattttctttacatttttttcaaacaaacacacccagcagagtataatgtctatgtactttatttatgatttctagttcatttaacatgtctaagaaacatccgtgttgaaaaattatttataaattaaaataatataaactatctactgtccttatactcaactcccaattataagcaggtggaaaaacctggagaatgttttgtttacattctgtgcagtctttgtcagagggctgcctgagcaactgggtcagagtttagttctgctctgggagtagcaggacctcaagaaggaaaggaggaaaggaagtaactttttcttgagcacctgctatgtgtcattcactttcaccttcataatccatttaattttcgcaaaaactttgtgaggttggtgttttatctccatttccctgataaagaagttgaggttcagcaaagttaaatgacttgccctcagtcacacagactagggcagatccaggattcaaactcagggcttctgactcttgagtccagagctctgtccctgacagcagcagcactgcctctcctctcttccagctgttatgtccagactgtagcagaacccagtgttccagccacaagttttccaggaaataataaaggactcctagctccacctcccagggcaaaaatggctgctgtgggaaacacaggctggacctacgaatggcattagtggtttattagttgatttcagttgtccacactaataggcctccctctaacaaaaataattgagagctgattatgctcagatataatgtaaagtgaagccactttttattggaagaagcattccctcaaaacgtgtagagtatttcacattatttaaaggcaaatagagagaaaattatatggaataagaacaaagatgtttcttctctattatgagggactcagttctgagaaaggattttaaattgtaagaaataggtaagtccacgaatcagtgattcagtggtgtggagagctttatttctgagaaggccagtagcgctcccttctgacaagcaaatctaagacctggatgacagatgacttcctgcatttggttggttcttttgtcattcatatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcataggctaagcatgaacctcacctccaagactcggggttcctaaatggatgagaccctctttgggaagtcttgtgggcagtgtctaattccactagaaaagttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccagcatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagaggtaatccaggtctccagaacaggtaccaccggctctttagggaggaccattcaaaagggcattctcagtgattttccctaacccagctcacagtgcccaggcgtctttgcgcttcctcccacactcaatcctgggactctctggtaccacacggcatcagtgttttctggaatatagattaaacaccaatatgaggcttctgggtaaccccagtctgtgcgagatctaaaatagcaactccctaagagacaggactgggtcatttgcaccgcatcacacccaggttcatagcacaccaacatgagtttatctaatgcttcctccagagataaatttttcagaaaggtttgcaaaaaacactcaaggccactatagtaaaatggcataagctaaggtataataataaaataataacaatacttaacatttattgagtgcttattaagtctcaagcactgtctgtacccaacacttatcaaggattctttttcatgtaatcctctcaacaactatatgggttaagtatcattttattcccatgagtaaagggatgaggaaacagagggtttgtgagttgaaaacacatttcacgcttctcacagctagtgagtaataaagctgggactcaaacccagggctgtttgactccagtgcctctacccacggccaccactctttgcttgtcaatgttgttctaaacatattgaagggggggctctgaccgtggcaagcgtgtgagtagtaaggggagaatggccttcatgcactccctcctcacctccagcgccttgtgttttccttgcttagtgatttcccctctccccaccccaccccccacagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggtaaggctgtggagtccagtcagaggagattcctgccaagggggacgaccagcctgggccagggtgggtggcaagtccacagctaggtcagaacagcttctctagagcttctatgcacagcttctattactgtgatgacaagatctcaacagacggtttcaaatctcacatcactcccctccttcccatcctagaaaagtgcaaaaaagtttatgaaagtgatgggcttcctcacatacctgtcaatgcctgcagtcatccgattccgcccctaagctgtgggaagagagactttgatatattagctcctgccttttcctttcccttcccctatggagagaaacaatgggaggatcttgagctgaggaaagtcacaaaatgatgagaagagtgtagggtccttagagatgaatgaaagaaaaaaaaagagaaaggacgtctgaacagaaaagggagcggtagaggagagaacaatggggtttgccattctctatctgggtctcactggcacagacagtgctgcaagattggttccctcatgggaatgaaatgtttcccctccttcctccgcaggacaaaacaaggagaggccaccacctgttcccaacccagactatgaggtaacgtgggatagaaatgggccaggacgctggaggggatgtccctccaggggggaaggaaacagatgggatggcccatcttgtctgccagatgcctcaaagcccctcactcagggcttccattacaaccctctatgtgccacctctgcgtccttcatggtaaaacaggactgtctcaaaggctgcatggcttccacaaccatggagaggtggaagcttgcaggagacatactcctctttctctggcttattcattgactgggatacagccatggagaatattatatatgcaaattctaacacaataaattctgggctgatattccaccagcatgcaccagtatagcgagttattgaaatattaaaattatataaatattatataaaagttattgaaatattaaaatactcattgggaaatagccccaaactttgctcaccccaacccacccttacacacacacatacacacacacacacacacacacacacacacacacacacgtgaccagacatcccagtccctcccctaccgggctgcctcttgagttggggtaacaaagagttaatgcctggcatggcagaggatcaccaggattgttctagttgattggtatgtgtgcactcctagttgttaaatattttcactatcacacctggatatactcaacaaatatttgttgagccaaatactcaacaccagccaaacacgtagtatttactttagcttaagcgaattatttagccctgacagaagccctggaatgtgggtctttaagttcctatttttgagatgggaaagctgaggctcacggaaggaggtgaccagctcaagtctcctaccgtccatgccaaattagaattccagcctgcctcctgacttcaagtccaaagttcttcccacgcactaaagctagctcttcagtgtcctttcttaggaggtacttcctcccgcaccactgaccgccccctctctatttcacccccagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagagttgctgtccctgttttctgagagaccctcagaggctgccttaactcccaagaccattcaggttctcactatctttgactaaattctcagctatgaccccagatgcgagcactctctgtttccacagctggtagggccgttacctgaagctctctttagagagggcataagggaataagaaaaaaaagagagagagagagtgaagggaggggaaagaaaagaaaaagagagagagaaagaaaaataaaaggaaagggaaagaagggagggattgaggaagggaagaaagaaagaggatgggagggagagaaagaaagaaagtttcaccaacttctcttggaggaaaacatcaaacgtggcagagaaagactgatgggtccctgatggagtggttggtagaaaatggacaagacagaaataggccttgaaagacagatgaaggtacggaagaggacggtggcggtggaagccgggcttggagatgggacacagatttccacaagctgccaggaaaagctgcgagccagggctggggaagtgaaggagggaggtgtctcaagcaggcacacccccaccctgaggcagccgcctgcagccagaggcgggctgtggttaagcagtgcaggatgtgggctgcactgctaagcgtggcttctgggagtgagggtgggagaggtacagcggcagctgggcggaggcccgtgtgagagcgctttgttctcagtctcccacagcacactctgcttgcagagagaggaggctggagcatccaggaactgtcctaatccagctcaaaccagtgggctctcttctctccctccctgcactaataattcaccctgctgatttatgagtgcgaccaccactaaaaaggccattcgtgaccagcagcctccacatactgctccccctcagccttgggctgtagctacagcttctatttgtttttggtcgctgttgaagagtcacttccttcactctaagcatcaacacttaggttcagaagatgcctccatgatgttgtccatcactagctgctggatggcagttttgtcccaagtatacttgattgtgccctgtcaaggggaggcatggctcagcgtaatacaggcaataacagctgacatgtgttgagcatttactcaatacatgcttcagaaattgtacgtagcactttacctgcattatctcatttaatctttatgttgacacaagaagttagatgtcatcctcattttacagacgaggatactgaggctcagagaggtcaaatcattgcccaagtcacagatggggtggggcagagctggaactagcagccaattttaatggtcagagcatctactcattactgactgtgatcataaagaatgttccccattgtcgcacactggggcctgtcgggggtgtgggggccaagggcaggaagagcattaggacaaatacccaatgcatgaggggcttaaaacctagacgatgggttgataggtgcagcagatcaccatggcacatgtatacctatgtaacaaacctgcacgttctgcatatgcatcccagaacttaaagtaaaatttaaaaataaaaattttaaaaaagaatgtgtcgggcacggtggcttacgcctgtaatcctagcactatgggaggccgaggcaggcggatcatgaggtcaggagttcgagaccagcctggccaacatagtgaaaccctgtctctactaaaaatacaaaaaattagccaggcatggtggtgggtgcctataatcccagctatttgggaggctgaggcaggagaatcacttgaacccaggaagcagaagttgcagcaagcggagatcgtgccattgcactccagcccaggcaacagtgcaagactccgtctcaaaaaaaaaaaaaaaaaaaaaaagaatgtttctcattgtcctgacttaaaagctctgtatttaattgtttatgcattccttcaatgagtgcttttctaatcactcatgtggctatca

SEQ ID NO: 16690 - DNA, 13970 bp, Human
cctttttatttagcattttctcttcttaaccttctacccttggcctcttccttgcccagtgaggtgaagtggttgactgtggagccactcctgctaactggaaggaactgggcgttgccaggcactaagccaggaacttgaactcagctgagaagtgggatctggataactcctgcccctcagagcaaggctggcaaccagctcatgggtgtttggctacctgggggagggatttctgctcctgacaacaggcagtttgttcagttcttcctgccctgattcttctcctgttgcttttcactgcatccctgagctctttggtaactctacctctcaccagtttttgcaatttgctgtagacttcaaaatcctggctctacctctccttcctctgtagctgtatttccctgcaaagttggaagccaaccaagatcaagtttccttaactctttttctttcagggtcctggagctgaactcttctgacctacataccagaaaggctgtatcttatccttcctcaccaacatctgaaaggttcccccagcagactgattttaggtccctttctgaactagaatctgacaaagacgccacacagttttcagaaactctcaccatgcaacagattttcactagcacacagctggtctgcatttggggccacctctgctttctgagttccaacacaatggatttttgtggttgtctacctgtttttgctccatgcccatgtcatctttctcctgttgctttctgttttctgcacttctgcattctcctctcttttggtagaattttctcttttcttccctctttatgatgttttatttttttctactcagcctgccgccttctcttgttcctgccaccctttctgctctggattcagctagaagattttatgagtgactgaagagtttctagactgctaatccagggataaacgcaatctgtcttttttcagggttagattcccagcccagcctacttcttaactgcatgtgtaatcttcatccccctcctaccgatgtttctgtgccgcttcattaatctgtaaagatgacccaccctctttccagacaaggaggcatcttttctcgtttagattcctcagctctttagacttctcagtcatttagctattcaaaaaatgacagatgaaatccgaggcacaacaaagttatcatgaaaaccttttccttgagagccccatgtctgattgttcatattagctgttatttggtggaaagaacgctagatttttaagaaaagttctggttttgccacatggtagctgtgcaaccttgggcaaatcatttaccttcctcgggttcttagcgtcctcactggtagaatgggaatgcttcacaagggcgttaatggagatgaaacaatcagcaggagagcactttgtagattgcactcggatggcagggtgaatgagcagggatggtgtcctcatttgtttttaaagtcttcaaaggtaaaggattgttaagcatggagatttgatttgttgtttctgccaggtctcctggaaagctacaaactagaagaagtgcaggaatccttgtggtaacaggggtatcagctttttgtccacagagggtcctaaggaattccgactcccgttttgaaattgtatcgaatccagtcccaagtgaatgtggccctggggtggtgctttgagaagtggaatcactgcaggacagtttcaacattcacttcccaggcaagcctaaagcctgttttaaaagggcgtgtgggggccaaacccataacagtctgggacatttcagactggcaccacctcctctggctgtttccgaggccatctagaggccagagcccagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacaggtaagagccggcgggcttctctcagcgtttcctccttcactgctcactctataaagttagctaattgtcttagaagttgcaagacttttgtttgggagcctgagccacagatacagtttgttttactttgggttttactgaaaccaaagttggtggactgtttttggagaactgctctcggacaaacaggtttaggtgtgttcagctgccagtgattcaggcacagagagggctttctaatctcaggttacatgccatttttttgtgtgtggctgttctcaacctcccactgctggcaggacttggcatttggatttctgtgtgtgggtcttgtctgtgactctcagcaacaccaggaaagtggagattgttagagagagacctactgtgattttgaaagtgccccaacacacacattctaaatgtaaatatcaagtttaaaaaaatgccacgtggtacaaaggttctaggggtgcaggcaaacataagctgtctggagttgattaattcagtttctgcaatagactagtaacagtatgaaatccacctaaggacccatctggaaaacttacctgctaggagaccactttacatacaacacataatgcttaaccttaatacataatgtaatgtctaatcaatgttatgattcattttaattttttgtttatgctttcaattctatttgcggatgtttgtagtttgttataacagttttgaagtcagtaccacgaggcgaggctttaatgctgtggagaaagtaaaagcactgcgaaggcttgctgtgtggtagtttagttgtcacatggaatgggagggtccaggctgcatacaggtaggagtatgtagattctgggtgaagtaagtttgggagatggggcatctcagtttcactttactttaagtcctactcagatatttattttggaagtgtcagcagaagttctcacaatactacatcccctgttaacccttctttttcttctttttcattgcagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtaagtagattatcatcattttccagggtactcttgtttagggaaataataagccagtccatttctcctttcccttccagtatttttcttagcagcaagcacaaggttaagctcggaaacaattcttgggacagagactgagaggccgttgaaggggaaagcaagtgacagagctgcagacaggacagttgggtttgctggtgtttcacttccgctcccaccatcttggcctccttgcctgggtgctgagtaagaagaccttttgccatttcccctctctaggtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactggtaggttatgcagggaacagtggttttggaaaggatgagagcttgtagaaaagaaaggggcaatctttgttaaggctgagagagagggacaatcttttgtgatggatagagagagggactagcccttcagaactgggagcctcagagggagaccgaagagttctggggtaaaaagagaaaggctttgtttggctgtggaaagaaacagaaagtaaagcaaaggaactcagagaatccgttacaaaaatggcattgagattgtgaaagggagagggagcaattctttgatgaaaggcttacaacaggtctgttcactcactcatttattcgagatacttattgagtacctactctaatgctaggcaccgtcaaaagtgcatgacatacactatctcattgaatccccacaccactctaggaggcaggtactaatgatgggagctaacacttactgagtacttcccaaatgtcaggggctttacatgacacattttatttaatctttacatatctcatcagtttattgtgcatttaatgcctcccatcttgccaatgaggaaacgaggctcacagaggttaagtcatttgccctgagtcacgtagctgataaatggagtaacttaggactcaaacccaatcaactttgaatctaaaactgtgctctaaattggtgcattgtattgtctgcatccctataaaggacaatctggaaaaccatgccaagcaacaaagagcaaagtacacgaaacttatgaattgtagatctgggtttgagtcattgctaccatttaccagctatcaataagtcttattttcctcatctgtaaagtgagaataacacagtaaggatcacagtgaggataaaatgagataataaatgtgaatatgtcccaacctctgaattgtacttaacagctaccatacattgagtgtttattttgtacaggcacagcaaggaacaacttacatgaattattttattttttattaagaactcaagaaatgaatatcattatctctgtttatacatgaggaaactgaggctcaaagaagttaattacttcaaatcacacagctaagtatttcaacctagtgctctctggtgtgtgctcttaaccaacactactccaaacatataagcctgtgcagtggtacgatttcctttcattcatagtacagtttaaaaccatttctcaatgccccaccaatagagggctgtgtgaccttgcagaagtcatttgagtattgaaagaaataatgtaatggttttggacctcagtttcttcatctgcacaatgaagaggttaaacacacaaaaaatcagtggttcttaaatatatgtggataattattctttgagaatcaaataaaagccatggccctgcttcccataaaacagtggagacatacaaaatgagacttggattctgtgggcttgcagactaccttccatcctcttccccatcctccttcatggagtcaaggctgggaatcctgggctagacattctctaatgtcctttctggctctgagggcttatggaagtataatcagaaataaagctaaaggacaagaaaaccagggttcacagactctagtgtggcttaggggaccttccctctggtttcccttttccatcatttatccactagactgtagcttctgatttactttcctatcctctcagtggcatgagctccttgaaggtgatgtcttttttggctcagcatttctatcacagtgccaggaatgtagtaggcccttaataaatctgaataaataactgactgagtgaaagtggtgagaagtcagggagaaatgggttgggcactacgtttgatgaggttagcaaaaaccttaccccataagtagttcaacccacccagtggttttcaaagctgcatcagaatcacctggaggacctgttaagacacagattgctcagccgcacctctagtgtttctaattcagtaggtctggggtggggcctaagatttccatgttctcaagtgatattgttgctgttacttcgaagaccacactttgagaaccattaaagtatgtgtatggttttcctattgctagtaggattcacaaggtaatatattattttatgcataaaggtaggataaaggaagattccatctattgattaaatgcatccctattatgtcattagatttcattgtagtcctcttctttttagaatcctaatttaatctttttctccttacagtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcgtaaggctgggcagttctgggaaagttctaacactcttatggcgactcttggtattttgcagtgggctaaatagttgctgaacagatgtttttccctttaagtaaatcctatataaaagaattcacatttgcaggacagataaatcaggtatgaactagtaactttacaaaagctttcttaattttacaaaatatttccttatgggatttctttactatgtgggggggttgattttacaaaaatgtgctatgtaaagcttttctaaaaaatcccttatgtttaaagtgaagcatacatttgtaaaaaccactgggctaggcagtcagcagggccactatgagtcagggcttaggaaagtctgttgtgctgatagcaggtgttcattaaatgtattttaaaattgagataaaatttacccaccataaaatttacctttttcattttcacaaagttgtgcagcaatcatcactaattgcagaacgtttttaagctccctcccgtaaagaaaccccatatccctagctatcactccctattatcccctcctaccagcccccgacaactactcatctactttctgtctctatggatttgcttattctggacatttcatttaaatagaatcatacaatatgtggtcttttatgcccagcttctttcacttagcataatgctttcaaggctcatccttgttgatgtattagtatttctttcctttttatgactgcataatattccattgtatgaatataccacatattgtttgtccattcaattgatgggcatttaggttttttctgcttgttggctgttgtgactaatgctgctataaacattcatttacaagcttttgtgtagatcatatgtttttaattctcctaaaagtggaattgttgggtcttatggtaactctgtttagtttttggaggaattgccagactgtctttaaacagctggactattttgcattcctgtcagcaatatatgagggttctgatttctccccatcctcctcaacactcattgtcttttttttttttaatcataaccgtgtattaggccattcttgtgttgctatataaaaaaacccctaagactgggtaatttataaagagatttaattggctcacggttctgtggatgtacaagcatggcgccgatgttggttggctcctgaggaggcctcagggagcttttaccgatggcagaaggcacaatgggagcaggaattttgcatggtgagagcaggagaaagtgagagagttggggggaggtgctacatagttttatatgaccagattttgtgagaactcactcactattgaagacagcaccaagccatgagagatctgctcccatgacccaaacaccctccaccaggccccacctctagcaatgcagattacaattcaacatgagatttgggcggggacaaatacccaaactatatgaagccatctagtggatgtgaagtggtatctcattggggttttgatttgcatttttctaatgacttgatgttgagcatcttcccatgttcttattgtccatttgtatatcttatttggagatgcatacattcagagtttgcccattttaatatggggtacattatttcacttattcttgttgaactgtaagagttatttaagggatactagttccttatcagatatacaacttgcaatttttttcccattctgtgggttgtcttttcatgttcttcatagtgtcctttgaagaacaaaagttaaattttgatgaagtccagtttattttttctcttttgctgctagtgcttttgtgtctcatctaaaaaaccactgcctaatccccaagatcatgaagatttatggctatgttttcttctaagagttttatagtcttaatttttacatttagatctttgagttcgttttcgtatatggctgaggcagaagtccaaattcactcttttgcatgtggatatctagttgttccagcaccatttatctcatttccttaataaatatttaatgaaataaacagccttttttttttttgagacagactttcactctggttgcccaggctggagtgcaatggcatgatctcagctcactgcaacctccgcctcctgggttcaagcgattctcttgcctcagcttcccaagtagctgggattacaggcatgtaccaccatgcccagctaattttgtatttttagtagagatggggtttcaccatgttggtcaggctggtcttgaactcctgatctcaagtgatgtacctgccttggccttccaaagtgttgggattacagcgtgagccaccgcgcctggcgaaacagaactaattttaagaagcctaacaaacccaactctgaggttctagtttgaatagaaccaataaagatgacttaggtcaacacaaaactttttattttttttttgaataacaaatataaattagaggtgggatactaatggtaaaataaggtgtctgctttaaaactctggagttcccgaatcagaacccaaactgtattcccttacattctgaaaagtctctaagttcagaggtgtgaatattattaattagatggcaccagtttagctctgtgtaaacttcaatctactcccaagtgcatgtaattcttccaaaaatatgggggaaaaataccttacctgaagcttctgtgggatttacccacttgcttcttgtcttgttcacctgacatttggtttctgcttgttacagaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttattactactactactaataaatattcaacaagtaaataaatcttttttaaatcaaaagattagtatctgcttattctttttttttaattgtaaaccaattatggtattaagagagtgactcaatagacatatctggcagtttttacaggagagcttttgtactatttggaattgatttcaactcctctcatttagttattggcactaataactacatgaaatgaatccagttttagtagcgtataattttatttttccagttttcaggttcatcaggcttaaaaagtaggataatttatttttcttgtctttgtttttgagacagggtctcaacctgttgcccaggctagggtgtagtggtgcgatcttgggtcactgcaacttctccctcccaagctcaagtgatcctcctacctcagcctcccaagtagctgggaccacaggtgcgcgccactacacccagctaatttttgtactttttgtagagacggggtttccccatgttgcctaggctggtctcacctgagctcaagcgatccacctgcctcagcctcccaaagtgttgggattacaggcataagccactgcgccgggccaatttatttttcatatgctcagaatttctcccattctctgaaataggtccacacatttaatttctagatgttataaatccggacatgcaaacttaaattttacgctcataagaaagttcttgatattaatgactttatcctgtaaaactctggctctgttacacgggagaacattttttacagaccgttattagttgcaaagagggtcacatttttataggctaaagctccagtgaaagacctcaaggatttataaaatagaatatggagtaaaatgattgtattgtaaaaccagaaaaccaaaattaacattagggagtttttaccaaccaacggctattgtctttttaaagttaaggggattatctaacaacttggggtcatggaaaataaatatgggagatgttttagatcaaaagaaacttaagagatgaacacaatcaaagtgcaatgtgtgatccccaactggatgaataatagtgtgaacaagctagttgtaaaaacaagcttggaggggcaattgggaaagtcttgaatatgaaaatgttaaatatatggataatattagggaattattgttagtttgtattaggtatagtgatggtattgtagttataaagaaaatgtacctattttgaaaaattcttactggagtattaggggtaaatgtcagcaatttactttaaaagcataggaaaaaagcaaataaaacaaaaaaggcttcagaattaggtgatgggggagatgaggggagaaaagaaaagaaaagaatgaattaatgaatttaagggatgggtaaattccacatactctgttctctacttttctatatgtctgattttgtttgtaatgagagtgagaagtggggagaatatgggatgtatgtgtgtgaacaagttgtgggtcatccaagtgtccatgcaaggtacttagaggccatgatttaaggatactaactctgaaaattatgtaataaggattaggaaacttcttttaaaaattaaattgggggagaatatgaatactttccctcagaatattttccttctaataacatatatgtaattcataatgccaagtattcctattgtactcttctcaaatatattatccatttaaacttttgttttgtgttttaggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaaaattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttatataatttgtgtatatacatatctagaagttctacattgcagggaaaacagatggatatatatttaatctttaccaaaaagttttcttagtagagacaacctgcaagtcaataatggatacagttagtttctaatgggtaaacagaagtatacggatttccacagaattttcacactgttttggatagctgggaattgggcataacaacactacttagtttgagggctctttcaaagaaaagtatcaaagattctatttagtactttgcattacacttttaatagggaaaactactggctttcaagtctagtaaaggaatggaaattgaaaaatggaaacttattaattcttccccaaagcgaaagcatacttttattctcctcctgctttcattgacatgtggcaatttccagggaagaggcttactgattattaaagcagtgtacttattgtaccatctctttttcagaagtatgtgacgccatctcacttcaagtactgtgataacataactttcttacttttccaaccaaagacacagaaatcccagttcctcttttcctctaatacaggctgtaatgatttgatcatcattgccaccgccaaaagtaatttaataaacacccaattttggaggctgcaatacctacactaaaaaggacaccaaccaatgaggcttgtggcacatatcactacaagcacctaatatatatttatctatactgtatgatctcccaggtgtttctgaactctaaatttacagtagtgtattctgagaaccttcaactaaatctcgagacgtaaaaacgatgtctgacatgcagtcagagcatcaaaattatttagttctgcagaattccataaaaacaaaattgtaattattccaagtccgtagcctacttcattttcaagcaaaagagagcatttagctcccgcctgaaagttaataaatctctggtcagtgaaaccaggtgtggttctggaaagaagccaggttcctatggtaacttcggatcgccatttaagttgtctctcggcctcctgctctgacgtcacttccggtgttacctg

SEQ ID NO: 16691 - DNA, 14008 bp, Human
  misc_feature (1)...(14008): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtgagctgagattgcaccactgcactgcagcctgggtgacagagcgagaccctgtctaaaaaaaaataataaaataaaaaaataaaaaattgagatatcacatgtaaagtgcttggcacagagtttatgctcaaaaatattagttgctccctgtttggtacacaaagggcccatcacaaatgcaggtgactgctgcatgcgaatctctgccctacttaaccatctccccaggagtatgggggtcacctctgcttaggaccaccttggactccacccaccaagttctcctacttatgacgttagcttattttttcttccttcttcaaaagaaaagttttaaacatacacaaaagaagagagaactatatgacaaaccctttacacccatcaccagctagtttcaattatcaagcaaaacaactagtctcgtgtcacctattctcccatctctttttttcgttgaatatatatatatgtatttttgagatggagtctcactctgtggcccaggctgggatgtagcggagtgatctcgactcactgcaacctccgcctcccaggttcaagcaattctcctgcctcagtccccccaagtagctgggattacaggcacacgccaccacacccggctaacttttgtatttttagtagagacagggtttcaccatgttagggaggctggtctcgaactcctgacctcaggtgatctgcctgcctcggcctcccaaagtgctgggattacaggtgtgagccaccccgcccggccacccatgtgtgtctttaacagatagagatgttaaaggacaaaaccacattttatcagacccaacaaaattaagaatgattcattaatacaatctactatgtagttcatatttaacttttcccaattgtctcaaaaacttttctttcctgttgatttgtttgaatcaggtttatccaaaggcctgtgttacattcaattgtaagatctcttgggtatttttctatcagcctgcttcaacatgttctgttttcagaggaaacgctagaatgaggaaagcattaccccttgaaagtctctccaactcactttcctgaacccttttcaataacacaaaaacaagcatctcctttttttttttaggttttttttttttttttccctctggaggcagggcccaggctggagtgcggtgcagtagctgggacaagaggcatgcgacattatgcctggctaaattttgtatttttagtagagatgggttttgccatgttgcccaggctggtcttgaactcctggactcaagcaatccatccggcctcccaaagtgctggaattacaggtgtgagccactgcgtcagcctgggggtgtttttaaatgataaaaggtgtttccctttccagaatctttaaaataaatggattcctctaatagctttcaaaatccaacaatcatcccagtgaagtcaaaaagcagggtttgtattatttcttgttttagagggtaaaaatttctgggattttgttcttttcaaaatgacttttttatgccctcccacctgctttttgaaatccaccaaccacaatatttaccccatcccccttttctctcccccccatctctctctctctcctttacacactccctctctctctctttttagcagcaacatacaagccggccatattagagagatggaaataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctggctacctcgccctgccttcagcctcacggggctcagtctctttttctctttgggtaagttagacacatctgcatgctcccgagggttcagaagtgtagccgcaatgtgaagaggatgggggcaggggataggaaagaagacattgctagcgctttccctctgtgtccttgggaggggaggtgctggggactggaagggacgttgctggggagtgcagaaccctgggactacttagtcacagaaatgttgggtcaggggatctgagtgttgctgggggctgacaattgtcaagggaggtgaatcttctctggatttcccctaagtggacctacgtggcggtggggcagagagtggattgacctgcagtctcttcagggattattttttggagttgctgcaaatgcggggtcctgggacttaatgctcccttaaggggcttcttttcagaagcttgatcctggtggatttagggtattaggagagtgtgcaggggagctggtggcagaaagttgagtctgggtctggcttcttggcactcggtctcactgatctgttggaacgtgtgtgggagtaggtgggaagcgggcttggggaatgatgtctgggttgggaggagacctgctgaggcacgcactgatggagaaggcacctttggcttgggccggatggaatggaggaagggccaggtgtagagattcaggaaaaaaatggaacccacaggctgagcgaggttgcagccctttaaatccagcctcagaactgcccagcccagtcttgcagactgtcctgtcaagtgtttgtatttgaccactcagagacttcctggtggggaagtgggctagaaagttatttgcaagcctgctttgtagagtttcattcttgctcctaaacttacttattgctggagcagcaactgagagtcaagtccaaggactgttgatggaactattccccaccacaaaggctctctctctttctgtggtgtgatgtgctgggtttggagtaggagtgctaaacacagacagtgcagaggccctgccagcctgctttgctgagttacttggcatattaacatcagagcaggaatgctatggaatctctggcaggacctgggtttcaagccacctttgtcatttacgtaatgatcacaggcaagttactcaacccctctgagcttcagttccctcccgggtaaactaaagaatgcctactgcctgacgtgtttgtgatttggtgcatggcaggaactcaacgatggctaacataagaatgcttttcgtgagcccaggcactgtgtatcttgtttagccctcacagcaatcggaggtagattctattatactcaggttacagggaggaaacagatgactatggtaacgggagctgaaatttgaactccctgtgtctgacttcagcacattctcttaaacgttggattccactccccaatgttcaagaaatggcactgctatattaacagtacctaattgatcagagtctcaggacaggctgaaagaaggggagttgggtgagtggcctgttgtaaggaggcccagctggaggacaggaccctttcctcaggagttaggaagcacttcgtgcaggagagaagccgcctggtgagagccatggctaagtaaagatagaaagggggctcagtgaccaggacccagagctctgggctagggtgaggaagagggagtctgcgatgaagaggtctgagtgtttggggtggggagatggtagtgggaggaagctaaagcttctgcaaagctgagtgggagaggatgcaggaatggggaccttgaacttgaacttgattggtgctgtaatgaggcatgtccctggcactccaatgctgagggccgagttgacagtggaactttggtggtgttgcagtagcatcgatccccaggatggaggatgccacaagtgacgagggaggggactctgtcggggctgggcttgtggggatgactatggaggtggcaaagagaaagggcaggtgggcaaccagctctacccacggcagaagcatatgaggctagttttagccagaaacaattcaaatgactgggcttccctcaagtttttcttgagaccgttgactccacagtcactggcctgcttaccaatgtatggattatgttagtggaggcatagaaagtggagtctgggctgagcatggtggctcacgcctgtatcccagtgctttgggaggccgaggtgggaggatcgcttgaggccaggaattggagaccagcctggacaacatagcaagaccctgtctctacaaaaaaaaaaaaaaaaaaaaaaaaaaaagaaaagaaaaataagccaggcatggtggcatgtacctgtagtcctaactgttccaggaggctgaagaaggagtatcaagagttccaggctgcagtgagccgtgatcatgcctctgcactccagcgtgggcagcagaaccaaaccctgtctcttaaaaaaagaaagaaagaaagaaagaaagaaagtgaagtctagtcctcactctagcccactgcacatatctgctgcttgtggtggtggggacccagacatggagagaaagctgtctcttcttcctttagtagactttattgagtccccactctgccacacactgtcctgggtgccagggataccaagatgaataggagtcagttccccggagcctctagagggaaacaggcccatgaacaaataataacaagacaacattgtatgtatggcaacaataatagcaataatgctcatcatagtcgcagctgacttttgtccaggccatgtgctaggcactgtgctgagcttcatacaggtagtaagtcatttaatccttcgacagccctatgaagttgggcttattgtcccctatattacagatgaggaaactgaggcactgggaggttaactatcctgccattctgccctcaagtcatgtggaagagataggaacagggctggggtgaggacaaggacaatggggaaacagtcaccgaggctaatgccctgtaagctgggacctgaagaataagtaggaggggcccaggggcaggagggcaaatgagcttctcaacctgaagcaaaaatacgtgcaaaggcatggagaagggaaggaaggtggtgttttcagaaaaaatcagaactggggtcactggagtgaaggagacctggggggatgggggctggcaggggatgaggctagggtataggttggtcccagatgccaaagggcttggaagctgtgcccaggagcctggacttgatcctgaaagcagtgggtagccgttggaggtctggaggtgaggagtgatgagggtgggttgctcctggctgcacggggatggactggagtggccggggttggggaggcccttgagcaggaagggtctggatggtaaggcagtgcaggtgcggagatacgggctggatgccacactcacctgggaggcaggggctgccccgggagacagttcatctgtttagacacttaaaaaaaaaaaaaaaaaccaagaagaaaataattacctcataggttgctgtagggtggaaagaggagtgaagagattaacttccagtctctgcaagagacagcatttggcagatgagcaaatttttatagtctctgcaagatgggctagttagaacagtggatgacacgaggcctgagggcccagatgtgccttggagacagcgggtggcccgccactgctgaggttttggatctaagatcagaagcctcatcccgttgatgatcttttcccttctgtgagttgaaaatcaggagacacaggccccagacctggtctcaaatgggacaaccaggaagattgtgggccccccttgtatggaggttcctttaaatggtacaattccctgctggcgggcctgcctggagttggacctgccatatagtcggcaagagatcggatgccttggaatggggctcacttcaccactcagcttcaatgcctcaacccagtctggagccaggcaggctggcttcagattctagcttcgcctcttactagccgtgaacttgggctcgtctcttaacttctttgtgctccatcttcctcatccggaatgtgggagcgataacaggttttgttagtattaaatgaggtgatgtatgtagagtacgtagacagtgcctggctcgttgtaagcattttgtaagggtttgtggctgtgatgaagtcctttctgtggccttggccatgcattcgggtgctttcccgaagcaggagagttaatcaagagaccagagttttgctcacagctctgaccttgttgagccatggtcccctcgtctttaatgagggcccggactggcgggaggtctgaggccagcaccctagagctgctgggattctggtgaggccacaggcttacgtggagatattggattaggggctaggaaccatgattctggcctcagcttgtccctattctctgtgtgtggctctcatggcctttcctcaccggtaaaacaatggggctagatctacggtttctgatctcagctccagctgtggctccggatcccatgctcgctccgcaggatggaacttgacgtttgactctgtgaccactagagggcacgcgtgttccgcccggtaccttctgcagggccccgctgcagggtggggagggggagcccgcattgcacctctccggctgcccccgtcctgccggccagaaaaggcgcccccgcactcctctctaccctgccctcccccacggcagggtgctagctccttcgagatggtgaggttcaagttctaatctggagcactgccttgggcttggtggggggcagaggcccgcacagagtccgccgggcttcgcagaacgcagactttttggtctggggagcccctgggaagatgatcgaccttccaagggaagagctagagggataggacattcctgggatgggaggtaagctcaggacaagcactgtcagtgccttccctcagagctctgggcctctgcagatgaagatgctgttggcattttctgcacacctcctccttggctggtgcgctgccagatgctttcagaacggcgatgaaagtacaggagatggaattgggctttgttcttcctgacaggggcccactcagcctccccagtccttattcccctaatgagcacttaagctcacacctggaatcctcggccctggactcctcctctagaaaacgcagatggtgacacctgtctcccagcttggagaacagatgaggtccccatgcctacccctccatccagggctgctgccagttcagagaatctctggttcttaagtcctgccatttgccctggtcactcgggccaggggcggggctggcagaagggtgctccaggcagatgttgatttccctgcaggctgcagggcggctgcttctacggctttgtgaagaaaaaaaaaaagtttgaaaaataggagccctgcaggcctgggctgttcgccaattcctacggactggttggagtggggcagtctccaaggtgccctcaggccaggccagaggctcccctagaagcccttcctgtttgcaaggcagaacttggggagaattgaggataatagcagctaccatttgctgaatacttactgcttcttttcattatcgaaacaaccctgggagatcggtgtcaccaactgcgttttacaaaggagtagcccccactcttccagcttctgatgctggagctgggattgaacccaagtctagtctcatccccttgtctatgcgattcccacatcagcctctatcgggctcatctggacagcctcccagcagcccccatactccccaaccctgcagggacctcctatcacactccaaagaggaaactcctaattccatatcctagcccacaaagcctttgtgagctggtccctgcctaactcttggacctcaggtctcaccatgcaccccctcggtcattctgctccctctgcctcaggcacacgaaactccttccagccactgggacttggcccctgggagtacacttgcctgggaactcgactcgctcaaaacttcaacgggctcactctctcacttcaggtgggcgctgcctgtgtgtccccctcagagcagtcttccctgcccacccgacatcagacaatgcccctctaccttgccgagtgtctctacctacaactccatgatttttttccttgttgatgtctatccttctccccagaatataagcttcatgatgcagtgactctgcctgtcctgttcacagcagtaacccccagggcctagactaagtgcctggcacacagtaggtgatttataaatatttggtaaatgagtgaatgaatgatgctgaacactgctgtttatcctccataaagaaaaggaatcttctgagataaggttcttgaggatacgggcagagcatcttggaatgaaggccagggctcaggtgagtccagtgaggtgcctagggcgtgacatttaaggaggtatttccatgaccaggcagtggatgccccttaagtgtcttgccccaggcccctcgctcgcctccctgtaggctctgtcctgcttagaatgtcggagtgggacaggcctttctcagccccagcaccaaagtctcctggcctcagtctggtgttcctaataggactctgcagaaccagcagctcccaccctgcctgcctgtagcagctccttgctgtggtgtctccaggttgacatcttcaagagggactcctgtccctgcagacccatcagctggtccttggaatggtgcctcaccttctggggcacctcttccctcccacagcttgtctgccctctttcttgtctgttgcaagcctgaggaaggtagggggctgggctgggctgggacacagctttgctctgtccctggggtatggagagcgaggccttccaaatctccagctgttctcagtctgctgtcctgagaacagaacggcaggggagccctgcagtttcagctggaagggttttggcccagcaaagatggttagaagtggtgagaataagggggaaactgaggcaagcatagtgaagccccttgtctgtggtcttctgctggcatgtgacagaactggggcaagtgtggtgggggcaggggtgcctaacagtggttctagaaaaggcttgaggccgtttggctgcccctggcttgacagatatagatgatgtgacgatttggtttctctcctcccctacctgctctgtggccccgctttgccccaaagaccacatctggtgccccatatgtgcctgcccactccaggagtatggactggggaggctgagtgggcccctgccaggaagaacgaagtccaattccatgcggcttgcacctgtactcccagctacttgggaggctgaggtgagaggatcacctgagcccagcaggtctaggctgcagtgagtcatgattgcgccactgcactccagcttgggcaacagagaccctgttgcaaataacagtaactcccacctcctgattaactggagctgtcagggacccagtcccctccctgtggctctgctctgcctcatcccccaacactcccaggcacagagggcttgcccctccccagccctttcagccagactcctcaccagcttgtggcttcatctgcagtgccaccaggacggagcatggaggtcacagtacctgccaccctcaacgtcctcaatggctctgacgcccgcctgccctgcaccttcaactcctgctacacagtgaaccacaaacagttctccctgaactggacttaccaggagtgcaacaactgctctgaggagatggtgagtcctgggctgaaggcaggggcaggggaggaggtaggagccccatggcatgaagcccctggtcccaccaccggccccggcactgcgctagggccccagaggaccctgggtgggctgcgtgctctggaggctcttgaaacaaggtgtgctgcgcatccaggtgcctcacagaggtaactgcctctcttccccaggaaaagggtggatgggaagagggggcatcctcactgtccttgtagttccttgctcatccagccacccatcctgtcccttgctccaaccccagttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccctgaccgccaccgtggccatggcaagatccatctgcaggtcctcatggaaggtgaaggctggggtgccagctgcggggccctgacctttcccacccacctactctctgcggcatttgctcagggcactttggggaggccaggccctcctgaggatgggagcaaccatttgtgctgcatagaaggaatccattttcttccctctagtcctcaagaacctgggaacatgtcccagagagtcctggtaatgatacagaatataatcccagtcttaataatggggcttggtgtgatggctcacacctgtaatcacagcgctttgggaggctgaggcaggcagatagcttgagctcaggagctcgagaccagcctgggcaacatggcaaaactccatctctacagaaaatgcaaaaattagctgggcatggtggcttgcacctatactcccagctacttgggaggctgaggtgagaggatcatctgagcccagcaggtagaggctgcagtgaatcatgattgtgccactgcactccagcttgggcaacagagcaagaccctgtttcaaatgacaacaacagcaataataatgatggtgatgatggcagctttcatttattgggcacctctatgtctcagtcatagggctaagctctgtttatgcattatctcatcctcatgaaaacctttgagggaggtactattattaagcccattttacatgttagaaaactgaggttagagaggataagttacttaaggtcacgcaattcgtaagttgtacaattaggactcaaatttgggtctgtttgatcttaaagttcatgctcttaaatacttcatcacactagctcctctgggggctttgggtgtcctgggatttggaggtggcggcgcttcagggtcagtcactggattgcttttcggctttgctaaagtcctgtctgtggaggagagtaaagtcaggatggttccacgcatgccacgggtagtggggtgatgggggaggcccctttcccagccctggtgctcagtggctctgcttcctttccagagccccctgagcgggactccacggtggccgtgattgtgggtgcctccgtcgggggcttcctggctgtggtcatcttggtgctgatggtggtcaagtgtgtgaggagaaaaaaagagcagaagctgagcacagatgacctgaagaccgaggaggagggcaagacggacggtgaaggcaacccggatgatggcgccaagtagtgggtggccggccctgcagcctcccgtgtcccgtctcctcccctctccgccctgtacagtgaccctgcctgctcgctcttggtgtgcttcccgtgacctaggaccccagggcccacctggggcctcctgaacccccgacttcgtatctcccaccctgcaccaagagtgacccactctcttccatccgagaaacctgccatgctctgggacgtgtgggccctggggagaggagagaaagggctcccacctgccagtccctggggggaggcaggaggcacatgtgagggtccccagagagaagggagtgggtgggcaggggtagaggagggggccgctgtccacctgcccagtgcttggcctggcagtggcttcagagaggacctggtggggagggagggctttcctgtgctgacagcgctccctcaggagggccttggcctggcacggctgtgctcctcccctgctcccagcccagagcagccatcaggctggaggtgacgatgagttcctgaaacttggaggggcatgttaaagggatgactgtgcattccagggcactgacggaaagccagggctgcaggcaaagctggacatgtgccctggcccaggaggccatgttgggccctcgtttccattgctagtggcctccttggggctcccgttggctcctaatcccttaggactgtggatgaggccagactggaagagcagctccaggtagggggccatgtttcccagcggggacccaccaacagaggccagtttcaaagtcagctgaggggctgaggggtggggctccatggtgaatgcaggttgctgcaggctctgccttctccatggggtaaccaccctcgcctgggcaggggcagccaaggctgggaaatgaggaggccatgcacagggtggggcagctttctttggggcttcagtgagaactctcccagttgcccttggtggggtttccacctggcttttggctacagagagggaagggaaagcctgaggccggcataaggggaggccttggaacctgagctgccaatgccagccctgtcccatctgcggccacgctactcgctcctctcccaacaactcccttcgtggggacaaaagtgacaattgtaggccaggcacagtggctcacgcctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaaaaaaaaaaaaaaaaaaaaaggcaattgtgcggagccaaccatcactgccattacactcacattcaatggaaattgattaggcctgagagaaggagcaagaggcagaaacactgactctgagaccatgaccttggaagatcctcagagatcaactagccaagtcactcacttaaaatggggaaactgaggttccaactgacagaaactgagggtcctgccctcttctctggctcctcagtctccagtttgaagcaacagagccatcattttcccagtgggaggggcctctgtgtcctggtctatgatggggcgagttggaggggtgggcttctctagccctgccccctcccaggagcccagcccctctggccaggactgaggaggagtggagggaagcagggagggagggagcaagtgtgaagggcacagctgctggcaaatgccccattccctgccccagcacttcccagcctttccaggagctctgccccacccctactcaaggagtcaggtgcccagggtagggaataagtctaggaaagggggtggagacaggaccgtgacagtctcagggaccaatccctgcctctgcccatcagattgccaatttggggagacagcaatatcatctgggagattcagcttaatttgcttcaattcagcaaccatttattgagcatctattatgtgccaggcactgtgccgggcactggggatatacacaaagccataagcactggggactgccaggttggcactgtagggaccaagattaactttttggtgcatctaattccacctctgcaagacactgcttccaaggctacagttggggaagatgaagagattctagaatctgtgccctgggaagggagaaacagcagggaagag

SEQ ID NO: 16692 - DNA, 15037 bp, Human
tcccaaagtgctgggattataggcgtgagccaccgcacccggcctgtaatgtatttcaatgttaagtctccaccccaaagtgaacatgggtcatatacaacacacatgtttattcagtatacttgcattaggacccccttcatgagtatctatagctcttcctgtaacctgttgaatatggtattttttgtttttgttttttcttttttgagacagagtctcgctctgtcacccaggctggagtgcagtggcgcgatctcggctcactgcaacctccgcctcccaggttcaagcgattcttctgcctcagcttcccgagtagctgggattataggcacatgccatcatgcctggcagattttttgtatttttagtagagacggggtttcaccatgttagccaggatggtctcaatctcctgaccttgtgatccgcccacctcggcctcccaaagtttgggattacaggtgtgagccaccgtgcccggccgaatatgtatgtttagccaagccattcgacataaagctcctgcctctttttaagggtctgtctctggttttgaccagaagcccacctcccagcctgcaggttgtaaccctttataagaaataaagtcagcctggcacggtggctcatgactgtaatcccagcactttgggaggctgaggtaggaggatcacttgagctcaggagtttaagatcagcctgggcaacataatgagacccccgtctccacaaaaaataaaaaaaaattagctgggtgtggtgtgagagcctgtggtcatggcatctggcatgatttttataaagatagttttattttaagtataagagtagtttttgggtaaggtgtggtggctcacccctgtaatcctagcactttgggaggctgaggtgggtggattgcttgaggccaggagtttgatatcagcctggccaacatggtaaaaaatgcaatgatcctagcccttgcctcttcctgtacttaagatactgtctgacaggattaatgattatgcttctgtgacctataaacagatgtactcttgcacccaaaccttgatgagatttatgctctaatgtaacttctgagcacatttgatgtaatttctgagcacatggagagccgccaccaccagtgtataaactgtcggaaacactgctttggagcagtctagcagaaactccctgaaaggctctcccgggttgcaattcttggtaagacttctgaatagaactaactttaaatatttaaaagcttgtttttttttttctttagttgacataacaaagcataccttagaagtctttttttttttttttttttttttttgagacggagtttcgctcttgttgcccaggctggaaatggcgcgatctcggctcaccgcaacctccgcctcccgggttcaagtgattctcctgcctcagcctctggagtagctaggattacaggcatgcgccaccacgcccgtctacttttgtatttttagtagagacggggtttctccatgtcggtcaggctggtctcaaattcccgacctcaggtgatccgcccacctcggccttccaaagtgctgggattacaggcatgagccactgcacccagccagaattctttttcctcttacagaaaaggaaaggtttcaccatgttggccaggctggtcttggactcctcgcctcaagtgatccacctgcctcggcctcccaaagtgttgggattacaggagtgagccaccgctcccggcctgtacttagttcttttaaagagaaaactggcagggcgcaaaactggccaacatggagaaaccttgtctcttctaaagaaacaaaaattaccgggcataatcccagctactcgggaggctgaggcaggagaatcgcttgaagccgggaggcggaggttgcagtgagccgagatcgcgccattgcactccagcctgggcgacagagcgagaccctgtctcagaaaataaaaaataaataaagagaaaaaaatactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggagggcggcggagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcggtgaggtggtggcgagagcgcggggcttcgggacagggcttcgggaagcggacaggtgtgggctgttagcagtggcaggtcgaggtggggaggacgcggggtcagggccgtgggaaggtcacggcggagggcggggaaaggtatctcgccgcttgcctaggggcggggttcgggggtcctcctgaggacctgggaggtggggagcgatcccctgaccgagtcctcactcgcggctgttcccttccacagccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgagttggggacgcttttggggagagggcctccaggttgggcctgccgtcttttccctggttggggtgtgaccttgggctcgagtcttcccgtttgtggtttgggttcggacccaggaccactcaccccgagaatggccccattccctaccctagccacgccttggcttcacgggacaatcttcactataagccaacattatttagcatataatgcccgttaagtaggcggccaaattcttttccagccttttgttaaggagcccatataagggaagtgatcatgtctcctcttataatgcggaaaatgggattcagacaccttaggtgacttgcaggggtccaggtctgtcagcctcactgcccaaggtcataatctccaggctagaccagaaatacattttaggaagcaaatgcattttaacagtacaatgaaatgtgtgattttccaaaaaatacaaattctctaaattgacacaagaaatcttgagtcacagatagatatatgaataggtgagaagattcccaagaaataattatctcctcctcctttcagcccccagccccagggccagatgtttttattgacacatccttttagttttccagaaacaatgtcctgcgatttaaattgttactaagcataggaaaaggtggcctgcaacttccttgttatatgtcacttgttatagtaaagaatgctatattacatgaactctaaaatgtgctagattgtaaggagctgtctgtgctccagtgccagagaaagaatctcaagaatcttgccaattttaatcaaaggatactatagattgtaaaatgcctcttgcattccaagatgttagatgtgaaatacatgttcatctaagattgtgtgatatatggtatatgcattgacatctcttaggaaagcaaatatcacatgttctcacttatcagtgggagctaaaaaatacgtacatacagatgtagagagtggaatgatggacagtgaagacttggaaggatgaaggggtggatgatgagaaactacttaatgggtccaggcctggaggctcacacctgtaatctcagcactttgggagaccaaggcaggcggatcagctgaggccaggagttcaagaccagcctggcaaacatagtgaagccccatctctactaaaaatacaaaaattagccatgcatggcacacgcctgtaatcccagctcctggggagactgaggcaagagaatcgcttgaacccgggaggcagagattgcagtgagccgagatggagccactgcactccagcctgggtgagagagcgagagtccatctcaaaaaaaaaaaaagaaattacttaatgggtacaaggtttgttattctggtgatggataattcagaatccctgatttgactacttgtgcattctgtgcctgtaatgacatcacacttgtgggcggggcacagtggcttacaccagtaattccagggctttgagaggccaaagcaggaggatcgattgagcccaggaataagaggttgcagtgagccatgattatgtcactgtactctggcctgggtgacagagcaaggccctctgtcttaaaaaaaaaaaaaaagaaaaaaatggagtttcaggtgtggatagaaatttctaaaaattgtgcttgtaccccataaatttatacaataaaaaaaagtcttggctgggcgcagtggctcatgcctataatcccagcactttgggagaccgaggcaggcggatcacgaggtcaagagattgagaccatcctggccaacatggtgaaaccccgcctctactaaaaatacaaaaattaggctagacgcggtggctcacgcctgtaatcccagcactttgggaggccgaggcgggcgaatcacaaggtcaggagattgagaccatcctggctaacacggtgaaaccccgtctctactaaaaatacaaaaaattagccgggcgtggtggcgggcgcctgtagttccagctactcgggaggctgaggcaggagaatgccatgaacctgggaggcagagcttgcagtgagccaagatcgcaccactgcactccagcctgggtgacagagcgagactccgtctcaaaaaaaaaacacacacacacaaaaaaacaaaaattagctgggcgtggtggtgcacgcctgtagttccagctactcgggaggctgaggcgggagaatcacttgaacccaggaagcagaggttgagtgagccgacatcacaccactgcactcgtctcgtgacagagtgagactccatgtcaaaaaaaaaaaaaagtacttaggaaagtagatgtgaaaaacttaaatcagctgtgaacaaatagtaaattaaaagactagaccgtgtgaccaagtggggtgagtggtacgtgtttcttttacattttttttttttttttgagatggagtctctctgtcacccaggctggagtgcagtggcacgatcttggctcactacatcctctgcctcttgggttcaagcaattctgcctcagcctcccaagtagctaggactacaggcacgtgccaccacacctggctaatttttgtatttttagtagagacagggtttcactatattggccaggctggtctcgaactgctgacctcgtaatccacctgccttggcctcccaaagtgctgggattacaggtataagccaccgcgcccagcctgtggtgcgtgtttcacagcaaccaggaggctgtcaagaaaattaatattaccttattgggtgccaaggcaacactgtttggtgttcagagctgattaaaaacaacaacaaaaaagatattataggaacaatatttagtgtgataaaatatacagtctaaaccaatagtcccttccttaatgatgaaaggataaaatcattgccagaacaaaggcagcgtgtaatttttagaaaggaaaaaataagttgttatttgcaaatgatatgttgtatgcttagacaaaaacaaataattaactgaaaattgagagtgaatttaaggatttgtatgctggtgagaccaggtaaatgtgcacagttagaagtgtccctgtgggtccttgatagccaatcaggagagcaatgatgtggtgtgacgagtcattcggctgcccctgttttccaagcatgactgtgtccccaagcacaggggtcctgctggggcagctctccctgactccaggattcataagtccctgcctggggcttgtactgagtcactcaggtggggtgtgagtagggggctggggagtggtttgtttgtaaccttttctggtggcttcttgaccaggtgggagtgtggattgatgttggcagccgttttgagactgagaagaataatggggcaggctactttttggagcatctggctttcaaggtgaggctcttaaagtctgtctcctctgggcttagggctgcctgttgtccctcctgaggatgaaggtcagaaaaattagcctgattatgggcctcagttgcggggctgatgtctggctggctttcctaaaaggagccacatgagcttaacctctcctgagtgggcacgtatctgatgagcccctgcctgaggccctcagagccaagaggacccaaggaaccataggagccccacttttcaccagagaagccaggcctgtggaacacacgtagatatgcacatgcattttaacaaacccacagacatgggcatgcatgcttgcttatgaaatgttcttctctggtggaatatctaggcatcccttggttgtaaagacccatgttttttaaaggaatgaaaaacatggagaaggattatggggtgggcagggccatggagccatagtaggcaacctagccagctgcaatgtcacaggtatgtgtgcagaattaacgtgtgtgtgcacaccaagagatagcaccactgttctccacacacaggactaggattgggtcccacagaggccactagcatgtattcacaaacatacagtcatgggaatggcatgggaggagtgggttctatcacttgaacacaggtgtgggcttacctgaccatggctgtcaataaggaggggggaggtgtactggtaatgatccccacagcttgttggtaagctgttacaggagctttaggcaacacttgctctggccatgcccttcagtcctggccctggctatctctgttctgttggcgcatgatgccatggttttggtcacctcaaggcctgcttagtgcttggtaaacagactctgggatctgtgtccccagagtctatgctgagggaggtacctgtggaccagtggtcctgctgggtgtttagcctctgaggacagggttcttgggttcctgtgtagctcctgattgttctggttgatatctggttccagggaacaaagaatcggcctggcagtgccctggagaaggaggtggagagcatgggggcccatcttaatgcctacagcacccgggagcacacagcttactacatcaaggcgctgtccaaggatctgccgaaaggtaacacctggaggaagaggcggggacagagggcagggaagcagaggacagctacctaggagcccctggctgaccacagaatcatattacccttagcgtatggctttgcagctgggcaactaggggtgggcagcaggagatgccaggcctggggattttgtgctgtcgttggtctgcagtggtccacctggcacctaaacatgtcctccttgcatctagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggtgagagttggctggccttgtggggggatgcttgctccattctggcctggccagaccctttccaggtcacatttttagttggctagctgtcggggttattttcctgagttatgcaactggagacagtttctgtatccatgtggtccagtgagtcttttttaatggctttgtgggcttcacttgaattttgggctttgttttaaggtatgttttggtgcatgtcctgacagtccaagggcgaagtgtctgggtgtcccctccatgtggtctcttgtctcctttgtggatggctccgggagctttgatgctgcccttttgagagtcccacagtgttggctcacgccttctcagagaagactatgagcctgtcctgaagtcaggcatgaggcaagggcagacaagggttgccctctgggccctggaggggtgggtggcagagacaggggaagggggttggggagtgtgctagggcccactcttcggagaaaccatgcctctcctagtctgcctcctcagtcccattcatgcatgtaccccaactcactccagtgtggtagaggtgttgacacactgaccatatgtcttgtaggaagctgtctcgtgcagacttgaccgagtacctcagcacacattacaaggcccctcgaatggtgctggcagcagctggaggtgagtgatggaatcactgaagtcctgggtagtggggtcccagccttggttatcaaagccgaggtcctggttcccaccataggggacctttcaccccaggggactctgctcccaccctaaccttgaggggaatgaccttcctcctgtgctctctgaggtgggataggattctaccctgccgccaccactgggactggttacacaggatgctgtccctctggtacaggtctgtcttagccccacctggttctaggatactgagttcatgggctggtaggggatgtaagctcctggccttgttccttgtggccttgcccttgggagagccagccattagttgtgtgttgatgcatgcctgataacaaaccaagaagtgccttgaaaggaaggcacagaagggtggggaagatttcactggggactcagagttggagtttgggggaggggctttttaaagcacctgtagtttgaacagaagcctgaaaggtggtgagtgttatttaggtggggtgtggggagctgagcgcaggggaagagcagtgtcatggtctaaggtttgctctgctgctgtgtggggtcacagtgcaggtaggctggctagagaggggctgtggcagggactgggcaggagatggcaggagcaagggggagcagtagatggactccaggtggttttatagatggaacctggttggggtctggacatgggtaaggaactgaggtcaaggtgcttcccatcttggctggtcgtggtggctcacgcctgtaatcctagcactttggaaggccgaggtgggtgaatcacctgaggtaaggagttcgagaccagcccagccaacgtgacaaaaccccgtctctggtaaaaatacaaaaattagccaggcttggtggcagttgcctataatcccagctacttggaaggctgaggcaggagaatcccttgaacccgggggacggaggttgcagcgagctgagattgtaccactgcactccggcctgcacaacagagtgaaactccatctcaaaaaaaaaaaaaaaaacaaacatgcttcccagcttatgaccttggcggctgagtgtgcagaaaagaccaataggaagagcatgaccaggggctttggagctggggaacctgggggcaagagcaatctgacgtgtgtgtcagactagcagggcttgagctcatggaaggaaggaatgaaaggccaacgcaggccgggcgcggtggctcacgcctgtaatcccagcactttgggaggccgaggcgggcggatcacaagatcaggagctcgagaccatcctggctaacacagtgaaaccccgtctctactgaaaatacaaaaaaattagccaggcgtggtggcgggcgcctatagtcccagctactcgggaggctgaggcaggagaatggcgtggacccgggaggtggagcttgcagttagctgagattgcaccactgtgctccagcctgggcaacagagcgagactccgtctcaaaaaaaaaaaaaaaggccaatgcaactggtggcaccacagagccctcctcttgtggaggtgaggaggcaagatccaaggagtcctagggtatacgtttgtaacattatttgcaaatgtccccagctctcaggggacccaagagctaatcacagccctgtaatagctcctctttctgccccctcacttgccaccccctgcagggccagcagccagaaatacttgagggagagctagagggaaaaggcaggccaggtggctttgtgcccaggagtaccagtcttgtccttgatgtaggtggaatgcatcttctcaagtgagaacccacacttggatcacatggcagcccattttgaaactctgaacgcttttgctctcctgggactgaggccatgggagctatttggccctgaggtgcctgtcctgtccacaaggcagggtctgtctgaggaggaccttctttcctcaccctgttctaatgtcacatactcctggtttctcccactaagacaggacatgggggtcctctgcctgtctgtgaatcgccccaccctgtgccttgggccctggctggtcagtaatgccactgtctgtctcagcaggagtggagcaccagcaactgttagacctcgcccagaagcacctcggtggcatcccatggacatatgcagaggacgctgtgcccactcttactccatgccgcttcactggcagtgaggtatgctgccttttgggcaggagtagtgctcagctgggggcctgtgggaggacccccatgtgcatggttatcctggtgactccagagatacctcagcagttgggaaggggttctgtggctgctgcatcacaggcacacatgttcacacacatacaccctctacccacacctgccaccttttctgttcccctggcagtctggctgttcctcagccttgtcatgtactgtttcagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtggtgagtgccagcgcgagcatgggacctcgccttcagggaagagagggtgctggggctgtgtgctcctgtgcgtgggggtcacagtgtgcgttgaagacaagagggtgggtgctgaccacctatccccctggcagcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggtaagtggcagcctggtattcctaggtgggatggcggctttaaccagcacagtgggaggctgagagatgacacactggctcagaatgaataccacccacccccccactttaggatgcgcctgtgtaccagtgccacggagagtgaggtggcccggggcaaaaacatcctcagaaatgccctggtatctcatctagatggtgagtcctacagctcagcggggaggggtagagtacatcttgccagcgacagcaccaaggtggccactgctcctaactaaccaaggttagaaaggaaaactttgaagaccacgccatgccccatcaccccacccttggagatgcaggcaggtgtgagacaggtccacagcccatcactgccataataggtgaccatagaagagagggctgtgatctgagtcagcatgaggtcagggaggtccttgtcaacctgaggctggagattgtttgtgtacctgtgggtccaggattgggctgggtggacctctgagccttctctcacccttaaaggcactactcctgtgtgtgaggacatcggacgcagcctcctgacctatggccgccgcatccccctggctgaatgggaaagccggattgcggtaacatggacccctgggagaggttctggagtcttggcctggcagacacctgggaggtgtagggttggggcctggcatagcgcagcctgctcctataggcatccctggtgtcctaggcagctgtcacctgcaggggtagcatagtgggagggcagggcataggtgctgatggctgtggagatgggcggggcccatggaggtctatagcagggatcccttctgcctttcctcttttgggctggggacagctgcatgctgcctgtgggagatctctgctagttggatgatgctgactggctgaggtggtggccaggtgcccgttagccagtatgccctctgcctcaccctgcaggaggtggatgccagtgtggtacgtgagatctgctccaagtacatctatgaccagtgcccagcagtggctggatatggtaagtggcctagggggtctgctctttgtttatttcctcaggccgttctcttggcctccccttccacctctgctcccgcactgctgctcagcttacagagcagccagttaaggccccaagcagctctccccagtcccctggctgccagggagttcttgctcagaaaacctgtcccagcagttccttgactgcctgccaaggtgccttcatcaataccctgcacccgtcaggtaacgggcacctccatgtggggtggggcttcaagggccagaacatgaagggacaggctcagcacccctgggggaatgttctctcctctctttccactcaaagcctgtcttgtgctgctctgggcagcatctccgagctgggtgcggcacagggccaggtgtccctgtgcaggccaggtaccccaccctgacgctccaccctatccccacaggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaagtgtgtcatccctcttttggcattggcatggagtccatggggcagtagatggggagcaaggacttccctctagttctgtggctcctggatcctcctgccttcccacaggctgatgtgtcctcagccaggggcaagcgtgggggttgcagctgaggccggaagtctttgatgcctacagggagctgagcccagatgtttccactcagccacttaggggagttcctcagccagctggtcccaagattgggctgtgggagtccataggaagtgtaaacccagcctttgcccctgtaggagtcccagcctggaatccctgcaggctcaggtgggaaacccctcactgtggaccttgtgccaagtcaccccctggtggtccctggtggaccagaaggggccaaggggtgtctccaaggatgcctcttgtgtgtgtttactctgcattctgggaggaggatagcctggggcatagtgttctcatttggtttctaactgctgcctggacaagcagggcaggaatcctttgcctccgctgactcaggctccaagaatagccctgagctcagtggggcccgagccccctccctctactacatttgtcccaggcaagtccagagctgctggcctgacaatcccctccccattttcctgaggcagccaggacctggtacagctcttagctacctagtccctctgttatctcttttggctctggtccccatggtgggtgcgcaggtaggctgctcctcctgcaccccccagtgcttccacagtcaggttctctgggatcccagggggaagttgaaagcgaggggcccaattttcctttgaggaagtcgctgcctggcagtcacaagcagggtgctgggacaaggtcttttagaagatggctgttcagaagtccccccagcatcgtagcttggaagtagcccaaggaacccttgtatcactatcaccctgccccactgcctttccctcaccattggttgccatacgttgccaattcggagacatttgttaagcaccttctacggcccgggactggggcattgcgcagatcattctactttgtgaacggctggagagaagatgctgggcagcgcagaaccctgacaggcccaaccctgggtgctcatggaggtgcaacacccaggcaggggaacaagtgccaagtctgttgtcaagtttgagctcctggaggatggggcttcatttctaagcccagcctggcccttagaggctacaggtgtgctggacacgagagcttgagttgctgggagtggtctggttctaagggaccttgcgtaccaagccagggactctggtctttaccctggagccatgctggggaggtgtgttggaggttactgtgaagagaagtgacttggtcagagttgagattcagcatggggactctcaggccatatttctgtatcagtcttggtgagctgtgctgtggcagaacagaggtcatggccacacgaactggagccagctgtaggggacacaaagaggactacattcccagcagggctgggagacgcggaggcacgagtgggttggaggagggtaatcttccatagtccagtgaggagtttggtggtgtccagggtacagtgggatgtgtggggctgggacctgataaagaggccctggttggaaacagatggggtgaggtagtgactgaggccagggaaggaaatgttcagggaaagcttgggagggagaaggatgtgctctgggggctccaccgccctgatggggttgcaggtaggcactggcctcgggctgtgccctaggctgtgttcctcccaggaggccagagctggggcttcagagggccacactcctgctcgtgagtctcatagaagctccagacgtggagtcattccaaccttactcctaccttctcaacagcctctcccagcaccctttgagagaccctctcacagcagcctgtcctttcttttggaggcacctcaattctgatgaggtttgcctga

SEQ ID NO: 16693 - DNA, 41671 bp, Human
  misc_feature (1)...(41671): n = A,T,C or G
gatctgctgggactggggtggaggaataagcgggtagatactgcaaaaggaggatgaggaaggaggaagttgttgactctgcctggggcagggtgttcccagggcaagcagctagagctggtttgggggagggtccagatgggcttccagcatgtggacctttggaatcttcagttcctatgaagtgggcaagacatctgtgtcagtcatcttaagggtccttgccaagctttaaagagctgggtggacttggactgatccaaggcagggctgtggcagggagggcatgggagggggtgctacacctatagcccacgaggccagtcttgttgccagtcccatgccctcaacacctggctcctggctgggtacacactgggcagagagaacctgaggatgcagggcacctgccaggggtgttgtggatgacatcgctagagggcagtgtggctcaggttgaagccgtgttggtgggggctggggcagagagtgtacaaagcttggagaggcggggctggggatcccgaggaggcgggaaactgcaggagtccggtgggggccaaacaagaaagtgagccaggggtttaggaacttctggatctctcccttgttccttgtccccagtgcattttcaaagacaagagggagatacaaatatagtaaaaggcaaccataacgtattttaaaatgaatttcttagagattgacatacttaatttatactgtaatactgtaagatagacaatgtgcacatcccattttcctgaagagaaaatgttattaacatattagtttcaaaaaatatgtaaaactttagttaaaaaaaccaaaatactaaaaatcaaaaaaaaattgtaaaaaatgaaattctggaaagacgattaagatactcccagggcttagtgagtacccaaagtacttggttactaagtgccacgcacggccgggcgcggtggctcacgcctgtaatcccagcactttggaaggctgaggagggcgtatcacctgaggtcaggagttcgagaccagcccggccaacgtggtgaaatcccgcctctactaaaaatacaaaaattagcagggcgtggtggtgggcgcctgtaatcccagctacttgggaacccgaggcaggagcatcccttgaacccgggaggcggaggttgcagtgagccaagatagcgccattgcactccagcctgggcaacaggagcgaaactccgtctcaaaaaaaaaaagtcccacgcatttgctcccagcagccaaagcaaagaaagaggaacaatattgaaatgtgttttgagtctctatccatgaggtaaaagagcttttccagcgtggttgagcatgctcctatggacggcggaagagtcccggggctcggagcagtcaagggggaccccgaggaggggcaggagggcgcagcggagttgacggctgggactgcaggcctactggcccctgtcggctctgaccaacctggccgtgcgggtcacgtaggcctcgtcccactgcatgaaaacccctccctcctgggggccctgggctccctagcaaggaggtagcagaattcacgcgtgccgctgctcagggatgcagcgccagggcggagcccgtaggtggggcctatgcaaatcagcgcgggcaggttgggagagctgagtttgcgcatccggggcgggcctgcacaatccgggccttgaactggggcgggaccagtacaatccggagttgagcatgcgcattctcgatcctggcctgaagaactgggcccacttgttccaaaacgggcgggtaggtgagttgggcatgcgtggtcggaggccgggcccctttcagctggggcggagcctactcactctggggcgggacctgcgggaagatagacatgggctgtcgcggcttgaggaggggcggggcccaaggggcgggacctcgggtggcccgaggtggcccggctgctgggttggaagcggcgcagtccgactcatcccggccccgggatggcgtccccacgggaattgacacagaaccccctgaagaagatctggatgccatacagcaatgggcggcccgctctgcacgcttgccagcgcggtggtgaggcggggtcctctgggaggaggtgggaggtgcaccgggatgggtgggtagggcggcctgggcgggggtctcgcatggagaaggggcgggagacagatggggaaccggggacaggtgaggttgccgtgactggggaggctgctggggacaggtgaggcggtcgtgacagtggtgggccagagacaggtgtggcagagcagggggcggggacaggtgtgtgggggcatatcggcttggcggtggctaggtctggccaccatcacctcggggagggctctggccccctcgcttccctctccaatccccatcgcccccagtctggggaggaccctgtgggcaccccaggcccttccctctctcctggccaaggagtgtgggccgggttgttggactggaactgagctgtgtggccctaggtgaattacttggcctctctgagcccagaactttcaaaggtgggctagttttccaacaggaggaagggtgcctcttggccttaaagctgagcttgggcaggaacttcagcagagatgtgctcaggatagagacagaaaagtatgccgtgtgggcctgtgtctgtgtcccgggacatgtaagtatccacctggggtcatgggtgtacagtaaaactggagagtgaaacagctaggagaatgctgaaattcatggaattgttaaggggctcacctctcctagggtcccaggtgtttaaaccgcttccttgagtttctgcctgtccttaaatgagctggcagttttttttttttttaagagatgagtctcgctcagtggcccaagctggagcaagtgcagtggcgcgatcatagttcactgcagccacgaccttctgggctcaagcaatcctcccacctcaacctcccgattagctgggattataggtgcgccaccacacccagcttttttttttcttttttctttttttttgtagagacagggtcttgctatgttgtctgggctggtctccaactcatggcttcaagtggatcctctggcctcggccttccgaagtgttgagattacaggcgtgggtcctggcctgcaacttttttattaccaggaaaagaaagatttgttttaggagtaactgaaacattgtaatgaatttgcagcttgtccagcacctcagagaacatctagtttaacagacagtgaaatggagatcaggagattgagtgacatgcctgggtctccctgtgatcctgcctctgcttatgtatgataagcaaggggagagttctttgtgctcatcctgctgcagcagcctggagccatggctttgatcatgatatgagtcctgggggaagggtgtgtgtatttctggccacactgtgagtcctggcaggggaaggccatgtttctgaccagaccaagtcgtggtaactcatggctttgattgtgatgtaggtcctggtggggctgtgctgtctataatgcacactcagtcctgagggctatggccacccctcctttgagactcttctggaggcggggaggctgagccagtctgtgttattagggctgtgtggtcctgacttaggggggtggctgctattactacataggggaaaggagtgaggacctggacttttttttttttttttttttgagacggagtttcactcttgttgcccaggttgtagtgcagtggtcctatctcagctcactgcaacctctacctcctgggttcaagcaattctcctgcctcagccttccaagttgctgggattacaggtatgcgccaccatggccggctaattttgtatttttagtaggatggagtttcaccatgttggccaggctcgtcttgaattcgttatctctaatgatctgccccccttggcctcccaaagtgttgggattacaggcatgagctgccatgcctagccaagtctgtgagcctttaaggagtaggtcctcaataagcggaggcagggtattctgtcatcactaccattctttctttgcttctcactacgtctgagtcagggattgatgcatcagctccaagccaacccccgttacaggtgagaggaagctgaggcccaatgggaaggtctcatagctcctgaggcagggcttgtgtttctccaggctctaagtgtggaactgaaatgtggctctggcctgagctgaggggctcgtgccatcacggtgtctcagggtgttggggtaggctgggttctaggtccgcactttttcctggaggaggaggtagcacctgagaggccaaagatgagacctgcaggttgtttggggatttgggcctcagggttcacagcagggagtgggtaagcagtgaatgaacatggaacccgcccatgcagcacctccagctcccagtgcctgcatttgggcaacactttaccctttgcatagtagacttgtaggttgagtgactgcaaggacagtctggacccggagggtgtgggtggggatggaagcggatttggtcccagggctttgtggggaggaagaagcaggacccactgctggtctgtgctttgtactgggttttctctggagtctagtccccagctcctcagggcactaggggctggtggactgagggatgtactgcacctcctccactcccacaggcacgcccccacttgataaaatttaaagccacacctgagggcttgggaggcttttacctttcccatcattggcctccgagctcagacctggaggaactctgagggcaggtggggcaagagctgactcaggaaggactgcagaaaggacggtgtttgatggcttttctcagctgaaaggtggcaagactcttcctgggtaaggacatgactggtgtgtgcacagggcaacaggagagatgactttcagtcccctctgaaaagggcctccatggcacgttactttattttaaagagctcttccttccctagcctggcctaaggaggtgagagcagttgcagttcaggagtcaattctggcaccccctccagggacttgtggctgctccttgggtagaagtaatggaacatagacactgcccattgccaggcacgtctcaggccccttgggccccttcgctcctagagctcatggggcctgcagcgaatttacaggaaaggaacccatgagggaagttgggctgacatgtcttcacatttccttccgcacatgctcaatgttataaacagtgtgttcttttttttttttggagacagtcttgctttgtcccccaggctggagtgcagtggcacaatcttggctcactgcaacctctgcctcctgtgttaaagcaattctcctgtctcagcttcccgagtagctgggattacaggtgtgcaccaccacacccggctaatttttgtatttttagtagagacagggtttcaccatgttggccaagctggtctcgaactcctgacctcaggtgatctgcctgcctcggcctcccaaagtgctgggattacaggcatgtgccatcacgcccagctataaacagtgtattctaccatcctgtttgctcagtgtcagggtcctgtgggctcagagccacaggtgcagccgtgcacccagcccgcttagtccacgtgctctgtttcgagagctgcaatgtgttccctccttgttgtgcctcagttggcaatttcttatggctggaatttcccagtgttttgctatggtaagcagagctgttgtgatacacttgaactttggttttcttttgggtcatttccttgggagcttatcttggggagcagaggagataggtaatttattgccttgttttgcacccaggcctgatttgctgccctgcctgcccaccttgtgctgcgcatgtgggtggaaggcgggaagggaaatgccaccaaatgccatgggaggaggctggagctgtctctgggaaaataggagatgtggagagggggtgcagatccccagtcctgaggttttgggagtccctgaaggagcagttggggggtggccccatcagcgggagcagggtagatgcaggatttcctcctgcttagcagctgtcgcactgcccttggttgcttgagagcccggccacctggccgggaactatgcaaacaatgcacaatgcgggcctcagctgtccaccggccctgaggaggcaaggccttgcctaacttgttttcctctcaccttagctaatactgagagttctctgcaagtttctccactctcactcagtcagcctgtttcatggggtctcctccttcccgcccctgaggctcaccatttgggtcacctttaaacaaggggaatgcacaggagtgatggagcccccactggcaagcaaggccctttgtttctctgcagggcctgcctggggccaggccaccgcctccatgccctgagtcccaagggcagtcggtgccgaggtacacctatggctttagctcagtatccgccagggtaggacagagggcacagcttcccagaagtgcccaggctcttggatagcactaggcttctctgagggatgactgccccattttacagctggggacaccgaggctcagagttcccaatgagtgtcagactcaagatggcaacccaggcctgactcctgatcccctgcggaagtgcttctggggcctctgtgctctgagggaaacaacttgttggtggggacagtctgtctaggcaaccaggtgaaggcacttgcagaaccaagaagaggggcagtgacaggtccccacatctgttcatctgcctgtctgctatggttttacctgacccaggtcctaaggatgaggaaaaggaagcttcctgaggcttctgacgtgagaccgcgtttgatggcactggaaactgagctgagggctgggctcacgcctgtaatcccagcactttgggaggacgaggcaggcagatcacctgaggtcaggaattcgagaccagcctgactaacataatgaaatcctgtctctactgaaaatacaaaaattagccaggtgtggtggcatgtgcttgtaatcccagctacttgagaggctgaggcacgagaattgcttgagcccgggaggcagaggttgcagtgagctgggtaccagtgtcctccagcactccagcctgggcaagggcgacagagcgagactccctctcaaaaaaaaaaaaaaaaaaaaaaaaaaaaaaagaaggctggaggtgatggctcacacctgtaatcccagcactttgggaggcccaggcagtcggatcacctgaggtcaggagttttgagaccagcctgaccaacatgccgaaaccccgtctctactgaaaatacaaaaattagccaggtgtggtggcaggtgtctgtaatcctagatacttgggaggctgaggcaggagaatcgcttgaacctgggaggcagaggttgcagtgagccaagatcgcaccactgccctccagcctgggcaacagagtgagactccgtctcaaaaaaaaaaaaaaaaaaagaaaagtgagctaggtcccataagatgaagctggcagttctgctgccttggtatctgttctagccagctgggaatatagggggctgtattcagatccttccgtgcctctagcctggcatcttctctggctggcacactgacctgtggcacatggatggtggtgggtgggctatcagagggactgtccttgtgggcatcagtctgggtctctggtctcaaccccttgtggtccttaccctgagagacttctagatgcctccctccctgatcctgcccacagttcctgagcaccagcgctgtgccaggccccagggccctaaagggctcagataccacagggcttcttctgctgtaagtgatcagtctagagagaagagtgtcattagtgaggtgaccaggattgagggtgaggggtgttcccggtggccatggagatgccttggggaaaggactcattgaggaagtgactttttagctgggctttgtatgatgaaaagaagttcaccacagggagggcatgcagtggggctatgtgttctgggagcactgagtgatggatggggtgggagagatgtaaaaaggttagggtatggattcctggatgacagaggcagggtgttgattaccctgctgggttttggtcctgtccttcatgcggtggggacccccctagccatgtttagccagtggcaagttcggttgactttatgcctggtggtgcacatcaggatgaaaagggctggagagatcccactgtgtctgccagagcccaggcgggcctggggaagggggacatgccaacggtggcttgaaaccagcatctggggccactccaggagctgtgtggggatgctaggaagccaagaagatacgtctgatgccagtcccatgccctgaggctgagagaccacaggctgagagggaggggtgcgctgggagggtcccagccctcatctgacactgtgctgcttgccttttagtgtgcatgaccaactgcccaactctcattgtcatggtgggcctgcccgccaggggcaagacctacatctccaagaagctgactcgatacctgaactggattggtgtgcccactcggggtgaggcttggccccagctgtctaaggggagctttgtggggcatgacgaagagaatagagaaggcctattctctattatttggcctggggttgggtcaaggtcagggttggtaggggttgctgttgctgtgaaagctgagcctctccttccctccagagttcaatgttggccagtatcgccgggacgtggtcaagacctacaaatcttttgaattttttctccccgacaatgaagagggcctgaaaatcaggaagtaagtatatgtgttgggtgtggggggagaggttgctgggggacccagtgtggagaaagctaacacattactgaccatttactgagaagcccctggagtggagctgctggtgaatgactgagctactcctgagccctggccttgcccagccctgatggctgtgtgacagggctgtgtgacaaggctggtctctggatctctcaggatgtggtgggggtgggaggtgatgggtttggggatgagaggagagggtgtgttgtgtggcctcctggtggctgggccattcctgccctggggttaaggaacccttgggaaggacagagcttcagggaggtaagaggggctcagcccatgcaggtcgttggagctgctgcctggaggtcacgctcgctcaccccagcgccccgtggggatggctgctgctggggaagggaacctgagtgagtgcaggcatacaggccttagggatggagctgggggtggggggcttcctcccttgccccaggataagctctctcctgtgtatttggagcatgttcttggtgtgtgattgctggtgcgattggctttgcattgacatctcctagatgctgctgggtgagtcgttcacacttctgctgttactctggagatagaaatatgtatatgctaccgccccaccctcaacaactttcagacttgaactgagtcctttcttcaaggaactgagcaccagctggtggtctgagcagccatgctgtgcttttctcaggaggtgttagctgtggtcttgagaagccccttatcaacctagggtggcagagacttgctcttggcccagccatcaggatagggcagtgagcagaggttgacccagctctagtgacttccccaaatcaagcccagtggctaccaggctgccactggggtccacactaggctacccgttccttctctggccaccagggggcaggaactccctgctgtggggcttggaccttcagactggagactgcctttgttcttgcatcggtgtggctgggccaggctgtggcaccaagaagggaaggggagcctgatattcaggtttctatggccaaattgtgggtaaaaatcaaggctggaccctctggttatattgagccagataaaaagtagaggactaatgtctgaacctaccgtgtgctgggttcttgatgcccattgtcaccccctacttttacagatgaggaaactgaggctcagacaggccaggagtctcgcacaaaatagcaagtttacatcagcgcccagacttgaatctaagcccatccaccgctaaaaagtgtccatcattccaatattcctcaataggtaggtcaaggaacatcaaatgcaaattttatttatttattttaaaaattattattatttgtgtgtgtgtgtgatggagtctcactctgtcgcccaggctggaatgtagtagtgcaatctcagctgactgcaacctccgcctcccaggttcaagcaattcttctgcctcagccaacaaccccaagctgtggacgctgatagcctactgtctgatcttcccagcagcttctgtggtgggcggtgcctcacttttccagatgctgggaccaaggccagaaagtgatgggggtgccttgggtcactcagggtttgaatttgaagtccgtcctgcctgaatccatagtgtttgtggggagagtctgccagctgttccactctggctgtccccctaaggtagggatatttgggattaattcaaatgaagagacctagactcagagaggttgggaagctagtccaaggtcaccctgcaacagaagctggggacaggctcattgctgcctttctgcaggcataccctctggctgccctagaaaccctctctgctgtatccgaatcctggctctggctgggccacagggccatctcctattaatcagcccaaaatttcccaattagcaaaataaaaggaccagagtttttaaaatggaaaacctgggaagagacagctgcatttcccagaggcccagttactcacacagtgttgaggtccatctctgacactggacacagcagaagatctagaaaagtgcgtgcaaggccgggtgcagtgattcacgcctgtaatcccagcactttgggaggccgaggtgggtggatcacttgaggccaggagtttgagaccagcctggccaacatggcaaaaccccatctctactaaaattacaaaaattagccacatgtggtggggcgcctgtcatcccagctacatcaggaggctgaggcatgagaattgcttgaatctgggaggtggaggttgcaatgagccaagattgcgtctctgtgctccagcctgggtgacagagtaagactctgtctcaaaaacaaagtgtatgcaagggcataagtacacatattctaaacaggcacactcatactcctgcacacagtcctataccacacacaagccccctatgcacacacacacgtgggcacatgcatgcatgtgcatacctcataggcacacatccggacatgcgtataccatatgcacagggtacatacacatgcacaccccctgtgtacacagtcacgttatacataagggtatatgtacatgtgtgggcacctacacatataaatacttgggctcacttaagccacacgtaattcaagggccattacacacacgaaggcgcacatgttctcaccctgtatatacacacacacctgagcacgctcatacatggtgtgtagggggtccccaagactgccctcaggttcagtgatttgctagggtgactcccaggacttggcatatagctggactcatggctaagacttagtacggcaaaatgacacaaagcaaaatcagaaaaaggggcctggggtgaagtccagaggaaaccaggagcgagcatcaagattttctcctcatggagtcacacaggacgcacttaattcctcctgcattgaacattgacaacatgtgtaaaatgttgtctgccagggaaattcatcagagactcaacgaccaaggtttttactgggggctggtcatataggcaccctgtgcctagcatgtaccaaaattccagactcccagaaggaaagcagataatcaacataaaccatgttgtttgtataaacagtctatgcacagtgagctcctcttataattcagggaaagtttcatatcactagagggaactgtttaccatcaagttccccaaccccggccaagggccaacctcacaagcaggcctttcgaaggggaccattctcatacctgctgtgttaactcttccacacacatgcagtcacccactacacatgaaggtgggtgcacacacatatgcatacctcagagtcatgtgtgtgggcacatatacgcttgtgttcacctgtatgcacatgtggatctgtgcacatgtacacaccaagcatgatcgcatatgttctcacacagtcacatggcacatgaagacgtatacacacacaccatgtgtacacacatggtcacccccacatgcatactctgtatatgcttggacacacacacacaaacttatacacatgggtgcatgcacacacatcctgtgtgcacacatgtgggcacactcactcatacctgtgcccatttagtcacatactgcacacaggggttgtgcacgctcgtgtgtgtgcacctgtgctcatacatgggcccagggaatactcacacaggtacactcacagatttacatgtacacacttgggcacaacacacacataaccacccacacgtgtgtattcatgcacatatgcatctcttcaccccatttgcactctcttatacacacacacacacacgcacacacacaggctcccaggctcttccctcagcatctccaccggggccctgaggtctctcctgcatggtggtgtcatggccagagcagcccacaaaagagatcttagcccagaacgtggggctctaaggagaaatgtccctaccaatgccagttacctggactctcagaattcagatgtttttggcatgaggaagaaagcactttgaggctttaactggaagacccattggggcacagaaatggttacaagggctggacatagtagctcacatgtgtaatcccaatattttgggaggctgtggcgggaggatcactggaagctaggagttaaagaccagcctggggaacatagtgagaccctgtctcttaaaaaaaaaaaacaaaagaaagaaaagaaatgtcacaaggagccgtaagagtagagctcttttcagtgccctggactcagctctaccactgatttctttgtggttctcagatcagcttctgccgctgtatttcaggcatatcgtcctgatgagagccctttgactttgacatgctgggagtttaaacacaaaatccaaagatcaacaaagccaggagggctgggcactgtggctcaagcttgcaatcccagcacttgggaggctgaggagggtggatcacctgaggtcaggagttcaagacccacatggccaacatggtgaaatcccatctctactaaaaatacaaaaaattagctgggtgtggtggcacatgcctgtaatcccagctactcgagaggctgaggcaggataattgcttgaacccagaaggtggaggttgtagtgagctgagatcatgccactgcactccagcctgggcaacaaagtgagactctgtctcaaaaaacaaaaaacacaaagctaggagatctagctttacccttacatagaaaaagggaagataatagataaaaaggtaatttatctatctccagacctcataggataaattgatgagaataatcctggctgggtgcagtggctcgcgcctgtaatcccagcactttgggaggccaaagtgggcagatcacttgaagtcaggagttcgagaccagcctggctaacatggcgaaaccccatctctactgaaaatacaaaaattagccagatgtggtggcacgtgcccataatccctggtacttgggtggctgaggcacaagaattgcttgaacctgggaggcagaggttacagtgagctgagattgcaccactgcactccagcctgggcaacagagagtaagactcttgtctaaaaaaaaaacaaaccttctgtgtcaatccactttgcagcaataaatgaaaaagctgagaacttaaaaagattgtgtaagcctgggcaacatagcaagaccccatctctaaaagaaatttaaagattagccaggtgtggtggcatatccctgtagtttcagctactctggaggctgaggcaggaagattgcttgagcccaggagtttgggctgcagtgaggcatgatcccactgctgcactccagcctaggtggcagagcgagaccttatctcaaaaaaaaaaaaaaaaaaaaaaagatctgaaaactgtatagtcagtgttcggtcataggtgggggattcccattctggagggtatggatatgatagaagaagagatgcagaaccctccctcagaaggggtggtttggggaactctctttcaggaaagaaagttgagcactaagcctaacactgcccgagggccagccctagtgttcctcccatccccaccaccaactcctgacatgcacacaagaaaacggctgcttttaaaaatgcttattttgaaatataaaaattagctgggcgtggtggtgcacgcctgtaatcccagctactcagtaggctgaggcacgaaaattgcttgaaactgggtagaagttgcagtgagccgagatcgcaccactgcactccagcctgggtgacagagcgagactcagtctcaaaaaaaataaataaataaataaaaggcgggcgggggggggcttattttgataatcagggaaaatatatgacaattagaaatcatgaatgtggcacaatgacagcatggatttgtgcacaatgagaggatgagggaaaatacagaaacgtagtgcttaaaaaatgttcctaatagccaagagtgtatagccttccacctcacaggagcagagttagccaaacactgaacattatcctaaggaaagagaagggaaactttgaaaagagagcaagagacctcggggctgttccttctcctgtcatgtctcctcctgttgtgtgtccctggccaccctcctggagccagggtcgggtgctgggctgaccctgtgttttctctcctgaaggcagtgtgccctggcagccctccgtgacgtccggcggttccttagtgaggaggggggacatgtggcggtgagtgtgacaccctggtgacagctgggagtgacacatgggagcccatccacatctgtgcctttgctcgtcaggcatctggaggggaaggcagggtgtgtgtgccccagctgctctgggtgccagcccttgggaggaagtctgcaacagctatgcaggaggaagccagagactggatatgggccaggagtttccctctgggcatgtggtggccgcatttgaccctgcaggacttccctctggatgcttgtattcttggccaccccagaagttacaggtatcaggttgcctaagtctttagtaaatgtgatttctcctggtgtggggagaatcctgcccagcattactggttgttgtaggaacccactgaatcctggattaaggggattccacctgtgtgttggcccttctagtcagacggaagagcagaacagggctaaactggggtgtctgtgggaaacggctctaccccaaccttatatagtcaaacacaggggctgttctttcccttccttcttcttcctggagtcatgccttctggagttctctgtccccagctacaatctgtgcctgtagcacagccattgcccttctctctcctgggttgaatgttctgcctgtggatcccacatcatcctctctttgacttactgatttgtttcattgaagcacatcctccagtaacttcctgagaaaggtgcttggggaggtaaattgtgtgagaccttgcacatctgaaatgtctttttttaatcctcacatttgatggttgggtatagaatttctaggtggaaagtgcttttcccttagaacttctacaacatcactctgatgtcttatggcttctagtgtggctgtggagaagtctcatgtcattctgatttgctgatcttcctaaaagcttcatctcttagagggagctgagagtttctcatgccccttccgcttgggaggcctttagggtcttcaaggtgatgtggtttgtggtgggtcttctctccaccatacatggtcctagggggccccttttcatcataacactcttgttctccaggtcagggaaattgtcatgtattatttctttgacaaatcacctctgcccctttctggcaactcactccatccctactcccattttctgagctgctttttctagaacttctggtggctacatgctagcttgattctgagattctgattttatcttttttctcttaattttctttctttctttttttttttttttgagacggagtctcgctctgtcacccaggctggagtgcagtggcgtgatctcggctcactacaagctcctcctcctgggttcacgccactctcctgcctcagcgtcctgagtagctgggactacaagcccccgccactgtgcccggctaattttttgtatttttagtagagatggggtttcaccatggtctcgatctcctgacctcgtgatccgcctgcctctgcctcccacagtgctgggattacaggcgtgagccaccacgcccagcctttctctttattttctctgttttttttggttgtttgttttgagaaagacttcttcaacattatcttacaagtatatgagtgttgttgttttttatttccttgagacatggtcctgctctgttgcccaggctggagtgtagtgtctcaatcatagctcactgcagcctgtctcctaggcttaagtgatcctcacacctcagcctcctgagtagctgggactacaggcacgtgccaccatgcttggctaattcttgtatttttcacagagacagggtttcaccttgttgagcaggcttgtctcaagctcctggcctcaagcaatttgcctgccccagcctccgaaagtgttaggattacaggcataagccactgcacccggcccaaatttctttttttgtttgtttgtttgatttagtttctgtttttcttgttaaaggttttgctggagtgtccagtgagccctggctggatgccctttttaaaaaagtgatgctgggctgacatggtggctcatgcctgtaatcccagcactttgggagtctgaggcaggaggactgcttgagcccaagagtttgagaccagcttacatagcgagactctgtgtctacagaaaaatttttaaattagccaggtgtgggccaggtgcggtggctcacacctgtaatcccagcactttgggaggctgaggcgggtggatcacgaggtcaggagatcaagaccatcctggctaatatagtgaaactccatctctactaaaaaaatacaaaaaattagctgggcgttgtggcaggcgcttgtagtcccagctactcgggaggctgaggcaggggaatggcctgaacccaggaggcagatgggagactgaggcaggagaatggcgtgaacctgggagacagagcttgcagcgagctgagatcgcgccactgcactccagcctgggtgacagagcaagactccgtctcaaaaaaaaaaaaaaaattagccagatgtggttgggcacagtggctcacccctgtaatcccagcactttgggaggccaaggctggcagatcatgaggtcaggagttcgagaccagcctgcccaacatggtgaaacctcgtctctactaaaaatacaaaaattagccaggcgtggtggcacaagtagctgtaatcccagctactcaggaggctgaggcaggagaatcgcttgaacccagtaggcggaggttgcagtgagccgagatcacgccactgcactgcagcctgggcgacagagcaagactctgtctcaaaaaaaaaaaaaaattagccaggtatggtggtacatgcctgtaatcccagctacttgggaggctgaggcgaaagaataacttaagcccaggaggttgaggctgcagtgagctatgattgctccactacgctccagcctgggcgacagagtgagaccctgtctcaaaaaaattttttttaaataaaaacaaaaaaatgatgctgtaaccgaggtgtggtgcacacttgtagtcccagctactcaggaggctactcagaggatgcttgtgcaggccccaggtacttctcaaagagctccagatgggtcagtgcctggctggatggggttgggaagggggcctgggcctccagctcttctttatcagccagctagtcctcccatttcgtccccacctttgtcccttttcttagcaatgccactgcaccctctggagtgctctggtcctgcacaggtggtgtgctctggttggccagcacctgtgtttggtttcctacatgactctgagtccgtcaccgtggatctctctgacagaattgtgttgatgtctccatctcctgttgtctcctttttctcctgtcatctctttttctctttatccttctgttcccattttactggggtgtcaggatggagtagaaataaacataggttcagtttactaggtttaactggtttcactgcaattcctgttggtcaaacacaaactgagtgcccactgtgtgcagagcagcactgagtaggttcttctgtgccacgggtctgctcccctgctgggagcacaggcatcctctccttctaacttccttggggcattctctccaaggaaggggagggccagcccagccgttgcaagtctggaggagactggccaggcaggtggacctggcagcagctggtccttatgagaaatccagtccccagagagcctgtgctgcggccctcactgcccacttcagggcccactctggccccttccttccccagggccagaggctgagttaaccctagtttggtcctaggtttttgatgccacaaacaccacccgagaacggagagcgaccatctttaattttggagaacagaatggctacaaggtgaggcctccttggctcctctccttggcggaactgtggcatgtcccctgccctccagggctcctttcaccgcctgcttatgcatgaggggcatggggctggcatggctcctgagtgtaatttgggatgagaggggctgtctccacttggggtttgctttccagagggaagggggttttcgtgggagagtctaggagagggcagcacctgctttagctctggactccttgactccgcctccagccctctgaagcagggtttcagggcctggctgcttgtcagcatgggcctcaggggatggagagctccgaggagcaaggcgggaggccctgaacatgtccgtgttcctccctcccaccaccccggcgcttctggtcctgccgcagaccttttttgtcgagtccatctgtgtggatcctgaggtcatagctgccaacatcgtggtgagtagtgcatctgaccttgtcagaaggtcgtgtgtgacagggacatcccttttcaggttttggctaaccttaatttgatcttgaaccttgtgggggtagggaggaagtgtaacttcaaatgctgggtcaggtatgcctcgccctctgtggatcactgtggaaggctgggtggctggtggacattcactcaccccacctccccctcgtaaccacctggacactaggagagcaccttcagcaggggtggaagggtgggtgaggggcatgttttatatttcagagaaagaaagactcattctttccttcccctcccccagtttatctgaggaatgggcatctgggtctgggaaaatgagagttcagggtggggaacggcctccaggcctccccctgtaccacaaggatgagggacttcaatccctggaccctcagtgataccctcttggcactggtgtgagaactcagaccagggagctgctggaccagcccccacctcagcttccagcctcaggttcccgcactggtctccggtgcaacctcctccagccccctgcccagcagtctccttggtctctggccccgcctggctcctgaccctgatatgtcctttctctgtgcctggctccggcagcaagtgaaactgggcagccctgactatgtcaaccgcgacagtgatgaggctacggaggacttcatgaggcgcattgagtgctatgagaactcctacgagtcgctagatgaggacctggataggtgagtcagggcagcgccaggccctgcagctgtgatggtgggcggcaggggtcatacttggctgcctcctatggctccccatggtggtggctggaggaccaaaaagcagagatggtctgacctttcttgtttatttccttggggcagaaatgtttggtcagaggtgacttgcagaacaccggttacctcatccaaaactctgcgagtcaggattttatactattccatcatgaaatcaagccgaatttctatgcaaggggtcttaaagcaggggttggcaaatattttctgtcaaagatcagagagtaaatattttatttagaccttggaggatgtacagtctctgttgcaggcactcactctgctgtcacagtacaaatgaaacatagatgatatgtaaatcaatgggcatagctgtgttccagtaaaacttgataaaaacagcccacggctgagttcgactggctggccacagtttaccaaatcctgtcttacagaacacatggggcagtggctgggtaaataataatgtagcccttggtgaagtattacagtcatcattacaactcgtcattgtggagagacatgggaaaatataatattgcattcagtgaaaaggctggaatacaaacttgtgcttaggttctgtaattctataagattgtgtaatacgggccgggcagagtggcttatgcctgtaatcctagcactttgggaggctgaggcgggaggattgcatgagcctaggattttgagaccagcctgggcaacatggtgaaaccccgtctctacaaaaaatacaaaaattagcctggtgtggtggcgcatggctgtagtcccagctactcgggaggctgaggtgggagaatcacctaagcccagggaggtcaaggctgtagtgagttgcagttgcaccactgcattccagcctgggtgacagagtgagaccctgtctcaaaaaaaaaaaaaaaaaaaaaaaaaggatgcacatgaaccaagaaacacaagcaactctgagatgaatgcttttggggtgtgcatagagcagggtcctcagctgggttctagagccagcccaggccgggcctgagctgaatggcacctgccacctgggcctctctatggctttcatggtcccccagcacagcatttctcttcatggttctgtgatgtgatccatttgtctggagcagcttctgttggatttgtcagtaagcgttgctcttgcttttattggtggtgtcatcgtgacacccccaaaccaaggtcccaaggtccagacagtgagagctcaactgagaatatccagaggactctcagcctgaaccagagcccaccctgcacccccacacccagagactgatcaatgtgctgtccaagctgcagtgccacataggtccagagtagggaaagtggctgagctggacttatcggctgccaccaccagcaccatcctcctgtgcttcctgtctcatccaccagctgcccaggatggggtgtggcagctgctcagcacacttggatgaccaggactgggctctagtgggaggaggtcactggggaaggaaaggccaggtccttgtacagctgaccaggaagagtgagggcgtggagcgtttgccagctactcccaagtcaacaaccctcgggaaaactgtctcttggttcaacttacagacagtgtattgagagtgcggagataggccaacaggggccccagggacacatgagcagcggagaaagtcatgatgtggtatggcggaccccccactttggatgtcacctttgggaagcatgatgagtgacgagcacctcccatctcccgtctcccacagggtttgcctgtgcgtcacacgcactgtgttgctcccgcctcacccccatcactcgcacaccagctgacggtcctgagggttgtaatctctggtggttggaagtgcaaggcctcgcagctagattccgtggctagccagatgtgctctgtgagaaccctggccacgctcacaggcctctttctactttctctctggacagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggaggtcagtgcatgtgtccctgcgtgcgcacacgggcctgcatttgtaccctgcgtggctgggtatatgcatgtgtgagtgcgctggggctaggctcccattcttttaatgtgcagtcgaggtgaatgaccttcattcaacctagaatcttcccatcatgtagggaaggtcatcaagcaacaggcaaatgcctggatctctggtttccatgtgagctgtcactcactgagccccttttgtcagaggcatgccacccttagagcgacctgagtccatacagtgtagcagatagctgtgccacagtccaggggagacctcagtggtcacgtagcacagggcacctggttgtggggaggcagtggccctgatgagtctcagctataactgtgctgctgtgctcagggtctgggagggtgcacaggaacagcacttgtgttcttgtgtgtcagcatgtgtgtcatcgacaagttagttcatgctttttaccaaacctgtagtgagtgttcaaggcgagggtgatctcatggaccctgcggctatgggatgctttaagggcagcccaagacctgtgggtctgagtttgcttatgatgtatttcagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcggtagttaccgtccctccctccctgtctacctcccagataccgcagggctgctgcatcatattgtaacaacagtgaccattgctccccttgggcaaaggagaggagagagaaaggatacaggaacctaggggctgggagcagagaggaaaaggcagcctaacaggatgggaccttgggtgagccctagaccattctcaggagtgagcctgggagttgacacctcaacctcactctcctccctccctgtggcctcctgctagggttcctcatggtctagctcaacaagaaatcagcggccacgggagcttggtagctgcagtcagccatagccaacctcccagggatctggagacacaaatgaggtgaaccagcacggcctttgtctctttaaagatgctgttctcgccaggtgcggtggctcacccttgtaatcccagcactttgggaggctgaggcgggcggatcacctcaagtcaggagtttgagtccagcctggccaacatggtgaaaccccatctctactgaaaatacaaaaattagccaggcatggtggtgggtacctgtaatcccacgtactcgggaggctgaggcaggagaattgcttgaacccaggagacagaggttgcagtgggctgagattgtgccactgcactccagcctgggcaacagagtgatgttctgtctcaaaaaaaaaaaaatgctcttctgctgacttctgggttgcattgtttctaagagaagtctgttgtcattctcatctttgctcttctggatataatgttacctcctttttctctgactgcctttaatattttcttttcttcttttttttttttttttcaagacaagatcttactctgtcacccaagctggagtgctgtggtgcaatcatagctcactgtagcctcaacttcctgggctcaagccatcctcccatctcaacctcctgactagctgggactacaggcacttgccaccatgccaggctaatcttttctaatttttgtagagacggagtctcatgatgttgcctaggctggaatattttctctttattgctgatttttagcaatttgattatgatgtatctcagtatggttttctttatgtttatcatccttggggtttattgagattctcggatttctgggtttctaaatataaaatgtgaagaattgttggccatcatttcttcaaaggtattttctgccaccccttctcccatcctggactcccactctgtgtgtgttagactgtttggtatcatcccacaggtcactgaacttctggttttttaatttcttctgttcatttcttctctgtctttttttccttccgagctttaatttagatagtttctactgctatgtcttcaaattcacttatctttacttctgcatttttattaaacccatccagtgaacttttcatatcagatgtggtgttttgaagctccaggaatttcattttgttccttttttgaatcttccattatttcttcattatgcttggctctgcagtccaggaagtgcctctgggcagtaagctgctgcctcctcccctcagcttgcttcccttctctcaaggatcacagtcctgcctagtctcgtgtctaaaaacagttgtttgatttgtccctttatttatttatttttttgagacggaggtttgctcctgttgtccaggctggagtgcaatggcacgatctcggctcactgccaccttcgtctcccgggttcaagcgattcttgtgcctcagcctccagagtagctgggattataggcacccgccaccacaccaactaatttttgtatttttagtagagacagggtttcaccacgttggccaggctggtcttgaattcctgacctcaggcaatccacccacctcaacctcccaaagttctaggattacaggtgtcagccacagcgccctgccaatttgtccttttttaataatagttgtttttgttggggccagagcaaatctggtaccagttgctccatcatggcttggtctttattatgggtggttcccatttcaatatgaaaagctttttctgtggatatatactttgactaatttgaatattaccacccctgcttttgtttttccatttttttttactgtggtaaaatatgcataacataaaatttaccatcatagctgttttgaagtgtacgtttcaggagtatgaagtacatttacattgttatgcaactctcaccaccatgcatctccagaactcttttaatcttgtaaaacagaaactctgtacccactgaacaataactcaagccagatgtgctggctcacacctatagtcccaggtacttgggaggctgaggtgggaggattgcttgagcccatgagtttgaggctgtggtgtgctatgatttcattcacgattggcccttgcactccagcctggacaacatagtgagaccccatctctaaaaaaattttaaaaagaaaaacaataactctatttgctactcccagcccctggcaaccactttctgtctttatgactttgactactttatatacctcatataagtgaaatcatatagtatttgtctttttgtaactggttactttagttagcataatatcctcaaggttcatccatgttgtagcttgtgcaagagtttccttcctgtttattttttaagacagcatctcactctgtcacccaggctacagtgcaatgtggaaatcactgcagcctcaaactcctagactcaacgattctcttgcctccctagtagctgggactaacaagtgcacaccaccatgcctagataatttttttattttttgtagagaagggaggctcactatattgcccaggttggtctcaaactcctagcctcaagcgattctaccactttggcctctcaaagtgctaggattacaaatgtgaaccatcacacccagccttaagaattttcttcctttctaaggcagaataagattctattgtataccacatttcgtgtatccattcatctgccaatggacacttggacagcttccactttttagctattgtggataatgcagctgtgaacatggatacaaatgtctctttgagaccctgctctcaattcaattctttttggtatagacctagaagtggaattgccagatcctatggtaattctgtttttattatttatttatttatttatttattttgaaacggaatctcgctctgtcgcccaggctggagggcagtggcatgatctcagctcactgcaacctccacctccctggttcaagcaattcccctgcctcagcctcctgagtagctgggattacaggcccacaccacgatgcctagctaattttttttgtatttttagtagagacagggtttcaccatgttggccagactggtctcaaactcccaacctcaggcaatccacccgcctcggcctcccagagtgctgggattacaggcgtgagccaccgcacccggcctctgtttttatttttttgaggaactgctgtactgtttcccatagcagctgcatcattttacatttctaccagaagtacacacaggttccaatttctccacatccttgtcaacacttgttgttttcttttcttttctttttttaatagtagccatcctaatgggtgtggtattgcatcttggttttgatttgttattcctgctttctgtccatatattttttcttttttttaagtgacagggtcttgctctgttgtcctggctggagtgcaatggcaccatcatggctcactgcagccttgacctcccaggttcaagtaatcctcccatcttagcctcccgagtagctaggactacaggcacacatcaccatacccagctaaatttaaaaaaaaaatttttttttggccgggtgcggtggctcatgcctgtaatccaagcactttgggaggccaaggtgggcagatcacctgaggtcaggagttggagacctgggaggcggaggttgtggtgagctgagatcacgccactgcactccagcctgggtaacaagagcaaaactccctctcaaaattaaaaaaaaaaaaaaaaaatttctgcttcccgggttcaagtgattctcttgcctcagcctcccgagtagctgggattacaggaatgagccaccaagcccagctaattttgtatttttagtagagacggagtttctccatgttggtcaggctggtcttgaactcctgacctcaggtgatcccacctcggcctcccaaattgctggtattacagtcatgagccactgcccctgtcctaaatttaaaaaatttttagagatgtggtcttgctgtgttgcccagggtggtcttgaactcctgggttcgagtgatctccttccttggcctcccaaagtgctgggattacaggcatgaaccaccatgcccaacctgtccatatttttttattatattttttcccttttatttttaacatttttgtatcattttctttagaataaagagcataggccaggcgcagtggctcatgcctgcaatcccagcactttgggagactgaggtgggtggatcacttgacatcaggagtttgagaccagcctgtccaagatggtgaaaccctgtctgtactaaaaatgtaaaaagtagctgagcgtggtggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgcttgaacccaggaggaggaggttgcagtgagccaagatatgtcactacactccagcctgggtgacagagcaagactctgtctcaaaaacaaaagaaaagaaaagaaaacaaaacaaaacaaaagcatatacttgctttgagttttagcctagcccaagagcttttttcatcaaggcatctgcaaccacttaggtttattattatcattactggtatgtttgatcttgttttcaataccttggaattttctctttattccaatttttctgtgtagatatgatcttttttgttatttgaaaggtaggcaatgtttttattccaatagtctttaccttaaagcttttcaaagacattctcaggctggatgcacataattgaaatatacttaacaaagctcatactgtcacaggaaaataatttttgaccttctgttgggaaagatgatgttgtattattgccattcatttcctttttgctctgttttttcgatgtaattgggcagagtacagcatcatggttttattttattttatttttatttatttatttattttttgagaccaaatctcactctgtttcccaggctggagtgtagtggtgcaatctcagctcactgtaacctctacctcccgggtttaagtgattctcgtgcctcagcctcccgagtagctgggactacagttgtgagacaccatgcctggctaatttttgtatttttagtagagacagggtttcaccatgttggccaggctggtcttgaactcttgacctcaggtgatccacccgccttggcctcccaaagtgctgggattacaggtatgagccactatgcctggcctattttattttatttttgaaacagggtctggctctgtcacccaggctggagcgcagtagcaccatctcagctcactgcaacctccgcctcctggactcaagccatcttcccacctcagcctcctgagtagctgggaccacaggtgtgcaacactacgcctggctaatttttgtattttctgtaaagatggggcttcaccatattgcccaggctggtttcaaactcctgaactcaagttgtggttttattttttatctattctttctcttcagaattgataatctctttcaaaaaagtaagcaatttttataactcattttgtagctcatttaacccattttgtgcttggtgggggttatccagccactgatttctttctcacacaaacagcagctacctgaggcaggttataggacagtgtcttccctccaaatatatagatttgatgctaacattcagttttgcagagaagcctgcagccaccccagtttttttcctttgaagttaatctgattattttccaagatgcttgtggatttccttcatctttcaagttttgaaactattacagtttttatgatccattaatcatctttccatgtttatcttctgataaacagccttgagcttgtcttctattccaacattatgactttttcttagtttaatccacaatttattgccttatagttcctttaaaaaaatgatagctttattgagatataattcatataccatagaattcacccatttaaaatatacagttcaggccatttgtggtggcgcacacctgtaatcccagctactcggggggctgaggcaggagaatcacttgaacccaggaggtggaggttgcagtgagctgagatcgtgccattacactccagccttggagacaaggcgagactcagtctctaaaaaaataaataaataaataaataaataaataagtatacagttcagtggtttttagtgtgttcagagttgtgcaaccatcaccacaatcagttttagaacatttcatcaccccagatagaaatcctgtgcccatcaacagtcacttcccatttccctctaacccttccttctgccttaagctaccactaatgttttcaaggtttattcgtgtagcatgtagcagtatttcattcctttacattgccaaataacatcctattatataaatataccacacattatgtatccattcatcagttgatgggcatttgagttgttgccacttttgggctatgtggataatgctgctgtgaacattcatgtccaaggtgttttctatgtttgtttgtttgagacagggtcttgctttgttgcccaggctgagtgcagtagcacgatcttagctcactgcagcctccatctcctgggctcaagcaatcctcccacctctgtctcccaagtagctgggactacaggaactcgccaccacacccagctaatttttgtatttgtttgtagagatggggtttcatcatgttgcccaggctggtctcaaactcctgggctcaagagatctacctgccttggcctcccaaagtgctgggattacagacatgagccaccgcatccggcataagtttttgtgcggacttatatttttatttctcctcactgtacgctaggagtagaattgctgggtcatatggtaattatacattcaaccttttcagaaactgccacactgtttcgccatctcacattccctcccgcagtgtgtgagggctctgatttctccacatacccgcctgcgcttgttaccatcagtcttggttgtagccgtccaacatgggaactcagtttagccacattctctgccactttataacatggattaccttttctctagggtccaggaaaaggtacctcatttccccttgtgggctcacagaggcacctttaatgttcatatttctatcaacgttcttttcatgatgatatatgtgctctttacgatggtggaagctggccgggcgtagtggctcatgactgtaatcccagcactttgggaggccgagatgggcagatcacatgaggccaggagttcgagaccagcctggtcaacatggcgaaaccccgtctctactaaaaatacaaaaaattagccagccatggtggcctgtgcctgtaatcccagctactcaggaggctgaggcaggagaattgtttaaacatgggaggcagaggttgcagtgagctgagattgcaccactgcactccagcctgggcaacagagtgagaccctgtctcaaaaaaaaaaaaaaaaaaaaagatgatggacgctttctctgtcatcctcttcacttccttctgtgccttcaccagaataatctttaatgtctaaatttctactaacagtctcttcaagacagtctaagctttttatcatgcaccacaaaattcttccagcctctacccactatcccatttcataaccacttccacatttttagttctttattacagcagccagcagcacttcacctcctggtaccaaaatatgtgttagtattcaagtgtggtggcgcacacctgtagtcccagctacttgggaggctgaggtgggaggatcacctgagcctgggaagtttgaggctgcagtgagccaagatcacaccactggactccagcctgtgtgacagagtaagactgtctcaaaaaaaaaaaaaaaaccactaaatgttaaaaaaaaaaaaagtattagtttactagggctgccgtaacaaagcactacaggtgagtggcttaaaacaacatgaattgattctctcacagttctggaggctagaagtctgaaatcaaggcgtcagcggggccatgctccctctgaaggtgctaataaagaacgcttcctcacctcttcctagtttccagttgttgccggtaatccttggtatttcttggctcatagcctcatcactccaatcccacctctgtccacggtcatcacatggctttcttccctatgtatgtctgtctgtgccttcacatgacattctttttttttttttttttgagatggagtctcgctctgtcacccaggctggagtgcagtggcatgatctcagctccctgcaatctctgcctcccgggttcaagagattcttctgcctcagcctcccaagtagctgggactacaggcgtgagccaccacgcctggctaatttttgtatttttttagtagagacggggtttcaccatattggccaggctggtctcaaactcctgacctcatgatccacctgcctcagcctcccaaagtgctgggattacaggcatgagccactgtgcccggcctacatggcgttcttaaaaggacaccaatgactggatttaggacccactctaatccaatatgtccccatctttttttttttttttttgagacagagtctcattctcttccccaggctggagtgcagtggcgtaatcttggctcactgcaatctccaccttttgggtacatgcgattctcctgcttcagcctcctgagtagctgggactacaggcgtgcgccaccacgcccaactaatttttgtatttttagtagagacggggattcatcatgttgaccatgctggccttgaactcctgatctcaggtgatccacctgcctcagcctcccaaagtgctgggattacaggctgtgagctgtgagccaccacgcccagccaacttttctttttttttcttttcttttgagagggagtctctctctgttgcccaggctggagtgcagtggcacaatctcagcccactgcaaccactgcctcctccaccatgttggccaggctggtcttgaactcctgacctcaagtgatccgcctgcctcagcctcccaaagtgctgggattacaggcgtgagccatcgcgcccagccagctttttttttttaatggcatttgtagaagatgatctatgctctgtgtgtgtgtgtgtatcccaaataacacaagtgaagttttccttcatagtttgcataacaacctacactcacaagtactatttccacagcacagaaaagaaaaaacacatagcatctctgtgtgtattggatgggtgatggataggtggacaagaccatcctggtagctttttacaagcaaggaaccaccaatgatcagtgttcctagaggtcctcccctccttagacaggtttctgttcccttcacccaggaaatgcccgtgaacttggtctcttctgcttgatgctgcctcaccccacatgtccccaaggctcatcttctgggcctgtaggaggtgtgatgactgtggtatctccctagggcgtctgtgaggaaatgacctacgaggaaattcaggataattatccactggagttcgccctgcgggaccaggacaagtaccggtaccggtaccctaaaggggaggtaggtgggatttggggcttagtcccagccacctactgcccgcctgggagtaccacctgtggctgagggcctgtggggctctgcaggggctgcgtgggtagcagaaggggcctggtctcagaggcctgccagcctgggtgtgtggttcatctccaccccttcccagctatgcagcccaggccttagtcccttcctcaggtgtggagtgggcagtgccatgtagggcaggccttcaacctggagacctttggctccctgctctccattcttgtctttccccttcccaggggtggagaattcggaagggcagggcctgaggtgggggatctgcggagttaggctttcctgggacccctgtagacagtgtgcggtcccctggcattcccaggccagctcctttcccagcgagttgtcagccctttccggggcgctcaaatggctggggagttggggagaccatggcaggcctgggactcgggtctcagctcactcgagtccctgtctcgggcctcatccttcctttggatgcttcctcttgtcacaggctgagcccatcctgtccttcctgtggctccaggcaccacccccagccctggcaccagacccagggagaccttccacacatgagttggctaccacaagccactgcacttgtcaccttctctgacacagttcagcccaggccccaggtcagaaactgagggtcacctttgactgaggcatctccttccacttccaggaggtggcctggggcaggggccaaataaaaatacaccccgtcaacacacatatgtacacatatatatacacatgtagaagcacctccacccagaagccaggctgacaggtctctacactgtaccatcctcaggatagtatagctcttgggaacattaattattccccacattatgttaggccaagttcagatttagaaccaacccagataacggtcaggagaaacaaagcagctggctgctcaaacatgagaatacagtgaggagaattggttgagaaattcatgttaccaaaagaaccggtctaggattttctcagaactaccaggaactggcacaaatcagcgtgtcatttttgcttcctaatcaaagcttggggcacgttcagttctgactgctggaggccatttttgaaggaccactcattgtgtgcagaaggatgaaactgatgaaaatctctaaacctgccaggttgagaggcccagcaggggcctaaaccgtacatcacggcaggcatagggggaagatactgggcaggtagactgaggatagttcctggggaccccagctgtttctgatgagtcacactccagaaagttccaggtctttgctctcttccccttcgctcttgtcagtgcactctgtttgctgtgggctggaagcaggcgaggtcttctccaccagtcacatgaattctatagctgaggattcagtgcagagccccatgggtgggcactgaggtggaccctgggatggagcctgaggcctagctctgcgctctcaatcctaccaggacctagccctgaggtgggaaaggtggcccctttcctcagctgcccacccccatggcctcagaaggctaggctggaggaggcccagccacagcttcccagaatggtgagtagctgcaggagtggaaggtggcccagtgtccaggatgtgtctgtccctcccccggagccaggcctgagggacccctctctgcttgcccttgcagtcctacgaggacctggtccagagactggagcctgtcatcatggagctggagaggcaagagaatgtgctggtcatctgccaccaggctgtgatgcgctgcctgctggcctacttcctcgacaaggcagcaggtgtgggctgtgccccgggggaggtgggaaggttgtgtgagaaggtaggcactgtcaccaggcatttctggtgtgctagccatccccctctgtgtctacagaacagctgccctacctcaagtgtccgctgcacacagtcctgaagctgactcctgtggcatatggtaaggaagcttcctgcacattgaccatgggtagccatgaccttggatctctgcacagttccatgattttctccgaattccttgaaaattgtgttaggagcccattcctccacctactaccccaccacctttcccaatttgctttttttctttgagacggagtctcgctttgtcacccaggctggagtgcaatggcgtgatctaggctcactacaacctccacctcccgggttcagatgattctcttgcctctgcctcccgagtagctaggattacaggcgcctgccaccatgcccagctaatttttgtatttttagtagagacagagtgtcaccatgttgtcaggctggtctcgaactcctgaccttaggtgatctacctgcctcggcctcccaaagtgctgggattacaggcgtgagctaccatcatgagctaccatctgcggccctaatttgcttttaaaaagtttgttctggggctgggtgcggtggctcatgcctgtaatcccagcactttgggaggccgaggtgggtggatcacgaggtcaagagatagagaccctcctggctaacatggtgaaaccccatctctactaaaaatacaaaaaaattagctgggcgtagtggcgggcacctgtagtcccagctacttgggaggctgaggcaggagaatggcatgaacccgggaggcggaacttgcagtgagccgagatcgcaccactgcactccagcctgggcgacagagcgagaccctgtctcaaaaaaaaaaaaaaagtttgttgtgaaaaagtttatgtggccacagaagacctccccagtgactttgcttaaccattgcctacctgcatgaggggcttttctactgatttttctgaacccccacaaggccccttggtcctcagggcctggactttattctgggtgcagggcagtgtgagtccccaccctgcctcttgctataccagcagagacttcaggcaacttcttcatctctcaggtcttagctcttcacctttaacacaggtgctcttgggggaatggctgtgaagcccagtggcagctgatgtcactccagtgtgtgacaatggcctcatcccccattgcactgtgcacctggcacacggttgactgggccttatatggtagagttggaatgtgggtggtttgggggccctgaagactttgagagtcagtaacctcaacttaggcctgctgttcccccgatccctctcggtcctggggttggggagcctggggcctctgtgtggccctgtctgggccgtcacatagatatgcgtgggtctgacagcgtgtctcatccttcctcccggggctccccagagctgcctaaagtggaagaactagagtgaggctgagatggctgctccattccacacgcccagacccccctccaagagaagtttctagcatctgcagctcagctgcctttcaggagtggggatggatttgcatcttccctttggcaggttgtaaagtggagtccatattcctgaacgtggctgctgtgaacacgcaccgggacaggcctcaggtagcaatggggtcactgctggggtagcggggtgttcctgatgtgggggtgtccagactgcacatcctccagggccaggcccagctgcggcacctgccagagggagcttgagtcttctgccaagactgttgtcccatcagcagggcggggccctggctctgggtggggcctgcatcaggccttcccaaggcacctgccctggggatggggaaatccctgactctgggccaccaggctcaggagtgcctgaacttgggtgtggttggagccccaggacttgaggagccacagggctcccaagcagcaacttggaggtctaagtcaagggggcccttgggctcagtgagaatgaggctggaggctaagaatgaggcttctggccttctgagggcaggtgggcactcttcccactccccatccctgcagccgaggcctcatgagcccctttcctaaccccagcacctttaaaaattaaaatgggatcatgtacttttggggaaagggccatgcagatactgaaggggcctcagcatggggtggagaccttggtccagaaaagcagtcaccacctgtgctccccaagtgccttgtggaaggtagaagctcctcagagtgtagctcagaaccactcttagtcccatgtggggtccctccacaatgttggctccctctcccactggggccaaggataggacctacacttctgggagccccggtcccagttcctggaggccactgcacggagaaggctcttgggcctcagtcatgcctcttgccatccatgatggggcctgcttgggctctgggtccctgctgaggatgcacgtcttgggctggaccaggacatctggccttggacctcacagcacaggtgtgtagatgtgtcctgtcccttcccaacaccactgcccccaagcaggaccagttaccctgcaggcctctcttcccattgctctgatagttcgtgcatgtcttggccaagttcagcccaggcccaatttggtacccacaagtcacaggggaacgtacctcccaacgggcatcctttgggccaaggaaggcccagatggcactgggcccccagcgctgacagagtgatggtaagagaggcccctgggttggcagggtgatggtaagagaggtccctgggcctggcagcccttgggagctgaccctaccagtccatcaccatagtgtggctggcggtcattctgcccactatgggtgggtgcttctgagaggcaaaccgctactaaccccaggttcctggatggctcccttctggcccatccattggggcaggctgtggtggaaaaggggcgcctcaggaagcctgcccagcagtaagaattatacctgcccctacaattccaggggccggtcctatgagcccaggctgtgggccatgggggccatgtctctctccctgaagatctgggcatgtcatgttgcatggggcagcagctcaggtcatcagtgacctgctcctgcaggtgatggttccggggcccacagctgggaggaggggccaccaggctctggggcacataagacagcctcagagagctaagggaagtttcagattccctattcctcaggcctgagactccctgagcccgacaggccaaggatgggactgagctctgcagtttggtggggtccttctatagctgagggcttcaggaggccctgtaccccagttctgaggggacagaccaggctgcagaccaggaaatgcccataggcttctggggcacctctgacacctgcgtgccaacactttaaactaggaaggaggcacccccaggagttgaaccccttccctgccccacagatgaggataaaatccccaagccaggggttcctcctcaattgactcagccctgagataggaggtgggagtggccttgctttgggtattgcctgacctggctgcagtggagcaggaaacgaggtggcatcctccaccgcacctttgttctattgtccatccacccgctatgtggcacgaagctcttggccatgtattcttagggaagcttgtggtctagagtcttgcggctgtggctgctacagtgagaatgtgaagcctgatgaaccacagtgatgaggacggcagacagcaggcatctcatctattcctgccatggagtgaacgctctgtgtttttattgtacagaacgtggacatctcaagacctccagaggaagcccttgtcacggtgcctgctcaccagtgaccatgttcatccactgtgaccactaggcaggcactgctctctgcagagggggtcattccaggccctccagtgtgtgtgatagtcaccatgccatgcagggatattcttgaagccacacatggctggcggaacccagagcccccaccccagcccacctggctctttgttgacagtcggcgacaaggttgtgcgtggctcctgacctgctgctaagagtcacttgaccagactgcatctgcatgggctgcgcggaggttgcccagccccagtttcttccggcgcagctcttaggtgttcactctcgccagctcagttggctttgtgaagtgtgaaaccctacaatgtgaaaggaaagtgcttgctgtgatgttcctactgtggcccagctgcccagcatggacctggtgactctccacagggcctctaccatcctctctgtggccacttcctgagccagaggccaggtcttcatggggccctgagcttctgctgcctctggtgagagggagagcccttcccatccttacccaccaggaactagagccccaaccacagcagatgcttcctgggcagccactggccaggccgttgtatccatgtcacccttagttgtgggcattcatgaaagcaatgcgcttgcttcagcacattgggatgcacagaaacgtgagggcaggggggcagttgtggtcgcccctccccagttgtgcatgtacccggctacttaggtatgcttaggggagctggtggccaggggtgccccttcaggcctgctctcacagtgaaaccacttcaagacagggcaggaagttaccttcctggtgcacacaccgaagtgctcgagggagaggctgccgccccctctccccttccctggctgtggacactggcagccaatggggaggcggcctctcccctgttgctgcccgtgtccacacaggaatgtactctggtggcagaaacatgcatttgccataaataattcagaaacacttgtatggtcctgtaaaacttctctggtgtttgttgacttctgcctgtgggtctgaggaagggagaaggcagaacccataggcagtccctgggcaagggaggattttcccggccgcagcacagccttccattcatgtgcacgtgagtctggtgaaaatggccttgtgaagtccagtgtctgtcatgcccctgagttcttttggtcccagagaggcagcctgggcagtctgtttacagctggcaaacagactggctggcaagttgtggggctgggtcagaaagtgtctggacttgtaatcgggtgccctgctgtccacaggtggactctggggaagccaggcccctggatcccaagtcctttgtgtccggagcctttcctggcctgtgcctggagggtagcacatctttccagcctcccagggctttgcagcctgcagatgccacctgtccctgagagaagttagcgtccctggccctggccggtggtctctcatccttgtgtgctgctctgctaagagatgtccaaggcggagctggggcaagatccttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaaccccccggcctctgccctggcatggtctccgcatgggctgaggtgtagctgattggctgccacatttcggccatgctggctggcgtgcccatgttgcagatattttcccgagttccccagaatggatggtattgaatctcagccacatgcaacactgtgtccagcattctttgcaataaatactttttaaaaaataatctcaggttgtatttggtagccagttctccatttgtgaagtgttttttttctggcctgctctgtcgacacctggtgctgtggtcttcctcgcaggtctgtgttgggatccttcgttcagcttccacccccatgttcactctcactgaagaggaattatgctgccctggagtgagtcctggcctggcatacatgggcaggcggcctgggtcttccctgggctgacctggggtatggggcccttggccctgaacatgaggcagatgtggagggggcagtgcagctggagtggagcactgttaagggaaggattctggggtccctgggaatgtgggctccaaatgcggcattcttggggaggaggccccgggagctgggtcaaggatgtagtggctgcgtgaggctgtggtgacagtatgctgaccagtgttttggtat

SEQ ID NO: 16694 - DNA, 43577 bp, Human
  misc_feature (1)...(43577): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggttcaagcgattctcctacctcagcctcctgaggagctgggattacaggcacgcgccaccatgcccagctaatttttctatttttagtaaagacagggttttaccacgttggccaagatggtctcgatctcctgacatcgtgatctgcccgcctcggcctcccaaagtgttgggattacaggcatgagccacctcgcccggccaacacttttaacatctattatttctggtcagattaaaagatgtactttttcttttttttttgagtcgatgctcaatatttgtttaatgaacaaatttataaccctctgctttatggatgaagatcctgagactcccagggaacagctgacttgctgccagccatgtagtcggcaggtagcttcagggttggtgcttttcacccctatattacattgcctctccacctttagcatgcagcttgatatttatgtaaaattaaaataacagaaaccatgctctttatttttcccactttttggagaaacaaatataccaatctttaagtggttattttaaaatggaataaaacagtttccatggttttatttggattggcaggtgattcatcctaaaactgatgaacagagatgcagacttcaggaagcttgcaaagatattctccttttcaaaaatcttgatcaggtaacattgatttctaaagtatttttattataatgatcttttagctttgctcctatttgtcacttaaactttaatttttagcaccctagccacagccgtgttaagcataaaaccttagattcatcttacatacagatgttttcattgtattgaccactttaacccaggcatgatctttcagatgccttttagtgtggtagtcccccttatccttggttttgctttccagggtttcagttacccatagtcaatgacagtccaaaaatactaaatggaaaattccagaaataattcctaagttttaaaaggcatgccattccgagtagtgtgatgagtctcatgctgtcctgctctactgccacccagaacgcaaatcatcactttgtccccgtgtattcatgccatatatgccacctgcccattagtcacttagtcaccatatagcagtactcatattcacgtaacccttattttacttaataatggccccaaagcacaagagaagcaatgctggcaattcggatatgccaaaaataagccataaaattcttcctttaagtgaaaagatgagagaaacttaaggaaagaaaggaagaaagagagagagaaaagaaagaaaagagagggagagagggagagaaaaagaaaggaagagagaaagaaaaggaagaaaggaaggaaggaacaaaaggaagggagggagagagggagggagggagaaagaaattgtatgctgaggttgcaaaaatctatggtaagaatgaatcttctggctgggtgcggtggctcatgcctgtaatcctagcactctgggaggccgaggtgggtggagttcaagaccagcctggccaacagtgaaattctgtctctactaaaaatacaaaaattagccaggtgtggtagtgtgcacctgtaatcccagctactcaggaggccgaggcaggagaattgcttgaatccaggaggcggaagttgcagtgagctgagatcgcaccattgcactccagcctgggtgacagagcaagactctgtctaaaaaaaaaaaaaaaaaaatagaataagaatgaatcttctatctgtgaaactgtgaagaaggaaaaagaaatttatgctagttttgctgttgcacctcagactgcacaagttacagccacagtgcgtgttaagtacttggttaagatggaaaaggcattacatttgtgggtggaacagaaatgtgttccaattgacatcagtagggttcaacactatctgtggtttcagacatccacatatccccttggaacatactccccatggataaagggaggactgctgtatttttctgagctgctttggcactttctccaagacaatactgataatttgaagagcatgcggttttgtcatgttgcaaggaaatgctcagatttgcatgaccctggcttagttaggagggtctgaatttatcctacaaagagattgatttttctgaagatgctggtatgtagttcccttcattgataatagttaactcactggcttaccacagtgtgtagtaagtgcttcttaggaatggtgtgtttctgcagggcctagcataggatctatgacctgggcctgtcctccctctcttggtggtagaaataaagaacaagggctatctcctgataggtgtcctagtacatttgggctgctataacaaaatactgtaacctgggtggtttataaacagtggaaatttctcacagttctggagtctgggaaatccaagctcaaggtgccagcagatttggtgtctgatcaggagcccacttcctggttcgtagataaccatctctgtgtgttctcacatggtggaaggagggagggagctctcagggtttcctttataggggaactaatcccattcatgatcatgtaaaggccttaccttctaataccatcacattgggagtcaggctttaacatgaaattttggggtgacataaacatttagttcatagtaacagagaatcttcagatttcctgtttcttctctattcttctctactgtttcttctctactttgaaggccacacattaaaagaatgaggccaggcatgggggctcacgcctgtaatcccagcacccagcactttgggagactgaggcaggcagatcatttgaggtcagaaattcaagaccagtctggccaacatggtgaaaccccgtctctactaaaaatacaaaatttggcagggcacggtggctcacacctgtaattccagcactttgggaggccgaagtgggcggatcatgaggtcaagagatggagaccatcctggctaacatggtgaaaccccgtctctactaaaaatacaaaaattagctgggcgtggtggcgcgcacctgtagtctcagctactcgggaggctgaggcaggagaattgcttgaactggggaggtggaggttgcagtgagctgagatcataccactgaactccagccttggcgagagaatgagattccatctcaaaaaagctaaaaatttaaaattaaaaacatttaaaaatttaaaaccgcatgaatggctaaggtgctaggcctattgaggagtcccagaatgtgcagagacaggaaggctggaattagatttcctctgttacccagctcctaccaaaaaggcttctgaagacatttccacagccctccttaggaatctgggctggtcagatatgagcttacaatgcatcagtcaaaggagttaactaaccttggtgtctgtaaaccagactaataactgtgtggtttacagtaatagccagagctttactcagagcttgttagtttgagactgaatgagacaaggaccatgagctcaaggaaaggctggttatgagaaacagtggtctgtgttagctgttttccctggaagacccatccatgtaaatggaaaaggggcttgcttctttatctgtgaataaaacctcttgtaaattttataccattaaagttactataaggaaagtttctatgtcaatctaacagttttcttagagttggagaataccatttgagtgttgaaaagttataacttggacgggcacggtggctcattcctgtaatcccagcactttgggaagccaaggagggaggatcatctgaggtcaagagtttgagaccagcctggccaacatggtgaaaccccatctctactaaaaatacaaaaattagccaggcttggtggcaggtgcctataatcccagctacttgagaggctgaggcagaagaatcgcttgaacccaggaggcagagtttgcagtgagctaagaccacaccattgcactacagcctgggcaataagagtgaaactctgtctcattaaataaatacataaataaataaataaataaataaataaataaataattacttttctcaataatgtcttttttctggtagaggatccagtccaggatcccatgttagatttagcagttatttcttcttagtctcctccaatctgtggcagttttcagtctttacttgtctttcataatcttgacactttgaagagtactagttagtcattctatagaatgtctcttcatttgagtttgatgtttcctcatgattttggaatatggttatatatttttggcgagactaccacagaaattatattgtgtccctctgaaagcatcatatcaaggggcccatgatgtcagtatgtcttattgccagcaatgttagttcattcctttttattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactgagtcataggataggtatatgtttgactttgtaaaaaaatctgccagatcagccgggcgcgatggctcatgcctgtaaacccagcactttgggaggccgaggcgggcagatcacctgaagtcaggagtacgggaccagcctgggcaacatggtgaaacctcctctctactaaaaatacaaaaattagctgggcatggtggcacacacctgtaatctcagctactcgggaggctgaggcaggagaatcacttgaacctgggaagcagaggttgcagtgggccgagatcataccactgcactccagcctgggtgacagagcgagactctgtctcaaaaaaaaaaaaaacaaaaaaaaaccaaaaaactgccagatatttttcatagtagttttaccagtttgcattcctgtccacaacatatgagatttcaggttgcttcatacccttactaacattttatagtgtcagtattttttctgattagtatatttgtttcaaattttaaatttatttcccaaatttctatttttaaattttcaaaattacagaaaattcaaaagaataataacatgaatacccagatgccctttacttagactggccagttgttaacattataccacatttgctttttctcttgtgtgcaagtttatgtacagagaaaaagaaaagaggagtatatataaaatgcttttcttttgttctgagccatttatgacatcatgacccttcaccactaaatatttaggatgtattttccaggaacaagaatattttctggctaggcaaggtagctcacgcctgtaatcccagcactttgggaagccgaggcaggtggatcacttgaagtcaggagttcaagaccagtctgaccaacatggtgaaaccctgtctctactaaaaatataaaaattaaggccgggcccggtggctcacgcctgtaatcctagcactttgggaggccaaggcgggcggattacctgaggtcaggagttcaagaccagcctggccaacatggtgaaaccccgtctctactaaaaatacaaaaattagctgggcatggtggcacattctgtaatcccagctactcagcaggctgaggcaggagaattgcttgagcccgggaggcagaggttgcagtgagccgagatcgtgcaactgcacaccggcctggccgacagagcgagactctgtctcaaaaaaaaaaaaaaaaaaaaattatccaggcctggtggcatgcgcctataatcccagctattggggaggctgaggcaggagaaatcgcttgaacccaggaggcagaggttgcagtggaccaagatcgcgccactgcactccagcctgggtgacaaagtgagactgtctcaaaaaaaaaaaaaaaaagaatattttcctatgttaacacaataccatttaataaacccaagaaatttaatgttggtataatataaaatcacctaacaacagtccatactcagatttcccgttttcccagtaaagttctgtatagctttttgttttgtttttcagtcctgaatcacatacaataagtcttcacctaacatcatgaatcacatatagtaagtacttcaacattgttggtagtcttggaaactgcaactttaagcaaaacaacctataatgaaacctttttttcccctcatcagtgttataactgtgttatttgaggaccttctatacattgttttgcttaaagtcacagttttcaagaacctatcaaccacattgaggacttactgtatttcatttggttgtcatgttgttattttagtctcctctaacctagaaatgctccctttccgcccctgttattctatatctcatgacacatgtgtttgaagagtccagactagaagaagaaaagtgactcagaacaagcggcttccagcaggcaacccacaggctaggtacagatgtctgtgtttggtctgtattgaacatgaaaatttaaatttattgccagtgtttaaataggagatttctggcaacactgggctcacattccagtcagtgtgggtaacacgtcagttgcaagccatcctttttagtatttgttagcttatacagtattcaacgcacgtggaactaaatacactttttggtgatactcaattatcttggtagtacagtcactctgatagaacataaaatcacatggaattatgcagtcataaaattattctcttttcaggtcttcagtctacatttctccaaagagaaagtctctttttttaattgaacctggtattctttagtgacttcctaataattactgatctccctgacagggatgctggccccagactgagaccattgtttcattagaatttaatagtattattttcttttcattatacttattgacatagttgatgtctggttatggcaggcaatatttgtaagtaattgtatgtgctgtatgcaaatgaagcaatattagctgtcttataatatatctcatttattgagtatctgttgtttcataaatactttcctaggtttttttcctttggtcataaaaattgatgacctggaatctttgttataccctttttacatatgaagaaactggagttcaccggacgtggtggctcacgtctgtaatcctagcactttgggaagccaaggtgggtggattacatgaggtcaggagttcgagaccagcctggccaacatggcaaaaccctgtctctactaaaaatataaaaatttgccaggcgtggtggcacaggcctgtagtcccagctactcaggaggccgaggcaggagaatcgcttgaactcgggaggtagaggttgtggtgagctgagatcacaccactgcactccagcctgtgtgacagagtgagactccgtctccagaacaaaaaaaaacaaacaagatactgaagctcagtgaggttaagtgacgtgtttcgctagtcaaaagttgtgctgttccaaaagataacctctaaggccatagcagccctttagatctgatgctcctgttaaggtcaacagctgtaggaaggtgggagcatatgactttacacatgacatagtggagccatcaggcaggtgacagtcatgtgggtgtggctgggagaacatggaccataatttagataatatttttgtgtaaattttgggaagctttttcaaaacaatactgcctcagaagacttgccagtttgctgtctgctgaggtacatggaggtgcaaagctgaatggtcccaggaaagcatttgtttcagacaacctttaggtttctgcttgaatgtggggacttctgttacatagtcacaaattgagataattatggtcactgctttttttcagcatatgtaaaggctatttttttcttcttgtgcataccctgcaggaacagctttctcaagttctcgatgccatgtttgaaaggatagtcaaagctgatgagcatgtcattgaccaaggagatgatggagacaacttttatgtcatagaacggtaggagatggagctttgaaattgtgtggccacacttaatcggattcatgactcagggcagatgctttatcctattctgtattcagcccagagaggctaagggccaggtgaacaagcttcccaaagccttgtgagagtccacagcttgtccctctctaccagtgctgtcctgagtcctcagcacaactcatatttgaagagcaatcatttagagtagaaagtctcctttaggccaggcgcagtggctcatgcctgtaattgcagcactttgggaggccaaggccggtggatcgcttgaggtgaggggtttgagaccagcctggccagtatggtgaaaccccgtatctactaaaaatacaaaaattagccggatgtggcagtgcatgcctgtaatcccagctgcttgggaggctgaggctggagaatcacttgaacctaggaggctcacgcctgtaatcctagcaaaggttgttgcagtgagctgagaccccgccactgcactccagcctggacaacagagcaagactccatctcaaaaaaaaaaaaagaaagtctcctttacagttagtaaggagtgcagggtgtgctttataaacatgttatttgccagtgtcaagtgaattgattccttgaagaattagccatggtactatagtcatttgaatgtttgtatttgagcctgattttactcatgaatacactgccctgaccttaacccctctggctcagatctaagtattaggaaaagatgaaatatttgggcttgacctgctcaccctactgtgtcctaacctcttgagtttagtatcctctggctggtggcagtgaggtgggtgtccttctgatctccttagtcctgaaagaaacactctcactagagtttaacaccaataagatattgcttcacctgatatcttccattaatttaaaataaaatggtttttggagctagataataaaaaggaaacaaaaatagtttttttatcttaaagtaatttcagagttacagaaaagttaaatagtgcaaaaaattaatcataggcctggtgcggtggctcatgcctgtaatcctagcactttgagaggccgaggcaggtggatctcttgaggtccggagttcgaaaccagcctggccaacgtggtgaaactccctctacttaaaaaatacaaaaattggccagtcgcagtggctcatgcctgtaatcccagcactttgggaggctgaggcgggcagatcacgaggtcaggagttcgagaccagcctggccaacgtagtgaaactccgtctctactaaaaatacaaaaattatctgggcatggtggcacgcgcctgtagtcccagctactcgggaggctgaggcaggagaatcgcttgaacctgggaggcagaggctgcagcaagctgagatcgccccactgcacaccagcctgggcaacagtgtgagactttgtctcaaaaaaaaataaaaataaaaaagtaaccgggcgtggtggtgtgcacctgtaatagcagctacttgggaggctgaggcaggagagttgcttgaacctgggaggtggaggttacagtgagccaagatagcgccactgcactccagcctgggtgatagagtgagactcagtctcaaaaaaaaaaaattgtaaatacaggttccctaggttagcgttctactccctttgctttattaagttgttggcaaggctgggcgtggtggctcacacctgtaatgctagcattttgggaggctgaggtgggtggatcacttgaggtcaggagttcaaaaccagcctggccaacatggtgaaaccccagctctactaaaaatacaaaaaaaaaaaaaaaaaaaattagccaggcatggtggtgcacgcctgtggtcccagttacttggaaggctgaggcaggagaatcacttgaacccacaaggcagaggctgcagtgagctgagattgtgccattacactccagcctgggtgacagagtgagacttcgtccccaccaccaaaagaaaaaaaagttgttttaagttgcacatataatgcccctttatctctgaataccccagtgtgcatttcctaaaaaggatattctcttactttagtacagaacaattataaaaaacacaaattaacatttatacaatactacatctaatgtatgcaccttattcaaatttttctaattattctcctcatttttaagattcttttaatctccatcaaatagctgtactagatacattggttgcctttcttcttgagccttttcttatttagattcttgaacagaaaatactctccctccttgagtaacctttgggttcttgctacctgtgacaaattattacactcagaggaaatttttttttttttttttttttttgagacggagtcttgctctgtcgctcaggctggagtgcagtggcgcgatcttggctcactgcaagctccgcctcccaggttcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcttttatgctaatacttcttacacagtaaattctacaagtaatgacagaataggtttttttgttttttttttgggggggtacggagtctcactctgtcgcaagggctggagtgcagtggcatgatctcagctcactgcaacccccgcctcccaggctcaagtgattctcctgcctcagcttcctgagtagctgggactacaggtgcctgccaccaagcccagcaatttttgtatttttagtagagatggggtttcaccatgttggccctgatggtctcgatctcttgacctcgtgatccacccacctcagcctcccaaagtgctgggattacaggcatgagccaccgcacccagcccagaatagttttaaaataaaattataaatataatacaaaactatatattttatttatttatttatttatttatttatttatttatttatttatttattttgagacggagtcttgctctgttgctcaggtgggagtgtagtggtgcaatcctggctcactacaacctccgcctcccgggttcaagcgattctcctgccatagcctcctgagtagctgggattacaggcacccaccaccactcccagctaatttttgtattttagtggagatggggtttcaccgtgttggccaggctggtcttgaactcctgacctcaagcaatccacccgccttggcctcccaaagtgctgagattacagatgtgagccaccatgccaggtctatatttataatataataaaattatattaccacctccagcagccacctttcccctttgccctgctgtgtactcccctaccaagacagaggtcccattgggcacttatgatctgggaaataagcatccacctgtacatgtccacaacttaaagactgaaatgcctttgtacagaaggaatgatttatttcatatgtaaacaaaagggattattctttgtacagtgaaagtggtgaataagagcctggcacagtggtttgcacctgcaatcccagcactttgggaggccaaggtgggaggattgtctgagcccaggagttcaaaaccagcctggggaagatagtgaaacctcatttttacaaaacatttttttaggccgggcacagtggctcacacctgtaatcccagcactttagaaggcccaggtgggcggagcacttgaggtcaggagtttgagaccagcctggccaacatggcaaaacctcatctctactaaaaatacaaaaaattagctggacatggtggtgggcgcctttaatcccagctacttaggaggttgaggcaggagaattgcttcaacctgggaggtggaggttgcagtgagccgagatcatgccattgcactccagcctgggcaacaatagtgaaactccatctcaaaaaaaaaaaaaaaaaaaaatgcaggccgagcaccgtggctcacgcctgtaatcccagcgctttgggaggctgaggcgggcaggtcacaaggtcaggatgtcgagaacatcctggctaacatggtgaaaccccatctctactaaaaataaaaaaattagctgggcatggtggcatgtgcctgtagtcccagctacctgggaggctgaggcaggagaataacttgaacccgggaggcagaggttgcagtgagtggagatcatgccactgcactccagcctgggtgacagaatgggactccatctcaacaaaacaaaacaaaacaaaaacacacaaaaaagcattttttaaaaaatttgccaggcatggtggcgcatgcctatagtcccagctaattggaaggctggggtgggaggatcacttgagcccaagaggttgagtctacagtgggcagtgatcataacactgcactccagcctgggggacaaagtgagaccctgtctcagaataaaaagaaaagaaaaaagaatgtggtgataaacaaataggaaagagctgagcacagtggctcacacctgtaatcccagcactttgggaggccgatatggattacttgagaccaggagtccgagactagcctgggcaacatagtgagacccctgtctctacaaaacaaaaaagaaagattgtcgttcaagtaaaaaggtacagttcctgacctcaaaaaattcatggtcaagttggagagacagacctttcaatagataattattacataatgtggtggtaacaatgataaaaacatatgccccattatatagaggatgacctgaatgggaaaggtcgagaggctctctgcagtgctgctgcctgaaatgagttcatgtcacttccaaagttaaatgctagtgtctggaggagacgctaaaaacactgaattctatgtttcctatttataagcttattttgccttgtctataaaggcctaggacaggtcagcttccctactgagtggtaagctcccctgagagcagggttggtggcacattctctgcttttcttttaatacatgatatttagtgattttgtcagacagttggaagttctttgtaggaaatttagaatataaaaaaataaaaggcctggcgcggtgcctcacacttgtaatcccagcactttgggaggctgaggtgggtggatcacaagatcaggagatcgagaccatcctggctaacacagtgaaaccccgtctctactaaaaatacaaaaaattagccgggcgtggtggcgggtgcctgtagtcccagctgctcgggaagctgaggcaggagaatggtgtaaacccaggaggcggagcttacagtgagccgagatcatgccactgcactccagcctgggcaacagggcgagactccaactcaaaataaaataaaatacaaacaggatagaaattaatttaggcataatctgattaccagtgtatgattccattattttttccatgctttactgttgagatcagacacctcacccaaaatttggttaagatgtcaagactgatgacactacatatacagtaaaagggtatgaaaaggtttattactcacatatagagcctttttagagagagcagggcaggctcccaggcagatccaaaaatgacttcagatagcaggcgagatgactgtcttgggatttatggtggttagaaggtgggattaagtgagggtactcttacacaggggctggcatttgtgttgattgaactccccgtcagcaccgaaggagggagcactcaggctttcttatcagcttgcccagatatggggcagaagaggaagggtttgaaagctgtcaacaatcaaacatcaaaaatggagtcgactaatggaattatctttacataattttttttacattaaatcatacattgttgtgtgatttaatttttttaatctgttttaagcatgttatggaatatagcattctgttattattattttgagatagagtctcactctgccacccaggctggagtgcaatggtgcgatcttggctcactgcaacctctgcctcccagtttcaagtgattctcctgcctcagcctcccgagtagctgggattacaggcacatgccaccacacccagctaatttctgtatttttagtagacacagggttttaccatgttggccaggctggtctcgaactcctgacctcaggtgatctgtctgcctcagcctcccaaagtgctgggactacaggtgagccactgtgcccagccatactctgtcattattattatatatatatacacacatacacaggcgtgagccaccatgcctagcctctgtcattatatttaatgactccatgatatatatagaaacatgtatttgacccatctcctattattagcagatgaaattacatatagtttttactattatagatattacctggtgaaatcctggcaattacatcttttgcagtatctttgattatctcttttggaatgactagaaatggaattgctatatcaaagggtctttttaaggcatttgctataagctttaattaccttgcagaaactgaaaagtttatgtttccctcagtggtatgttgagagtgcctatttctgcaaatgcttgtcagttctgaatattttttccttagcaattattgccaatcaatagataaataattgtatcgtttgtttgtttgtttgtttgtttgttttgagactgagcctctctgttgcccaggctggagtgcaatgatgcgatcttggctcactgcaacctccacctcctggtttcaagtgattctcctgcctcagcctcccgaatagctgggattacaggcacctgccacccgcccagctaatttttgtatttttaggagagacggggtttcaccaggttggccaggctggtctcgaactcctgacctcaggtgatccactcacctcggcctcccaaagtgctgggattacaggcgtgagccactgcacccagcctctgtcattatttttaatgactccataatatagatagaaacatgtatttgacccatctcctattattagcagatgaaattacttatagtttttactattataaatattacctggtgaaatcctggcaattaaatcttttgcagtatctttgattatctctcttggaatgactagaaatggaattgcaatatcaaagggtctttttaaggcgtttgctatatgttttaattatcttgcagaaactgaaaagtttatgtttccctcagtggtatgttgagagtgcctatttctgcttgtcagttctgatttttttttttttttagccattattgccgatcaatagataaataattgtatcgttttgtttgtttgtttgtttgtttgttttgagacagagcctcgttctgtcgcccaggctggagtgcaatgacatgatctcggctcactgcaacctctgcctccaggtttcaagtgattctcctgcctcagcctcccgagtagctggaattacaggcacccgctacccgcccagctaatttttgtatttttagtagagacggggtttcaccagattggccaggctagtctcgaactcctgacctcaggtgatccacccaccttggcctcccaaagcgctgggattataggcttgagccaccgtgcccgacctgctttgttttaatctttgttttaacagactatgaaagaaaacccatgcattcatatcaatacctacagcaaagcatttgacaaaattcaacatctttttgtgatgaaaatgctcagtaaactagcaacaaaaataactttccctaactagactaaaggcatttattaaaaacctacagctaacatcatatttaatggtgaaaaattgttttttcttacaactcagaataaggcaaggatgtttgctttcaccacttccacttaatattgtactggaggttatagtcaatgcaataaggcaaagaaaggaagagagggagggagggaggcaaggaaaaaaggaagaaagaaagaaagtgtggcatagtacacaatgaaataccatttgaccataaaaaagaaagaagtcatgtcatttgtagccacatggaggttgctatattaaggtaaataagataggcacaggaagacaaataccacatgttcttgctcacatgtgaatgctaaagaacattgatatcgtagacatagagaatagaatgatatataccagaaactgagaagggtggtgggtggatgaagaaaagttggctaatgggtacaaacacacagttagatagaagaaataaattttaatgtcttttttttttcctttttgtggagagaagtctccatacgttgcccaggattgtctcaaactcctgggctcaagcaaccctcccagtttagcttcctaaagtgctggagattacaggtgtgagccactgcacctggcaagttctaatgttttatagcatgataaggtgactatacttgggtgacaatatttagcatatttcaaagtaactattaatagaagagaggacatgaaatgatactgacacatagaaaggacatatatccaaggtgatggataccccagttaccctgacttaatcattacccattctatgcatgcaacaaacactcacatgtacgccataaattatgtaaaatattatatattaataaaagaaaaaaaattaggccgggcatggtggctcatgcctttaatcccagtactttgggaggctgagacaggaggattgcttgagcccaggagttccagaccagcttgggcaacatagtgagaccccatctctacaaaaataaaatattagccaggtgtggtggcacacgtctgtggtcacagctactcggggctgaggtgagaggattgctagggggctgaggtgagaggattgcttggggccaggaggtggaggctgcaatgagccatgattgtgcctctgcactccagcctgggtgacagagcaagaccctgtctcaaaaaaatatatatgtcaaaaaatgtatatatgtgtatatatatatttatgtgtatgtatatatgtgtgtgtgtgtatatatatatatgtttaagttaaagatggggggaaaaaaaggaaggggcatatagattggaaaggaagtattaaaactttgtttcaggtgacatgatcctctatgtagaaaattctagccgggtgtggtggctcacacctgtaatcccagcactttaggaggctgaggcgggcggatcacgaagccaggagatcgagaccatcctgctaacatggtgaaaccctgtctaaaaatacaaaaaaattatctgggcctggtggcgcgtgcctgtagtcccagctactcgggaggctgaggcaggagaatggcgtgagcccaggaggtggagcttgcagtgagctgagataccgcccctgcactccagcctgggtgacagagcgagactccgtctcaaaaaaaaaaaaaaaaaaaaaagaaaagaaaattccaagaatgccacaaaaaggctactagaattaataagtgagtttagcaaggttataggacacagtacaaagtcaaaatacaaaaatatgttttttttatatactagcaaagttccattggaaatctcttaaaacaacattttctattatatgtacctgccagttcttaacatttattatcagaagtaactaattaaattattctttgtcattcttctaggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggtgagtgagagaaatcgttccccttgcaaggcacagtattaattccctttctgtgtctctgtccttgggctgttgatttacactatatcttacagccatcctggctaacacggtgaaaccccatctctactaaaaaatacaaaaaaaatagccaggtgtggtggtgggcatgtgtagtcccagctagttgggaggctgagacaggagaatggcgtgaactcgggaggtggagcttgcagtgagccgagatcgcgccactgtactccagcctgggcgacacagcgagactccgtctcaaaaaaaaaagcactttattgtgacatcctgatgttaaattaagagtgctcctgaaagagatacagtgacttaaggataggtcacacacttggggactcaatgattgaaaaactcaagaatagatttgtataggggaataataaataatgggggccaggcacggtgactcacacctgtaatcccagcacttggggaggccaaggcgggaagatcacttgaggtcaggagttcgagaccagcctgagcaacatggtaaaaccgtgtctctactaaaaatatgaaaattggccagtcatggtgatgggcgcctgtagtcccaggaggcggaggttgcagtgagccaagatcacgccactgcactctagcctgggcgactgagcaagactccatctcaaaaaatacaaaatcaaataataagccttggtgctaactactggttcagaccaagatggaatagccctattccatgctagtgttctcacttaaaaacttaaacacacacacaaacaactatggacataatagagcaaacataggaagactctgaaaggtggaaagaagaaggcagactatctagggatattggggcttgaggaaagacatgacagtgagttcccaggttcccatatatcccagatggggtgctggaaagcctgaaatccagatcttctaacaggtatattcaacaaaagcaaaactccatctcaaaaacaaaacaaaacaaaagaacgaacagctaaacagaaaatcagctagtgtcagctaggatatagaagaacttaacaccattaattaacaaaagctatctgaaatttatagaacactgcacacagcaacaacagaatgaacatttttttcaagcccatggaacattcacccaaataggccatatcctggaatataaaataaaacttaaaaaatgtaaaagatttgaaatcaggccaaccacagtggctcaagcctgttatcccagcactttgggaggttgaggtgggaggattgagtccaggaatttgagacctacctgggcagcatagtgagaccacatctctatttaaaattttaagaaataatgaaaatttaaagaaaaaatgaaatcagaatgtgttctctaactacaattgaaagaaagaaactaaaaatcaataacagatctccagacacttagaaattaaataacattgtttttggtgtgagcaggggctaactgcagccttgacctcctgagctcaagcaatcctcccacctcagcctcccaagtagctgggactacaggtgtgcaccaccacacctgtctttttgttgttgttgttgttgagacagagtctcactatgttgctcaggctggtcttgaacttctgggctcaagcagtcctcctgccttggcctcccaaagtgctggaattacaggcatgagccactgtgcccagccaaataacacattctttcttttttttcttttttgagatgatcttggctcactgcaacctctgcctcctgggttcaagcgattctcctacctcggcctcctgagtagctgggattacagacgtgtgcacgtgtgccaccacgcccagccaatttttgtatttttagtagaaatggagtttcaccatgttggccaggctggtctcgaactcctgacctcaggtgatctgcccacctcggcctcccaaagtgctgggattacaggcaagagccaccgcacccggccaaataacccattcttggataatctctaagaccaagtctcaatgaaaattgaaaactgtatattgagctgtaaaaccacctgctttgtggctggggtatgaggattaaatacatgggcataagagaagtgactcccttagtgcctggtacaaggtgggtgttcacagaatgatggcacaagctccccatggccatggtgctactcaccacccttcttttcctgagacttcctttcctaagactcctattctttctatttccttgcctttggcagtcatttcctcttctccttgctttcttaggtcagtgacctatcaagatatccttttggcctctacttttctcctgttaattgacttgctttgcaagcccagactcttccaaagcttcaataccacctctaggaaagtaactcacagaaggtcctctccagcctgacttcttctttggccttggaaatgccttctgaggttgaagtagggaggatctggtgtcgtcactgagtttttcaagttggatcctacattcctgcttttataatgggcagctgccatcacggcccctatacgtagtctcttttgctttctcttgctttattgaaagtcaatagaaggtttcctgggaaattcctgcagtcacaggagagagtagcactccttttctcttttgaacttcaggggtgtttgcttgcctctgaccacttgctgcctgtgggaatttcctcttcactgctcgattggatgctcatcaaaggctatgttgatgtctggtgctttttttatattctccacagccatgggaactggccttgcaccacatgaaaagagagttttgggaagtgttaaagcatgcgtaaaaaggggtagaaccagctgggtgtggtgactcatgatgtaatcccagtactttgggaggccacggtgggcaaatcacatgagcctaggaattcaagaccagcatgggcaacgtggtgaaaccctgtctctatgaaaaataagaaattagctgatgtggcggcacatgcctgtagtcccagctacttgggacgctgagttgggaggatcacctgggcctaagaggtcaaggctgcagtgagctgtgatcatgccactacactccagcctgctgagtgacagagtgagactctgtctcaaaaaaaaaaagtcgcttgccgggcgtagtggctcgtgcctgtaatcccagcacttcggaggccaaggtgggcagatcacctgaggtcaggagttggagaccagcctgacaaacatggagaaaccctgtctctactaaaaaatacaaaattagctgggcatggtggcgcatgcctataatcctagctactttggaagccaaggcaggagaatcacttgaacctgggagacggaggttgcggtgaggcaagattgcgccattgcactccaacctggtcaacaagaacgaaactccatctcaaaaaaaaaaaaagtcgctgtaagagatatttgttgtggtcgggcacagtggctcacgcctgtaataccagcactttgggaggccaaggcgggcggatcatgaggtcaggagattgagaccatcctggctaacacggtgaaaccccgtctctactaaaaatacaaaaaattagccgggcgcggtggcaggcgcctgtagccccagctactcaggaggctgaagcaggagaatggcgtgaaccagggaggcggagcttgcagtgagccgagattgtgccactgcactccagcctgggtggcagagcgagactctgtctcaaaaaagaaaaaaaaaaaaaaaaaagaaagatatttgttgtttnnnnnnnnnnnnnnnnnnnnaacaatgtggggtttggttttctaagggggccaggggcggggttttggggcccaggtgggggggcaagggtcacagtgttgggtgcaggggggcctgggactccgtggggtcaggaaatatcgccggttgggcctgcaagaaaggtagggttaaccggtggtgtacaccaggagccgggaaggtagtgtattaggagggggcccccggggtttcagaggggtctcttaggagggccgggacgggagtgggaacggagtgacggaagtcatccgcgtagggcttccggagagagtggggatacttagaggggtgacccagtgcagggggcgcaataccgggtgatgtgtcacgccaaggtggagtggagtggtgtgatcgggtcgcagagcaaccttccactggggggtgtcaagcaattgtcgtggctcagcctccgcaagtaggtgggattacaggctcccaccaccatacccagctaatttttgtatttgtcgtattttgtattttgagtagagaccactttgaccaggctggtttcgaactcctgacctcaagtgatccacccacctcagcctcccaaagtgctgggattacaggcgtgagccatgcgcccagccgaaatattgtttgctattgcaattgtactaatctttgttacactgtaggtggatttgtaaaatattgggagttaactttgctgccctctgtgtattttttaatatttatttatttatttattttgagacggagtctctgttgcccaggctggagtatagtggtgtgatctcggctcactgcatcctctgcctccagggttcaagtaattctcatgcctcagcctcccaagtagctgggactataggtgtacaccaccatgcccagctaatttttgtatttgtagtagacacgagatttcaccatgttggccaggctggtctcgaactcctgacctcaagtgatccacccactttggcctcccaaaatgctgggattataggtgtgagccactgtgccaggccttttattttatctatctatgtatctatgtatgtgtgtgtgtgtgtctgtctgtctgtctctctgtctgtctatatctatctatctatctatctatctatctatctatctatctatctatctatcttttgagacggtctcactctgttggccaggctggagtgcagtggtgctctcacacctcactgcaacttcgcctcccagggctcaagcaatcctcccacctctgcctccccagtaactgggaccacaagtgcacgccaccacgcctggctaatttttgtattttttgtacagatgggtttcgccatgttgcccaggctgttctcaaacttctgggctcaaacaatccacccacctccccacctcagcctcccaaagtgctgggaatacagtcgtgagccactgttcccagcctgtatgggttttttttaaataaataaataaaatattggggttttctgtttttgtggggtttttttgtttgtttttttttttgagatggagtctcgctctgtctcccaggctagagtgcagtggtgtgatcttggctcactgcaacctccacctcccaggttcaagcgattctcctgtctcagcctccctagtagctgggactgcaggcgcgtgccgccatgcccagctaattttttgtatttttagtagagacggggtttcattgtgttagccaggatggtctcgatctcctgaccttgtgatccacccgcctcagcctcccaaagtgctgggattataggtgtgagccactgcgtccagcctgtttttgtgttttaaatagagttgaggtctcattgtgttgcccaggctggtcttgaattcctagcctcaagcgatcctcctgccttggcctcccaaagtgcagggattacaggcatgaaccaccacacacagcctaaaatattgttttgtttttgtttttttcgaggcagggtctcgctctgttacccaggctggagtgcagtggcatgatctcggctcactgcaacctctgcctcccaggttcaagtgattctcctgtctcagcgtcccaagaagctgggattacaggcgcccaccaccatgcctggctaatttttgtatttttagtagagatgtggtttcaccatattggccaggctggtcttgaactcctgacctcaagcgatccgtctgcctcggcctcccaaagttctgggattacaggcgtgagccactgcgcccagcccattattatactttctgacaaaatgtatatatgtatagtcctgacagcctgaggtggaagaaaggtagttaacttagatacaaataactgcttgcccatttaggaatctaagactaagcaattaacattctcacatgtatctccctgcacatgtgtacacatatctgagaagtgcctggtttggttaactgtcttctgatcagaatccattacttactaagccaggcacagtgttgtgtacctgtagtcccagctacttgggaggctgaggtggggagatcacttgaccccaggagttcaaagccagcctggacaacattgggggaccctatctcaaaataaaacagaaggaatccatgacttgctagagtcaaggtatctttcatatgcctgccttccatcttgcgtattcctcccgtgtctctccattaacttaaatcctacctctctttcaggtcctagacatttttgctgcaaaataatctttgatcactcctgcctactgtgatctccccttcttaccttgaaatttatgtggcacttgtcttctgtagtttcatcaagcacatttcatatgctcatatgctgtcttgaactgtagactttttatttttattttatttttttttgagacacagtttcaacttatgtcacccaggctggagtgcagtggcgcaatctcagctcactgcaaccttagcctcctgagctcaagtgattctccagcctcagcctcccaactagctgggactagacaaacgccaccatgcccagctaatttttgtattttctgtagagatggggtttcaccatgttgcacagcctggtcttgaactcctgagctcaagtgatctgtctgactcagcctcccagaatgctgggattacaggtgtgagccactgcacctgtccttgaaatgtagactttttattcctatgtattttgttgttgttgttgttgttgttgatattgttgtttttgggacatagtgtcactctgctgcccaggctggaatgcagtggtacaatcacaactcactgcagctttgacctctcaggctctggtgagcctttcacctcagccacccaagtacagacaagtgccaccatgcccagctaactttttttgtgtattttttcgtagagagcgtgtttcaccatgttgcctaggctggtctcatactcctgggctcaagcaatttgcccaccttagcctcccaaaatgctaggagtacaggcagtgagccactgcattcagccaaccttcatattttgatattttatattatctccccattaagattgtaaacttttttagggtaagaacaatctaattgttctttttttaggcaagaacaatctaattgttttggattttttaagtttttttaaatcctggattctaaggattaaatgattgttttattctctcttttggtgaggtgtctcttttttttttttttttttttttttgaaatgagggtctcactctgtcacccaggctggagtgcagtgacatgatctcggctcactagaggtgtcttttttgatattgaacagtgacagtgagctcataaatgtttaggtgttttctgttttgggttctatttatgacccataggtggcacctattgagtgctagatagcaagcaacagcatgtgggcatctggctggctcaggctataggtcctttacttccagtgatgactcaagattgaagtatcattaaacacttaattaacacagtaacttacatattcctctaatatttgctttggccagttaattaaaccatagatgttcctgtatataggcatttactagaattttcatattctttcttgtaggaccgggtgacttttagaagaatcatagtgaaaaataatgcaaagaagaggaagatgtttgaatcatttattgagtctgtgcccctccttaaatcactagaggtaaagtggcttgaataagaatctgttcatggggatcaggaaaagcttttaaaactattctgttgttaggttttcaaatcatactattctaatcctatttctgtgctgcatagctattgtgactttcaattaaggtcttttccttttatttgtgaatttgttgtttcaggtgtcagaacgaatgaagattgtggatgtaataggagagaagatctataaggatggagaacgcataatcactcaggtgagtgagggctttacgcagctcctttcctggaagtcacccctgaagaactagtacatcatttatctcaaaaacttcttgccggacgcagtggctcacgcctgtaatcccaacacttcgggaggctgaggcaggtggatcacttgaggccaggagttcaagaccagcctggccaacatggtaaaactccatctctactaaaaatacaaaaattagctgggtgtggtggcccatgcctgtaatcccagctacttgggaggctgaggcgggagaattgctggaacccaggaggcaaaggtttcagtgagtcgagattgcgccactgcctccagcctgggcaacagagcaagactccatttcaaaaaaaaaccaaaaaaccttctatgttctcccactgttgggagctcttattaccaggtaatagatcatacttcagaggactattatgtagtcctctgaagcttattgacgtccgtcttactgacacgtgcagatctcttgcttcctttcacctttccttggcttctagtgtttgttcttttgatgtcattttcttttgaccttaagtaagtttcatccattgctattagaacctggggaaggttaaagagttctgtcctctaactttctatatttgacacaaaggcatccttttggctaatctaacacaaatcagagttcacagtcttcagtgattaaccaaatttgtaagatgtaaagattactaaacagtgggctagatcattgtaatgagtactgtctgataattttctttgtccgctgtgtttgtatttttaattaaacataaatagtattggacttttccaggtataagcttatctgcctatggttctggctcaagagcacggagaagatacatggttggtctaggttgggtgatatgcttatcctagaacccagtactgagactacgaggaggaaaggctcagattggtcaggtgtgggtcctgtgggtggagttggccccactagaacacaaggactaatcagacttaccataaaaggggagaaaaaagctcccttggaagagataaaggactaacaaaaatatgatgtctactctgagtcacatctctaaatgtatttgttttctaggagccgttactattaataattcttttaattagaaattggaatattctataaacatttattaagataggtaggaccagatatgataagcactataatgaaggagagtatgaacgacagtgagaacatagaaatggaagtaatacatatggtttcattgaggaaatgccatttgagatgggcttaaaaaacaagtgcaatttcaatgtttgggatcagggaaaggtccttcagagcaagaaaacaatattagcaaaggccagtggtgtgagctgtgtttcagagcaggtatcctggtatggtaagaatgtagtgctgagattcagaaatgggagatgttaactggccacatttgcttctgaacctaaggtgctttaagtaacattcaaaggaccttcaagtcatcctgaaggttctaggcctgtctcatactgggttttcaggaagtatgtcaggagatgtgagaagtcaatagtgttttcttcatggtctgtgctcttgaagatagagtgctatctatcttcaaggtagataggtagtggtacagaatggacattaattaagatgatattaaaaggggcttattgtaggtcccttttgtcaatgtctctcactggaccaaggcttctcaaagtgaggtcccaggaccagcagcaatcagcatcatctgaggatgttagaattgttaggaatgcaagttctggagccccccaccagacctgctgaatcagaaactacattttatgttgtttcatttgttttgatcagctttgttacagtgtattttacatacaataaaattactaagtttaagtgtacaaatcggaagagttttgtaaccatccccaagtggtatttccatcacccatacagttccttgttttgtatttgcagtcagtaccctcccccacactcacattcctggaaaccattgatgttttctgtcactgtagaaattcctttctacaatttagtataaatgaaatcatgtaatgtatagtctctgtgtctggcttctttctcttagcataatatttttgagatttattcgtgttgtatgtatcagtagatcgttcctttttattgctaataatatttcattgtacaaatgtaatttttttttctttttgagacggagttttcctcttgttgcccaggctggagtgcaatggcgcaatctcagctcaccataacctccacctcccaggttcaagctattctcttgcctcagcctcccattactttttctttttaatgagatacagtcttgccctgttgcccaagctggagtacagtggcataatctcagctcactgcaacctctgcctcccaggttcaagcgattcttgtgcctcagcctcccgagtagctgggaccagaggcacgtgtcactctgcccagctaattttgtgcatgtgtgtgtttttttagtagaaatgggatttcaccatgttggccaggctggcctccttagtaaatacttaagagtgcaattgctaaattatattttaacttcataacaaactgtttcttaaaatggctgtactgtcttgtattcctaccagccatgtatgaaaattccagtttctctgcattctcaccaataaatagtatttacagccttttttaaaaaaattacagtcagggtcttgctatattgcccagcctggtctcgaactcctgagctcaagccatctgcccgccttggccttctaagtgctgggattataggtgtgcacctccgcacctggccttcattttcttaatggtatcttttgaagagaaaatggttttaattttgacaagtccagtttatcatcttttcttctttgtagttgtgtacttttgctgctgtattttaggaaatctttgcaaaatcaataatatgttctcctaagtttacttctaagaccagcactattcaatagaaataatatgtgagccacatatgtaattttaaaaatttttggtcaggcagggtggctcacgcctgtaatcccagcactctgggaggctgaatagcttgaggcagataacttgaggccaggagttcgagaccagcctggccaacatggcgaaacctcgtctctactaaaaagtaataaaaaaaattagctgagtttgctggtgcacaactgtaatcccagctacttgggaggttgaagcacgagaatcgtttgaacttgggaggcagaggttgcagtgagccaagatcatgccacttgcattctagcctgggggacagagcaagacttggtctcaaaaaaaataaataaataaaaactttcagtagatatttgaaatggtgaacttaattttaatatatttcatttaactcagtatatctaaaatgttgtttcaacatctaagtgatataaaactttattaatgagatattttacatttttaatactgtcttcaaaatctaatgtatgttttccatctatagcacatctaagtttatactagcaacatttcaagtgctcagccacatttgactcgtggctaatgtattgagcagtacagctctagacagtcagaattttagctcttaccttaggtctgtgatccattttgagttatttttattgtttttgttttgtttttttgagatggagtctccctctgtcacccaggctagagtgcagtggtgtgatctcggctcactgcaagctccgcctcctgggttcacgccattctcctgcctcagcctcccaagtagctgggactacaggcgcccgccaccacgtccggctaattttttgtgtttttagtagagacaggtttcaccgtgttagccagcatggtctcagtctcctgacctcgtgatcctccttcctctgcctcccaaagtgctgggattacaggtgtgagccactgcactcagccttgtttttgtttattagaagcaaggtctcactctgtctttcaggcttcagtacagtgtgcaatcatagctcactgcagccttgaacttctaggctcaagcaatactcttcccttagccttccaagtaatgccaccacactaagctaatttttttttttttttttttgagacggagttttgctcttgttgcccaggccagagtgcaatgccacgatctcagctcaccaccacccccgcctcctgtgttcaagcgattctcctgcctcagcttcctgagtagctgggattacaggcatgcaccaccatgcccagctaatttttttttttttttttttagtaaagacagggtttctccatgttggtcaggctggtctgtgaactccctacctcaggtgatccgcccacctcagcctcggcctcccaaagtgctgggattacaggtgtgagccactgcgcccggcctacacccagctaatttttaaattttttgtagagacagggcctctctatgttgcccatgctggtcttgaacttctgacctcaagtgatcctcccacctcacctcccaagtagctaagattacaggcttgtgccaccatacctgactacatttttgtgttttgttttgttttgttttgttttttgagacagagtcttgctcttgttgtccaggctggagtgcaatggcacaatctcggctgactacaacctccacctccccagttcaggtgattcttctgcctcagcctcccgagtagctggaactacaggcatgcatcaccatgcccggctaatttttttttatttttagtagagaacagggtttttgcctgttggccatgctggtctcaagcttctgacctcaggtgatctgtccgccttggccttccaaagtactgggatggcgtgagccaccacacctggcctacatttttgttttttaatgacttgtataattttcacaagtaattttcatgattgatagaatatttagcttattcttagagtaatgtagacagaaggtggctttagttttacaaaatcatgttttatgtttttgctattaaagtaccattgcattaaaccaaaaagattcccatatcctgaaaattagggcttcagtcattcttatggtggaatgtggatcttatattatctgttgtgaaaaagagacatataagaacctgatgacatgttcacaaagacctaaaatgcagtacagtctggcttctttactgttgaatgtagaatggaatgttctttctgtgagatgtgtacacagagcctattagtgaacttgaaaagcaggatacttggccgggcgcagtggctcatgcctgtaatcccagcacttagggaggccgaggcaggcggatcacctgaggttgggggttcgagaccagcctgaccaacatggagaaaccctgtctctactaaaaatacaaaattaactgaatgtggtggcacgtgcctgtaaatcccagctactcaggaggctgaggcaggagaatcacttgaacccaggaggtagaagttgtggtgagccaagatcgcgccattgcgctccagcctgggcaacaagagtgaaactccgtctcaaaaaaaaaaaaaaaaaaaggggcaggatgctcttccagtgagctctcttttccaactgggtagtcatctcattctaccctgcaaaatgacagcagtcctacaaagcctgaacagccagtatacccagaatatccaccactggacagcatggaaacaggaaatgtgtgtcttggcccacacatttagcctgtcccagcctaaccaggctgtttcatgagattggaaatgcaaaagagtgcatcccttaactgccacaaagatcaactgttttcagctgatggttaaaatcatcaaaacatggttttattttaaattttatccccttgcattgtttcacattatcataatccattgtagtgaagtattaccaaatcagtaaaatttaatggaccaaagtcctttcactgtccttcatttggtccagaggaagaggtgaaccaaggctttttgtttctcatgtattctagatgacattctttcccatctcctctcaaccctgaatctaccaactactcacgctacctgctagggaaagattatttatcccccaggcttctgaggaaagtcatccacaaaattggatagtaatagtacctactttcttagacttctttggcaaaaaaaatgaaatgatacacataaagtactcaccagagagcctgctgggagtgagcacacagcaacattagcagcttctattctatatgagctcccctgttcattctcctcaggccctaagtcattcttatcctgtacacataccctagtctctgctgtcttcttcattttgttttccttttctctttttttttttttttttttgagacagtcttgctctgtcgcccaggctggagtgcagtggcacaatctcggcttactgcgacctccacctcctgggttcaagcgattctcgtgccttagcctcctgagtagctgggattacaggcacacaccaccacgcctggctaattttttgtagtttaggtagagatggggtttcgccgccatgttgcccaagctggtctcgaactcctgagctcaggcagtctgcctgccgtggcctcccaaagtgctaggattataggcatgagccactgcaccaggccatttttttttccttttttctttttttcttttttttttttgagatggagtctgactcttttgcccaggctggagtacagtggtgcaacctcggatcactgcaacctccacctcccaggtttaagtgattcttgtgcctcagtctcccaagtagctgggattacagttgtgcaccaccactcctggctaatttttgtgtatgtatgtatgtatgtatgcatgtatgtattttatttatttttgagacagagtttcgttcttgtcgcccaggctggagtgcaatggcgtgatctcggctcactgcaacctctgcctcccgggttcaagctattcttctgcctcagcctcccaagtagctgggattacaggcatgcatcaccacacctggctaatttttgtatttttagtagagatggggcttcaccatgttggtcaggctggtaccaaactcctgacctcaggtgatccactcacctcagcctcccaaagtgctgggattacaggcgtgagccaccacacctggcctgtttttgtatttagtagagacaaggtttcaccattttgcccaggctggtgtcgaactcctggcctcaagcaatccacccccctcagcctcccaaagtgctgggattacaggtgtgagccaccgtgcctggcctttgctgtcttcaaaacacacgtacactccttccttcagtttgtttctattttagctaccagcctaatttcttgcatagccagagactttcaaagtgtgatctaacaatatggactaaaataagccagatacaaaaaatatatgattccatttatattaagttaaggaatggccaaaacctacaaggacagaaattagatatagttacttcatgggtgggaatgtggtagttttgactgaactccggagggagccttttgaagaacggatatattttctattttgatctaggaggtggttatacaggtttatacatttgtaaaaagtcatcaagccttgaaatgtgaccactttaaatggtggatgttatacacctatctaaacaaaaagggctcaagcactatccttcaccacctatcacttgcagatctttcctaccacacagatcttcccttttcaccaccctcttcttggtgaagtacctctccctctttgtgactctgcctctggctcctactaagtttctttcatggctgttcatcctttgtcagctcctatcatgaagctgtttgtgtaatgctagaacttcatggtgatttggctctgctggttgttaagatacctacccaacatagcagggcagaaacccacaggcacccctttgtaaagctgtggcatttactcatatggggcagtgatacgtcctgggactagattaactcagaaacatcagcctagctgtgtatggtgcccacttggggctctgtgtgatggtcaaagggcatgaagtttgtgaaagcctcagaagtagattctcagtgaagacaaaagacccacacagagtgagagtgcatgagtaataatgcgttatctgatgtagatggtgtttgttccacaagttaatagtgaggggtcagaaactgaagtgtgcctgaaagctgcttcgcgtatatctgcatgcctgactcagacgtcctcccaatatttgctcaaatctcaccttctcaagctcttttttttttccttttcctaagaggcaaggtctcattgcctgctctgaatttgtttactattgattcatttgcagagttaaaaaataaatacaaatcagagcttaagcagtgaaaaagcaatctatttctttattccccttcaatactacttatggctctgacctgacctctcttttctttcagggtgaaaaggctgatagcttttacatcatagagtctggcgaagtgagcatcttgattagaagcagggtgagtttatcagtttatatgtgatggtgtacacacaaaaagtaactatttgttttaaataatgtgaagtgtgttgaatacaccaaaccatcattgttatgtgaggtgtgtgactggcaaagacccatgtttaagcccatttagtatagatttagcatatttagattagattagatatagatttagcatattcttattcttgctccctttgcctctgctgtgtaattaatgatttagggaatattggcctacaaatcaataagaaaaagataaaaaccctaatagaaaatgggggctggggccgggcacagtggctcacgcctgtaatcccagcactttgggagggcaaggcgggcggatcacaagatcaggagattgaaaccatcctggctaacacggtgaaaccctgtctctactgaaaatacaaaaaaaattagccaggcatggtggcgggcgcctgtagtcccagctactcaggaggctgaggcaggagaatggcatgaacaccggaggcagagcttgcagtcagctgagatcgtaccactgcactccagcctgggcgacagagcgagactccgtcaaaaaaaaaaaaaaaaaaggaaatgggggctgggcgcaatgtctcacacctgtaatcctagcactttggaggcctaggcaagaggatctcttgagcccaagagattgaggctgcagtgaaccgtgattgtgccactgcactccagcctgggtgacagagcaagaccctgtctttaaaaaaaaaaaaaaaggaaagaaaatagggaaattatataataaaaagagattggaagggatgaacatgaagaaagcttccttgttagagcactgttagaagaggtctctaggataactgtggtcatttaatggatggtgtgacctagaaaactgaggagctgtaagtaggaggaatgactgttactggtaaatctgtcatcaccagatttttcggtttcttttttttcttttttgagaatacagagtgtgttaaaacagttatatataatactaagtcgagttaatatgaaaactttagcaaaatatattgagtaaaagttaataagtagccgggcacggtggctcacacctgtaatcccagcactttaggaggctgaggcgggcagatcacgaggtcaggagattgagaccatcctggctaacacagtgaaaccctgtctctaataaaaatacaaaaaattagccaggcatggtggcgggcgcctgtagtcccagctactcgggaggctaaggcaggagaatggcgtgaacccgggaggcagagcttgcgtgagctgagatcacaccactgtactccagcctgggcaacagagcaagactctgtctcaaaaaaaaaaaaaaaaaaagttaataagtatggaaaaagaagaatattactgtctgtaagatagctggatttgttttctctctctctctttttttttttttgagtgagtcttgctctgttgcccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccagcctggcaaccaagagcccaactctgtctcaaaaaaaaaaaaagaaaaaagtagatctgttgtttcaactgaaaacaatagttttggcctggcatggtggctcacgcttgtaattccagcactttgggaggccgaggcaggcggatcacgaggtcaggagatcgagaccatcctggctaacatggttaaaccccgtctctactaaaaaacacaaaaaatattagccaggtgtggttgcgggcacctgtagtcccagctactcaggaggctgaggcaggagaatggcatgagcccaggaggcagagcttgcagtgagctgagatcacaccactgcactccagcctgggcaacagagtgagactctgctcaaaaaaaaaaaaaaaaagaaaacaatagtttgaaatgtctgtgtcattttacttacagtttttggactagtgatgtttgtagatttctcagatattcattgacacctgctatgatcacagcatagtgttaggtgcataagatcagcagcagcatggcactgggatattggggatgggtggtttgtcagaagttcagagtcctggcttttccccagatttactgaatcagaatgtgcattgcgagaaaacctgcgtaatacgggagctggtgtgtatgtgacagtgtgataagtcccttctgttttagagaagggactaagtgggcacgaatatggctgcaactccagagaatactactgaaattggaaagggaaagttggctcagatgaaacagaccaacttcagagcaacagggcagaagtgtagaaggaagaagggtcaaaccgtgtaagctagtgtagcagttttgtttcttttaaaaattaaccaaaaaggaaattatctttctgcctacaacataaagtggttcttagagattgagactaattcttactaataaattctaaacaattatttacttaaattatcactttggttagcagttggatttgttaaaaaaaaaaacctctagatattaatataatgtagtatattatcttaaatttagttacttaactcttattttaaaaaatgggaggggggagtgcctataatcccagcactttgagaggccgaggcgggcagattatgaggtcagcagatggagactatactggcgaacatggtgaaaccctgtctctgctaaaaatacaaaaaaattagccaggcgtggtggcgggcgcctgtggtcccagctacttgggaggttgaggcaggagaatggcatgaacctgggaggcagagcttgaagtgagcggatattgcgccactgcactccagcctgggcgacagagcgagactccatctcaaaaaaaaaaaaaaaaaaaaaaaaaaaaaaaaggaggagggaaccactaacttaaggtacaaatagtacttaaaaagaaatttgttggccaggagcagtgaatcactcctgtaatccgagcactttgggaggccaagatgggaggattgcttgaggccaacagttgaaggctgcatgagctgtgatcattcctctgaactccagccttggtgacagagtgagaccctgtctcttaaaaaaaaatgtggggggcatgggggattttgtcactgtaaaatgttgttcaaggcgcagtctcaaatcagagaaatagcccaagtttgtggctcattacctaagagaagcattgtccttatttagacaagattgggcatgttcagaatggtatggctgtagattaccttgaaaatgttaggactccgagctctaggtaaaaagcagacttttctgatcaaaccagaccactgagattagtccatggagtttacatggtacagttagtgaattttctgcaaagtgaattcctcagtaattgtgtagagtatgctgagaacagtgtatgtgtgtgcaactggacatgcccagctgtgatcctggagtcagcctaggtcatgttctttgcctgctgtagactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttaggtaagaaaagttctttatgcattaatattctttttctaacatgtaatatttttttcccatcagcaagccttgacatattctgccatcttttactgctgtctaggcctaggcagtttatgtgaccaaccagagatggatgaatggatgctttcagcaaacatttctgagtactgatgacagcctgtgagcaagacaggcatgcaggttctttagccgtatgaaaagaactgatgtccagggctgtgggagaatggggagaacaggagctgctggactctgtaaagtctctaacctggatgacagtcttctgaattcatatagaaacatccctttttgcaagtggctggtgtcccaaggcgtaatctcatacaacatgaatgggtatgtttaggaaaaggtttgcatgagggaaatggcttgaattcattctctccctcacctctttttaacaatgcagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattacaggcatgcgccaccatgccgggcgaattttgtatttttaatagagacagggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctc

SEQ ID NO: 16695 - DNA, 21513 bp, Human
aaacaattagtacctgacctggcatgatgagcactcagaaagtgtcctaattattaatatttttatttctgttttctaagattattttcagctggtttataatgtttgtgccttgtaaagtatttagtattcttaaaattggatgtaaaatcatatataaaaatctaaacactatatcaacatataattctaatacttttaaatgtttttacatcaatcaagaatcatatgtgtgaaataatgaccttttgggctttgactcttgacaagttttcatgatctacaaaaattactcaattcataattgaagcaattagatcagatatgcttgtccaaattgtaggcaagtgtgtgatgtccgtaatgaccccaaatccctccagtgaacaggtgccagagatagcacaaaataaaaagcaaattatggaaatatctgtgttgggaaggtgggggtaggataggaattgctatagtaattttttttttaccgttaagtctctatgcttgtgcctatattacatatttgaacatatgagtaccaagctatatttgacagtaacttaaaacatattttttgaatgttaaaaccactatgacattttttatcatcaaactgaaatattaaatttcttcacatttgccatcagaaggcatcttttaagttacatttgtattgcacctgactacattctagattctttagctagagagaaaacactcagttcataaaaactgaaagtgaattgccctgagaaactctgttgaaaagcatatgtatagcacacaaactggaacatgaaacctgctaaatgggaggtaaaaatttgatttaaggatgaaaatgaaagttaatttagaaaatactttgatttctggaagaatctctttgaaaatatttatggttgtgactctcttaaatattgtaaattttatgtactcttctctattcttgaaatcaaattctacaataaaaaatatataagcaaacaaagttctgaaatgtgacaggtttccctcttactaacaaagagtaaataaatgacaaattaatttagtataataaaacataactattaaaatttatttagacactatcactgtttaaattgcattaagatccacttaaagtttctgggtgaagctacatatgactaaaccttataatttaaaaatctaaatgtgttcattttaattgccattaatattaaaaattttgtcctcttgctaattaaaaatttccagttttaagcttagagtaaattaaatctcctactttggcaaagttagatgagaatttggctgtgaggatgaaagatgttaggaaaaatggaagattaaacacatgcatctacttcccctacatctcaaaactccattaaaaaacagcaggaaaggaatttttaatggtaaaaaccagaaacaataaggagaagtgaaaaggagaaaatgccaataaaactagaatccagaaagcaagtagatctgtaaagacagcccatctgaaaaaattgtattaaaagcctgtagtaagagaagatgaaaatcatagtatctctcttattcctcccaatgttgtagtaatcatagcacttcattgtgattatctttttacttacctgtctcccccactagactgcaagcctcacgatataggaaatagggtttatttgtctttgtaccctagtgcctagctactgcttgtttcacacaaagtaggtgctcagtagatgattatgggactaatgaatacaactcatgttattgcgataaatagtactaataatgacctctgtctctcatctattcaatgtgttctgtaaaatataaactgactactctttgtttggttttgccttattattaatgaactggccttgctaattctgtcaatcctattacttgttcagagctatttctgcaagggtcatcaatatctggagattttaaatctgagcttaaacctattgaagttcaagacgagttcagtagacagggattctcacccactcaacaaggacaccaggcacagagatccaaactgtgagtccacaagtagtccttttgataatataattttaaaaattttaccttaggggaaagaatggtgattcactgtttatgtattattgtgttaatgtaaaatagttcaaagtacataaggttttgaattatctactataaagacaattaaatacagcgtatccttctctctttcagtgatttccaccagtcatcttcactaatacagattcagagtaaacacgcaattttgagcctgatattctagactgttaaaataagaccatgaatggagaactcattttgcaattttaaatttcctttgagtgaagggagaactaaagagaataaatgatgagtccttgcactttatgtttgaagatctggctcccaagttggaaaaggagtgcggtagttgccccttatccaagggggatatgttccaggacccccactggatgcctaaaaccatagataaaactgaaccttgtgtgtatactatgttgttttcctgaacatacatacctgtgataaagtttaatttataaattagacacagtcagaggttaaccataatcactaataataaaatagaacctttataacaatatgctaccatcacaacacttgcgctttgggaccttattaagtaaataagggttacttgaacacaagcactgcaatagtcaatctgataaccaagacagtaatgcatatggtgtggatatggtatacaaagagatgtttcatgttccaggccagagagagcaggatagtgtgagatttcatcaagctactcagtacactgcaaatctaaaacttgcaaattgtttatctctggaatttttcatctaatatttttggaccaaggttgaccaagggtaactgtaatcacagaaagaaaaacctcagataagtgaggactgctgtattcatccggcgctaaggcatgttttgaggcttttccttagtagtatgttgttgtggcggtggtttgttggtggtttttaatttttaaagtagaaataatgtttgttttgaaaggttactttagaaatttaatgaaacagaaataatgtttttaaaagaaaagaacacagagtttgttgatatttcttaaattcagtgaaaattttctttcaattggtttttttttttctattttgtttccatggaggttattattattactaataaaccttacagtttgcatcatgaaaatgagtgcagtaattgatttgcaatggagtatttttattaactgcaaaaatagcttctaactatagagtccattttaaatatatatatatatatatatatatatatatacacacacacacatattgtccattgtacctgctacttagaatcacctcatattaaagctagaaaaaactttagagatcatctaattcatcatgacaatttctgcccaaatactatgtttataagtggatttgatattatataagtcattatcaaaatatatatgaaccattcataataatgtctgtaatggaattcaaacaatatgtacaggaatatgtatatttacaagataaacagatactttaaaaaagatggctgttatgaatttctaaaattctattttctccagaacaagtaaaagaatatctgtatgtctgcaatcccggcacctcgggaggccaaggctggcggatcactcgcggttaggggctggagacccggccaacacagcgaaaccccgtctccaccaaaaccagtcaggcgtggcggcgcgtgcctgcaatcgcaggcactcggcaggcttagagcttgttaaagattcctgggtcccacttcagatctgcaaagcaggatcttagaatctagggcctgaaaaggaggaagggtcctggtaaatatccccaggctttctttttctttttttctttttttgagttggagtctcattctgtcccccaggctggagtgcagtggcgagatgtcggctcactgcaacctgcgcctcccaggttcaagcgattctcctgcgtcagcctccggagtatctgggactacaggcacccaccaccacgcccggttaatttttgtactttttgtagagatggggttttgccatgttgcccaggctggtcttgaattcctgcgctcaagtgatccacctgccttggcctctcaaagcgttgggattacaggcgtgagccaccgcgcgcagcctctccaggctttcagctgggaccatgaagggctccactctttgtggtgatgatcagaggggcgtatgccctccataacactcccattcttcatcttttctcatattccaggagactggcccaaacaggactgttgagtggctctaaggcttttagacgtcaaaagggtttataagaataatcatcataatatagttatgaatcagaaacatgcatacattttcttaaatgaccctgtggggactggagttaaaaagggaggagtacccagatgcaggcgtctagcagaatggacttgcttgagaatatcaagcaagacagccaaagaggactcctaggattgtctcaccaggacttctgaggcgactctaatgaaatgacttaaaagtgtggtggagtggcttctgtggctcccacacctgcctaatcctggttgatattgcacaaccagcgtgcactgacaatctctgggaaaaaagcaaggtctaatattcaaagcttggcaaacatgaccaagactttttctctttcctttgaattattttagttccctaattttttgtcccagatgccacttaattctttttattttgtattaaaagttgtgctcttgtctcaaccttctttctaaaaaaaaaaaaaaaaaaaaaaaaaagaatatctgtatgtcataatagcaaacttggataggtggatgtcttttcactaggaacaagaattcagttatgacttttaaagctcatatttccagagtaaatttttttttactgatgatacaggataacagataggaaattgatatttgctatgcattcctgacatactaattgtttaaaaggctccctacaactcccctgcccagtcccatttgttgaaaaagcaaaactatttgagtagggtagaaacagaaaatattacatcagttctatagtgtcttatatcaaaatttctatcatagtttttctatcaaagttcttatgaactttatctagatactgggagtggggggaagtcaggcataaagtaaggaaaattttcaacagcatcaggatgaatgttttgtatttaaaagaaagaaaacaaacatttgctgactgccaacaattttctaatttgttatagccattttgaggaccatgtgtcctgtattccactcatgcgtcccaaaatttaattttaaagaaaactcttattatgataccaccaaatgtaaaaattgacctatcccaaaattaacaactaacataactgaaggtggcaacaaaaatcctaagtattgtcttactccattagagaactgaaattcagaaaagatatataaagcattacaacataaatgcaaaagggaaaatcaaacagaaaatcacttatgatccgcaaaatcatgggtagggaagacaattcattggaaaacaagtatgctacattcaaattaaataatcattcccattttccaattccaattaattcaagaaattaattgttatgaggcataaaatcccctgtgtgtctcttgtggagacactgaaagtctccacaagcccagtaatactttcatgatctgacatggtgttgtcaaacctatctgatatgaaattctcaccactgataatttattttaacaagaaaggaaaggcacaactgctttctatagagtccaatatgacattggggaagatattcttggaaggggttaaaacacttcatattaatgtgtctgtattggtgagcatattagcttagcttagttgatcagattagctcacagtcaccttagaaaacaggaaagcagagacctaaggagatgtatggttagaggtagagaaaagtaggacgtaaagccctgcaagggtgactagaacacagtgtgacactccgtggggcacagatcaagataccaaatgtagatttctagcaatagaatgaagtagaatgtctgtcaattttgcccacttagcagtttttcttagttttagccatctcaaagcatagtatgtgccaggtagtgccttcaagatagataacttactaaatttcacttcagttgatttaagaggcatttcacttccgtacttgatttccagtctgctatttttatcccatgtttaatcatgttcagtcattacaatgcctttttagtgcagcaccttctctgaaacagtttcttattctatgtgtttccaaaagggaatatgaatatatgctctcatgtaaacgaaagaaaaaatattgtttattttaaatttaacaaaacaaaaaacaatcttactctgaaaattttacactggagctacttcaatgctctatgttttctgcattttgtacatccatggaaagatgtcaggtatgctataggtaaatagataatttaatgtttggctgtttaatttctttactttgtacttggggagaccagtatgagaataagactgcgaaagcctttcatcataatttgcaaaaagaaaaaaggaataaggatacatttacttgaacctcaacccttctaaataaaatctattgtttctactgagcatcaaccttttagtttgctagggatagtaacagttattgaaatgctaaaaatattttttctctgtgtggaaaacattgcatgtgatatattttttagatgttctactagttacttgatctgacctggactaaagtgagtatatatgctgtatactaaatctgtgtaccacttttctgatttacttttttagagcaatacccttaattttactgcagttagtatagaatactattattttccttaacatcaaaacaagccagtaactggccaaataagtaactggcatttgtattgcctaacatgcagaggaatactggcatgcatatatatatatatatatatatatatatatatattttttttttttttttttttttttgagacggagtcgcgctctgttgcccaggctggagtgcagtggcgcaatctcggctcactgcaaactccgcctcccaggtctacgccattctcctgcctcagcctcccgagtagctggaactacaggcacccgccaccacgcccggctaattttttttttttttttttttttttttagtagagacggggtttcaccgtgttagccaggacggtctcgatctcctgacctcgtgatccgcccgcctcggcctcccaaagggctgggactacaggagtgagccactgcgcccggccactggcctatatttttgtgggctcttctgtggcatcccaggattgggggtccacaggcatggaaagaactagtgaatagtcaaaaaaaatgaaagagttaattttaggtatgcctcatttccctaactgcaattttaaagggtaggtggggaaccctgaaaaatccagaggctcaaagctttagaaattaaagaaaaggcaggctatggagatagagaaatagtggacagcatcagtgtaaagtcattctttgcaaaagtcagaaccaggagctatgaactgaattatattccctcaaaattcatacattgagcccctaacccccaatatgacagtatttagaaataggggctttgtagaagaaattaaagttaaatgaggtcaaagggtatggctctgatcccatagaattacaagaaaagacaccggggagctaacccactctctgtcatgtgaggtcacagtgagaaggcagccatctgcaagccaggaagaaggccggcaccagaaaccagccttactagatcttgattagagacttttagcctctggaactatgagaaaattaacttctgttttttaagccacacagtctatatttcgttatagcagccctagcagacaaaggtacctagcaactgtgtttatttatgacttctgacaaatagaagagtggcagaaagtttgagagaatgaagtgttagttttcaaacataagccacacactgagattttatacaaaacttgggctagatcataaaaagcttaagaaacaaatagacttattttagaaattgatcttaaaaatccctgaatctgtagaattgtaacttcaaatacattttaaaaatcaaatactattgtttggaatataggattaatttttttattggttgatatgaatccatgagtgaaatatctcactttacaatataaatctccacacaaagctcacagtgtaatggttccataatttggccacatgtaagagtagttctataaagaacatttcctagctttacttttatgtataattgatgcatactgcatattacacttgcttttacaaatgacctagagatgcaggactgatgataagttctcagtgaattcatatgattgtcaaaaaccaacagtatgtcttttatactgaccttccagagtcgttattagtcagttaaaattaattccattaacatgaaataggccaggtgcggtggctcacgactgtaatcccagccactttgggaggctgagggtggatcgcaaggtcaggagttcaagaccagcctggccaacatggtgaaaccccgtgtctactaaaaatacaaaaattagctgggcatagtggcgtgtgcctgtaatcccagctacttgggaggctgaggcaggagaattgcttgaacagggacccgggaggcagaagtagcagtgagtaagatcgcaccactgtactccagcctgggctacggagcaagactctgtctcaaaaaaaaaaaaaaaaaaaaaagaaagaaaagaaagaaataaacagactcttctattacattcagtataaactaatgaggtttaatccaaagcgaaaatatatcattcaaataagtactgtctcaaggaatttagagacatggtgatttattgctttccatttcctcatcttggttttaatgcatatacaaaaaaattaggtcggcttctttggttaacacattcattcattaagcattttattgaagtggaatggcgtaatggaaaaaatagaaattttggagatttgagagtcagagatttgaaacctggctctatactacctttgtgagctctggcaagtcactcaatctctcagagtctacaattcacctctgaaaaacaaggataatagttttgtgtggattaaaaatagtatctagagtaccccgcacatagtaggttctttaaaatttgccactgtcatttatgaagtatttacaatgtatgaaacgattataagaggtacaacaagaagtaaaaaattgcctccatcctcaaagaatttacaatagtggagcaaaacatgtaaaaataaatgctataagttgttgtggatgctaggagagaagtcagtctatatcatacagtgattagataatcccaactatttgaaaatctaccaataaactacaatagctagtcttgaaagctaagctcttcttaagcaatactgagaatatacaagttaatttaaaactagatattctgattaaacaggtttgaagtgactaacaattgtcatgtgaccaatgataatgatgataatgaaatgtttaggggtagatttgtttttttaaaagagtcttttaaaactaatgcgtaaaaattttactcacttcctttgtattccagatcatcgctatcataaatgaaacaggaacaacatgcaggaccatttatatttgaatcattttatttcttggtaattactaaaccatagttgggaggtgttagaattttgaggacaagatttgagaagtgttatcctatataaagtactatttaaaattattaaaaacctaaattaagaggaaaataaaaccctaacttggtaaaattctattttaagctgtatttctcaccaatattagcttttactattactttcgaagagggtgataaaattcttttaaatgcacattattctgtcaaaggatccatatacaatttttacttaacacaggttttcattgaaacagtattataactatttaaaataaaaaagtacaaaatcacagattttcataattatgtgatgtggaaaataattcatttgaaccaaagtaaatcttggtgaaggcaagatttttaccttctgccttcttgccttactttattaccaatttccaatcacacaaagatgtgcttacccaaagacctgtaataatcctattgtcattttaaatgtttcagcctaaagtagacatgaaatcttttaaccatgaaataatagcattgtaaatgaaatgtttatattttttaaatgactgatatattgcatacacatatgtaaaagatgtatttttattttatctaacagactcatagagcagttattatgtgccgaaattgaagcaccttgcaaatatttcaattaaattacttgtaccagctgggcacggtgccttatgcctgtaatcccagcacttttgggaggccaaggcaggcggttcacttgtggtcaggcgatcgagaccagcctggacaacatggtgaaaccccatctctactaaaaatacaaaaattagccaggtgtggtggcccatgcctgtaatcccagctagttggaaggctgaggcacaagaattcttgaacctgggaggcagaggttgcagtgaggggagattatgccactgcactccagcctgggcaacagagtgagattctgtctaaaaaagacaaaaaaaaattaattgtatgatgctaatgtgtacattttgaaaaagataagatttttgggataatcagaaaaccccagagtgagttggtgacaggataaattaataggaaggtagatgaaatctattaatggctcataatattctacttgtgtcttcctctaggtgctttaagcagtgcaaacaaacacactcatgtcttaatatttttctttcaatctgttcattgcttccctggcagtaaacagtagcaatttttgccaatccttgtactctaactcaaatggaggcattagataaggatggactctgtcctttacttaaacaggcaacccagttgatttaagtcttagtattagtgagcaccatactggaagagttttgttcttcatgtaattcagagcccaggaaaatgcctagcatatagtctattctcaacatatattaatccaatcaacaaatacattttgtcctaagtaactggattatcttttcattaaaggattccttgaaattggtgaaaaccttttctggaaaaggaatttctttttcccagtagattgtcaactaggtaaacaacaagcaattcaagaaggaagctgtgccctgtatcttcagcatctgaaataaaattatttttagattttcttgaacttatgtatatttactgagaatagtagctaccccaaattaacaatccagtcttaaaaagtaaagagactggattgagtctctatttttctgggaactgaaaagctattgaaattatcaaataaatttccatttctttgttttgtagttttctttcgaagtaaaaattttcatgtcttttgagatgcaaaatttattcataaataattacactaagtaataagatggcttttctgtacagcagtttttactttccattttccattatgctttttaattactaaatccattcaaatgtaatattctttattacatttatacttacctaaacattgtgaaattgattggctttcccttgacagtcttttcttgttcaagtggaaaaactcaaattggcaaagacatttgacctccagtgattctggatagggattgcaaaaagagaaacaaaattacaggaccagtccaagtgttgagaccaaaggtaaaggcaaaagagaaatcaagaaagagttctgtgttaccaccctgcgccttgggaaagcaccacacagaccaaatgcaggattgaagtgtaaatcaatagaaaactaagatgagtttcaaagtataaactgtgcgatatagtgcctaaaactgacttcgaaagaaggaggcaaagcaaaaaaagtgaaagaataaagtataaaaataagatagtttatctacgattagtatatcctccctgacttgaaaacttcaggaaaatcacaactatatggacccctgagggaatatgttagtatgtataataattgagttttctggatagtccaaagctaaaaaaggaaatagatttgatatgagtgtgaaccagatagaatgaaagaatagattctacatgcgggcaccaaggagtttcgtatgaataaaaatccaagtgcttttagtgattttctattttagcctgtcaaaaatactataaaccggcagggtgtggtggctgaatcctataatcccagcattttgagaggccaagatgggaggatcacttgaggccagaagttcaacactagcctgggcaacataccaaaaaataaaaaaaaacattagcagggcgtggtggcgcaaacacacacctgtagtccccgccgctcaggagactgacgtggtaaggtcacttgagcccagaagtttgaggctgcagtgagctaaataaaacagcaccatcgcacttaatgaagcctgggagacagagttagaccctctctcaaaaaacttaaaaaaaaaaatactataggcttacctactggctatttccatttgcttggtggctactgttgtcatgaaaacttgtcccatggtatggagagatgctattgaatagtgttccttagaccatcattttttaatgccaattcaaagatttgatttgccaaatcatactgagaaaaatgactctattatagaatgttaatttccataatagtgtaatgattaagagttggctccaaagtcagaaaatgtaggttcaaatctttgctccaccacttattgtatgatcttgggcaagtaacttaaactctctgcccttcagcttcctcggttacaacatgtcattaacaattgttcctaccacatatagctatgtgagaattaaatgagttttgacacataaaataatttaaacaatgcctgacacatagtgttcatagcaagtatataattattaatttaatttttattatatgaaataagtaacatatattacgtcatatattcaaatttcacataatattaggaaattaggaaaatcagtaataaataatgttcactaaccacatagacttaactggaaggcttgagttaagaaaagacaaatgatgaattatataaaatccttaagtccagacatctttaataacacatgttaaattaatgtccttttacattgcggacagaaacattctaaatactttaccacttactttaccactgagtgattatccttagcctacttatggaatctggcagcaggagactataaatatgcatgtacctatatatttatctctatatatatgtatgtacatcctggaattcttgtgtcattattatttctttgttcctcctatagattatatcaaatccagtccctaaaatggaagaagccaaaagccaaagtttggaggaagactttgaaggacaggccacacatacaggcaagcaaagctagaagaaaaaataattattaaattaaaattaaatatggcaatatctaatgttcttattgacactattcagtatgtactttaagtaatatctttatataaattgttatgctaatctaaaaaatatttgagcgggcaaattaatttttgaaatcaaataattcctaacagttttatttagatgtcaaagagtaaaaaaacaaaaacaccaattactggtaatttcttgctgcccagctatcacaagacctcttatctacactataattaagccactttcctctctcctgattgtaccccaccctcagtatgaactttcattgtaaacaagattagaccaaaaggttaataaatggcctttaatttcatttttttcatctaataaagggaatgataagatattccctttatttttttgaataaataaatttcagtattcctccagaaaacttaacacttcatttcatccagagtctgttttcttaatctgttaaattatgtttggctatctatatgccactcctaagagcttaaaacttaaatttaaaaattcacatttaactctactaaatcttatttgaatggtaatttcctctctcttttaatttggattgagccattaaatttagccagaagtttgaaagaattcacaagagtaccagccaaaatgtgtggagatttattttataatagcaatgtgaggaataccttcctaattatgacaaaaacaaaaacaacaacaaaaagaccattgaagaaaaggttggtaaattcatttataaaaaggaaggaaggatggatggatgaagggatggagggaaagtaggagacagggaaaaaaaggaaggaaatatctgctgtctggtaaaggtcaccaggaacaaaagtcaaaaagcatttaacaaattggggaaaaacatttgcaactcagttgacagtgtcagtttcctaatatatattaagagcttctacaaatcgataagaaaagaaactaattaccaaatagaacaatgagcaaaagataggacagactattcatggggaaaaaaagaaacagaaaaaagtaacacagaaaactatagtgaaagcaagtaagtttaataacacatttttggcaccctcatacattgctgatagcagtgtaaattggtacaatctctgtacaggcaacctagcaatatcaaaattagtaatgtatatgccctttgaccagggaattttacttatataaccataactatacctgcacagagtgttaaaaatgtatgcacaagattcttcactcagcatcatatgtcatagaaaaaactggaaacaacaatgtagatcacgattaaacagtttaagtcaattatgtatatctacacaatggaacaccatgcctcaattttctaaataaggaagaaccttttcatgtgtgtatactgaaaaaatctccaagatatagtatgaaacagaaaaaacaaggtaaggaaaaatgcagataatacaccaccatctgtagaaaacacgaacaaaatggattctcttttttaaacaaacatacacacatgtatattttgcatatgcataaaacatatctaaaatattgatatgaacactgtatgtgaaaacaaaaagctttgattgcctgcatataatataaacacattcataacaaatttatattaaatatatatcatatataaaacaaaaattattaggcaatatagaggagaaagaaggaatacatccacatatagaatatgatatagaatatggacattaaaggtgtagatatagctaagctttagtgaaggatagtcagtttaatattccttgttttaaagaatttaagactttcttaaatgaataacgttgttagtcatcaggtcaactgaatatcagaattccagttgaatcatccttcatttaattagttttacttaaatctgccaatctggccgggcacagtggctcacacttgtaatcccagcactctgggaggctgaggtgggcagattacttgaggtcagcagttcaagaccagcctggccaacatagtgaaatcccatctctactaaaaatacaaaaatcagccaggcgtggtggtatgcgcctgtagtcccagctactcgggagactgaggcaggagaatcacttgaacccaggaagtggaggttgcggtgagccaaaatcacgcccctacacttcagcctgggcaacagagcaaggctccatctcaaaaaaaaaaataatctgccaatcctattctttctatgtttgcaaaatatgcctagaatcttagaagaatgggatgttctcgtaataattttcctaaagccattttagttttgttgaggtcaggccccctgctcaccagttgttttttatatactattgttattttgtttccccaacattcccagtttcctttattaatactgtaatgccaattttagtttgttgctgaagtttttttcttaggtaataaaagtgctattttttccaaaattctagtatcctatcaggactctaatttttaaatatattaaccccaaccttttgccagtagttcaaagtgcataatttatattttcattagtacaaatgtttccgaaatatcctttaccaaaacccatttaacaagattaatgtgggagcatatttttatgagcagggcagtcagaaatttctagtccaaacaagatgtttgtttctgatgcaggagacaataagtttattccatgacaatacttacacaaatttcaattatgccaacagtccttttgaaaataaaaaggaaaacaatttatttttaatttcattccaggacccaaaggagtaataaatgattggagaaagtttaaattagagagtcaagacagtgattcaattccacctagcaagaaggagattctcaggcaaatgtcttctcctcagagtaggaatggcaaagattcaaaggaacgagtcagcagaaaggtaagataatacaaaaagcagtaataaataatttacaatgtgttttctaatctaaatcaatctagagaatcactttagactattacaaaatatattcattacaatattgcttacgctggcaaaaaaaaatggaaatgaagtgaacacctattgtggcattctatactaagaacaggtacagttatgaaaagaattcgttacgaatacatgagctgacctagagatagtttcacaatatgagaaagcaacatacagagaattccatctggggaattgtaacaaacctgctccacttgttttgaaaacatgtaaagaaaaaataaatgtaaaactattttgaaacatgtaaaatactacacaaatgtaacacataatcactattaaaaattttatgctaaggttaaactttggaaatgtatctgaatgcctacatatccatatgcctgaatatgtgaatgaaacaagttttcatataaatgctcaaatacatcttcaagtcaaatttgtgtggtttgatctgttaaattaacagaactatagcaacaacttaaaaattatatgaaacattggaaatttttaggattaaaactaaattgggacaatattattattattattactattatcattttgagacagagtctcattctgtcaccccagctggagtgcagtggcgcaatcttggctcactgcaacccctacctcctgggttcaagcgattctcctgccacagcctcccaagtagctgggactacaggcatgtgccaccattttttgtagagatggagtttcactatgttgcccagtctgttctcctgggctcaaacaatccaccttccttggcctgccaaagtgctgggattacaggcatgagctcccatacccatcccgggacagtaatcttaaaacagaaaaaaatatgataaggaaaagaatgaggacattagggaaacaaatataagaaacagaagcaaaagaaagaagtaatgaaagcatcataaacttttacttaacttaaatctcagtgtcttctgtaaaatgacactaatagtacctacctcagaggttatctgtaaggattagataacataatctacgtgaagtacccaacacctggtatgtttttcataaacattagtttcacgtgttctcaattctcctctactttaaaaatccatggttctgagctgctccacatctattaatcacactatgccccattgttcctttatacctttttttcttttttggttgggggaataggtgcttaatattctgttaaatacattaataatggagtagctattatggaaggccctgcaggtgactttttattccaactgcaatgaaaagtagctatcttagaaaatggaatttgggccttttcttacttcagcccaaactagtgaataataataccctggagggcttgttaaaatatggattacttagcctcactcttataggttctaattcagtaaacctagggtggtgcccaaatatttgcatttcctagaagttcccaagtgatgctgatgctgctggtccaaaaattaacctcttggatgatctgatgaactccaaatagtaggaaaagctgtcttacttgaattttttggatattcaaaaaaatcagtaagttataagatataatagtgtttgttgctataaagaaaataaaccagcataaagatggagagtgtgagatggggacctttttaggtaaagtaatcaaggaaggtgacatttaaacaaaagcttcaatgaggtgaaagagaaaggcacatcaggagtgaaaggtaggtggtccaggcagaaaaaaaagagcaaaagtacactccttcggttgagaatgggcttggtatatctaaggaataaaacttctgacttaataatttctatcatttctttattctcagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatgaagattcactatgtcaatatctcatgtttatcctttaggtattggatgatggttttggtagtatctatattgctttagtgaacacagagtatgggcacggctatgctaacttgacaaaaatgactgatgcaacaatcgagttattagcatttcttagtattagttactcaaattgatacaatgcttgactacaaaacagagctgtcttcagcaacattattagtagacaaagaggatgtggataatattatgacatttttcaaaaatccctttcaagttatgttttgtcttttttactccattttccctcatcactgttattatttggacttttcaaattacattattcattataattttctttgtgtaataaaaatgaaatctcatgagaaaataaattttctatttgaagtctattctttctcaagcattacattaccaagaccctaaaaacattataaagcccaaaatacaaaatatcattcagtaaaatatcttatattccaaccaaattaatgcataagaaacttagaaacactgtgccaagttaaagttgtatttaaaaaaggaagcaatatgtttttattctctgggtgtaagaataatatttagtggtaataaaattacaatattcatttgttgattgcctattatgggccagtattttatacatatcatctctaattcttaaccacaaatctgtacatagatagtattactcccattttataaatagtaaaacagagaatcagagaagtgaagtgtaagttctacttttatttcccttgaaaacatttggaagtctctcctccaacacaaaaacgtggaagtgaaaaataaaatatgtttaaatgtctttaaatgaacaatgagatgaagagcaagataaaagaaattcctaggtgtctgaatcacagtagagaaataatggtgctgacataatatggcctgcaattaaagatatggtacttgataagtacccaaaaaggggctccctgtgagaaatctgtttaaagcaggtttgcacaatttcctgtggcagcctaatgttgaaatcagacatttgccacaaagtctacttttcactctcctaaatgactattgttatagcttgtctcctttccataagccttttatatcactttcctccacttcaaacatttcatcttactcatacttcattgagaaaacaaaagatatcagatgagacctacttcatctttccatcaccagatctaaagtggacagctgaagtaaacactgtttctgctgatgtcatgatggaagaagtgtccattctatctaatgccaactgatcaaactgtgctgtgaatcctactctttttatccacgtagtaattatttctcctgcaattatgactcccctctctgcatcatctctttcttccttctctatgttgtattatttatattggcttacatgtgaatttttaaatagcccactgtttaaaatacgcccacctataacttaaattttccagctatcactcacttctctttcctttacaattgtgtctctcaaaagagatatctaaagtcaccatctttattcctcacttccaattttttttttcatctcactccaagcaggcctttgttccaagtacttagagtcaaacttaatagccaattctcattccttattttttttctccctcttaaaaacacgtgtcatagttgactattttctacaccacaacccaccctgttttttttttttttctttttctttttcttttttttttttttttgagatggagtctcactctgtagcccaggctggagtgcaatggtgcaatcttggttcactgcaacctccgcctcccaggtttgagtgatttgcctgggagtagctgggactattggcatgcgctaccacccctggctaatttttgcatttttagtagagacggggtttcaccatgttggccagggtggtttcgaacccgtgacctcaagtgatccacctgtctcagcctcccaaagtgctgggattacaggcgtgagccatggcacctggcctcttaccctttttaagtcacttctttggctgatttgaaaactcactgcttgtttgctttctattccactgactattccttccaagtttcctttgctgatttatcctctaaacaccccaggtaacgtcctccagttcataatcttaattaccatttatattaaggccactctcaaattcacatctccagttttatctctgtcctagactctaaaatcctatgtctcaattgcaggaagggaagaaaggaggaagcaaatggtgtggcagtggaggggaagaaggtctgcgattgtactagattttggtgaaacaaaagtgggtgagatagaactcctgactgtgact

SEQ ID NO: 16696 - DNA, 21513 bp, Human; identical to SEQ ID NO: 16695

SEQ ID NO: 16697 - DNA, 21513 bp, Human; identical to SEQ ID NO: 16695

SEQ ID NO: 16698 - DNA, 21707 bp, Human
aaatgtggatgattatatttaactttaagacattttgtgagaattaaatgcagtacctaccaaatgagtagtagacagcagaatccagcctacaaccatgtggttcactgaacatgttttcttttttttcttttctttttttttttttgagactgagttttgctcttgttgcccaagctggtgtgcggtggcgtgatctcagctcactgcaacctctgcctctcaggttcaagtgattctcctgccttagcctcccgagtaactggaattacaggcgcctgccaccacacccggctaattttttgtatttttagtagagagggagtttcaccatgttggtcaggctggtctcaaactcctgacctcaggtgatctgcccacctcagcctcccaaagtgctgggattgcaggggtgagccactgcacccggcgtgagcatgttttaaacatataacattggtgaaacaactgggctgtatgttggcaatagactaacatataggtgttggttgtccttagggaaatcatagtctgttgggggtgtgagacagatgaagagatattttagtaaaacgtagtacaattgtttactataattctagatgtgattggaatttgatctggaaaggtttcagggaggtgctaggacatgagcgaagccttatgttggtgggtaagattttacaccgatacattccgtatgaaagtggggtaaagccttgggctgagctgacttagctctgcaatggtgatggttcacattttcattgtgggaaggaaacaaaattagtaatttaaaagaccttttccaaacatgcttatcttaaaggaaggatctaaggaaaatatcaatacattttttaagcagatttttaaaataataaaggaagctagaaaatccagtgtcaataatctacctgtaggtaactgagagcatgttttctgtgctcagagaaaatgaaactactcaagaaatgtatatttgatataatggtataagtatataaaatgtatgccacaagctaacactaggtaaatttcaaagctacctttgctagatttaactggaaagcagaagaaataaatgataccagtatgtgaatattttaaagttgctgcttcaatatactagtcaaagtctgccagagctatttaccatctcaggacaatttgttcacttcacttagaaattagaaatgtgctctggccaatacatctaaatttattttgtggtagtcattttgcttaatggaagtgttttccagatgttgcctaagtctagtcgtctgggcccttttccaataaatgaggaaagtttgatttcataggttgtcactgttgattttgtctaacctttggactaattggttcatcccactgtatttgcactgatatataagactcccaggacgtgggataaactcatctatcctttacgggtaagtgtcaaagttaacttgcttcatagaattaaatgtgttttcattagaggtgtttgaaaaaaaatgtgtaaagatagtagttggaaatttttgaaaaggattatgtttatgcaatacacctgttggaagcctttgaatttatattgagaattaagaaaaagttggaacagtaactccatgatgcttattaaattacatttctgtgacacaggttattattttccttaagataaaattttaaccttgcactgttaagtacatgccatactttggctagagttttaagataagtctattctatattggagatttcttaagaattaaaactgtcaataacgtggctgagggtgacttgatttgttctgcataagattaagtctaatggccaaatattttctataaaattaaagctgatttaaagtcttgtttcaagaatgggatggttttattattgttacatttttaaagttactgaaatgtgtataatgcaagcctaagttagtggtgagatgaaagagcagttttctgatacttttattttattttcagcaagggtacctacggtacctgaaaacaacgatggcatggaaaacacttcccatttacctgttgttgctgctgtctgttttcgtgattcagcaagtttcatctcaaggtagcttaaccatcgaacatacttttatttaacaactattgctaatcattcagtcttgatttttataacaacggaaatatatttctaaaaatttatatttgcttgagtttaatatactgtacaaccttaaaataatatataacatgtagcctgtttgtaagtgctttggaattctcatctttttctccttttgagagttttgagcttgtgtaaagaataattttggtacttgttatttctatggttctctcgaaagtttaaaaagtgcagacagttcatcataaaattatgctggagctatatagtatcataaaaataactaaaaaagaacaatatttagataacatgtaatttttgcctatatgttgaacaatttgttttttaaaatcaaataaattattgataaataacttattttggcatcatttagacatagataccatattataataaactatagtgtttcaaatggcattttattagtcttgaaaatgttctctttttcttacaagaactatttatccaggtatggacatatacagatgtgactgtcattttgtgttataacattaaacttttcacagttctcccaaaacaggtcctggatgaatagttcttgttactcatttttagagactgttaaagtacattcagtgaaatcacattagtaaaagatgctagcatgccatctagggggattaatagtaacaatgccaagctttggatttttcttttcttttcttttccttttgttcccctttgataagcaaaatctgagagaataaaaatcaagattcatgacagttatgatgaaattatgtttctaaagtaaacatttccagtaaaatacgagattcttatgaaacctgaacatgagtggtaactgtctgcataggcataagttgcagaattgtttagataagaaaagacaggaaaacacatgaaagcaaatgtgaatattcaataagaatgatgactactccagtatctccagacccttcggctttctcgtaacaatatgacaaggttcacaacactgggggcactttctaaactgccttttcctctgtgatacaattggttgttcactaaaacagtgttactttcattttaattgtgattaaataaatcaaattaaaattaatggggctgggtgtggtggctcacacctgtaatcccagcattctgggaggcctagggagacagatcacctgaggtctggagttcaagagcagcctgggcaacatggcaaaatcttgtctctatacaaaatacaaaaaaattagccaggtgtggtagtgtgtgcctgtaatcccagctattcggaggctgaggcaagaggatatcttgaatccaggaggtggaggttgcattaagctgagcttgcatcatggcactccagcctgggcaacagagtgagactctgtctcaaaaataaataaataaataaataaaattaatggttacaattaatagcaataaaagtaggacagacacctaatctatgaaagtaagcttttcctgtaaggatgatttcctcttttttttttttcttttgagacagggtcttgctttgtctcccagtctggagtgcagtggcacaatcttggctcactgcaacctccacctacggggttcaagcgattctcctgtctcagcctcccgagtagctgggattacaggcccctgccaccatgcccggttaatttttgtatttttagtaaagacaggttttcaccatgttggccaggctggtctcacctgacctcaggtgatccgcccgcctcagcctcccaaagtgctggaattacagatgatttcttatttcagaaatctgccaactataaaagagcaatctcttgatactgtcttgtctgcttctcttgctttctcaacctcttctcattctcttttttctttatatataatatatgtatttatatacatacactatatatacatttttgtatgcattatgcactcatgtacgcaaaaagttctgaaagttgtcctacaatttactgttttatttgcatattcagactttggcattcctggactctattcttttaagatttgttttcagtgtgtttcaacattcctttgtggatttaggacagtacacctgccaatttctattccagggatggattccattgtcacatttctgcagtcatttctcagggagggttttaaggtggtgttttccaaatgacttttaaaaaatatttgagaatgagtatgcttttgttattgtttgcttatttgttgcctggaaaacctctgttcatgacctttatagttatgcccagttattttaagggttctcacttcagcagtggttgtaagcatctgcctcccctgacattttaaaaatccagttatccccaccaattaaggaagaaaaagctcagtaaagtttatgctggtgcaaccagcgtgctttaaacttatcctcaggaatgggaggcaaagcgacaggtggaaacatctcaggcttaaaataagatatatcagagttcaaattctggatggattgtttacttaaggtgaccataaaatgtattatctaaattaggacaattataagggtaaaagagttcactacaaataattgggaggtattaattaacctatgatgccaatatactggaactattaactagtcgtgtgataatgagcaagttgtcaaaatttctgtgtttcagctttcttagctctaaaaaagggctactaaatcctggaaacattttcataagcattagtgataatgtatgactcagcacctggcatagagaagctcaataaatggcaactgctaatcatcaaaaccacagatcggtagtagctgtagctgccacctcttccttaggagtatcaccctctttaggcaaagccattactttgcctggttttcaaaaatgtgtttatcatctcagtctagtgaagaataaagtgacataattgagatcacctaagacatcagccaaatatcagctgggcctattgctgacatcattccaacaccttctcgatcaataaaattctctctcaccaagtggctttgtccccctcgttagattgctccctttctataaagtggtttggccatatttacgccagtattgtataattttagatttatcaagctgtgcagggagatgtggggaagggtattctagagatgccacctgcaactgtgattataactgtcaacactacatggagtgctgccctgatttcaagagagtctgcactgcgggtaagtcctgagagcgggtgtctcctctgtcaagcaacactgcgagtctgtgagtccccccttgcaccctcgtgcagtgctgtgagactgagcctccccttgcacccacttgcagtgctgttttcccactgtatcacttcctttgcttaagtgactttccttcacttgcataaatgttgcagcgcattgtacctaaggatggtgtcaaagcttgtgattattggggagggtaaggggagcctggaagtctgtcacttgcacaaggttattgtctagttccaagtaaatgtcttattttaaatagagaagatactgtgagtcaggagtcattaagtaaatagtaaggagtaattatttacaatcagagatgtcctcgactagtaatgaggactttcaatagtttcatcaaaagaatacatgagcatggaataatcttgtctaccattggactttctgatgttaacacgtttgtaaattacctggaaaagacactttaaagataaagtgctagtgtttaatgatgaatttcagttaaaatctgaaggtctgaattttaaattatgagtggtgtttcacttgaatatattttgggccattttattattaacacagaaacatttcctattcaatttaagaaaattgtaattaaagttatttgaaaggtgtatttgctttagaatttgaatgtgaagttgaggaatatattgtgcaatttatgtattggataggtaattatttcaaataagccttggtaagtccctgttaactctaacaaaggctttttaaattttcattttttaaatgagtagtcctccctaacatagtccacactgtaagattaggctgaaagctttcaactatacaccttccccagtttgtcataataagggcctctgcattacaaatgatttttaagcctcaaaaatgacccatttacgtggaatatatatacatatatatttatatggaatatattgctgagatctgtacattcaattactgtgaatctattacaaagcagtgtgtgaagaggagaaggatgaagagatttcatatgaaggctatctcactatctagacatttcccgatttttctttgtccatacatgtaaataactcgggcagcatcaggatgtctcttggagtctggaagggcaagaggagttgccctcagtcaccatatttcttttttgacttgggctgtctccatctgggataccatctaatttttcctggatgatgtactccaaatttcaaataaaagacttagaaatgaacttttggaaacctagtcaagtctaaggtgggaaatggctgtcaaatacgtgggcctggcttcacaatgaataatctgtaacttcttgttttgctctgggtagagctttcctgtaaaggccgctgctttgagtccttcgagagagggagggagtgtgactgcgacgcccaatgtaagaagtatgacaagtgctgtcccgattatgagagtttctgtgcagaaggtaagcatcacagtaccaaccaatgcttctcagtacagccagatctgtgcacctaccttagcatcactgataatgtctaacacgcagtccatcttaggccttgattttactaacatataagctatttcataataattttgttttgtggagatgaattaaagaagaaaagcgccttccaacagcagaacccccaggctcagccaggctccaagagtacaagatgttgccagagggggaacatagaggatgaggctgaatgtatatgtcttttttttcttcagatatggttcaatttcaggttaaatcaacagtaatcaaatcacttgatgatttcttgtctcacccttgctgacttcacgaagtcaactatcctttgagctatctgtgcttttggcctcagtgtttgagtatatatttaaggacataagcaacactttcagcttccctaaaccagtaaatttatgaattagtttaagccattaaatttataggcaaatctacctaacacgttgttaactgtcatgttccttcccatttctgcagtctcctcagcagtctctattccaatacatgtgcatggtaaagtcaataacaagggatattcccatcttaaaatcaaattctctatttataggtcttgaaggactcctctagagtataacaaaaggctccagattttacagaaaaagattttaaaaatatacttgaatactggattactttcctttaccaaatggttgttcttaaattctactttgttaaaacaagaatatttgtggaggtaaaagtgaaaataagctttgcttgcataatcaatcttatcattttatttaaacaagcctgcgcttcctgcttctttagaacagtgaagaaagatcggaaaactgctaatcagcagaattgagagatgtttcttaaccgttcaatgttttcatgggaaaacattccaaaaatgatgaagacaacacccttgtaataaaaaccttagagctcacccttcctgcagattttagcaggccccatgatgagtgacacatatttactcattaccctaattgttttggctgtgagacaagaaagctaagaatttgttttgggcagaggatgtctagggagtgaagatggttagaaagtgatgagacattgagagaacattttgataaagataatactttatgttatgaaatatttggtcagattacctaaagtttaggtagaactctgaaaaaaaaatgatgaaggcgatgctggccaactttctttacagaattcataagacagtcagcgtcccaacttaaaataataaaaccactcagaacctcaatacttcattttttaagtgtaataaccaaactatcttgagattcactacttagttgtttcagtatagatactacttacaggtgtctatatatctaaaaatcataacatttcaagaattgaaggaatcccagccatccaagtgcctctgaatgtgaaagagaaaacagagtccaagaggttaaccattttggccaagaacattagctagtacatggcagatctgtttctcaaattgagatacttgatgtttttgctgggtaggaggagaaacaagagggacagtggccagttcacggagactatagcagtagggttctggggcgatgttgcggggagcagcatgatttatcacaacccttctgtacccagagagtccccagtgctgttttcttatccttcattagtccctcttcttgttcctaaaaaaaaaaaaaaaaaagaagttccatgttttctcttctagactgagaagcggaaaagggaaggggactaaaaggttaaaaagatacacaccaaaccattaagttgtatctttgggaagggcagggcattttgaggaaaagcacaatgtgaaggtgtgaacttttcacaagaatattcatgtagaacttttgtaattaaaaaaagaacaaaaggcaaattggcatcatttaatttaaatgaatattaaaacagaaaaaaatgaatactaaaacagaaaaaaattctgaaggcaaagaccttcagaaatcatcttgaataaacatcttagtttgtagacaagaagatgaagttcaagataattatttgcctaaggtcacaatggtagaggctcgcaggcctaggactggaatttaggtcttctgattcctgagactttgctccctgtcataacttacaacaatttgagaaccagtattttatagcaatgcatccttagacttaaatggagtcattcgtgttgagctggagcctgcctgcactggctgtcaccagcatctactcttgaagctagatgcatctgtgcttttcacagttagagctgctgatgaacataaacaagatgttaactgacttgtcttacttggcctcagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaaggtaggaagatgacagatataatcaaaggagctttcttagatgaagtaacttgtaggtgactgcttatctaagcccattctcagagaacagggtaatcttaggaatcatgagcctcattacactcgaaggttttagactttgcttttaagtaaagtttaagacaaagtataaactctcagctctttctgtatttaccaaacccagcatgagtctgggttaaaacaaatcagaagggacaaatcttactataaaaaacaaaaaccaccccatgattttctttgtagaataatttgattctgtgttttggaggatatgggaaagttgagagatactagtaatactgctagtatctgtgataagcccaggtgccttgcttttaactgacagattaaaaggcagttggtcatattactaataaaagcaaaatccagatacttgtagactagtaaatagcacttcttgctgtgtttagactggtggttcttttttgttttaaatcacagttggtgtgatcaaactttctatttgatttatagaacattctgtttctgaaaatcaagagtcctcctcctcctcctcctcttcctcttcttcttcaacaattcggaaaatcaagtcttccaaaaattcagctgctaatagagaattacagaagaaactcaaaggtttgagcattgataaagatcaaagactgtatcaatgccatattaacaatgattatatttaaaagtaatgcgtgttggcagaatgaggacatcttaatatgggggggaatataactttatgaatattatcttagaaagtaccaaatgaatacttcctacaggaaattagtgccaagcggctaagaagccactctaaaagcaaaggataagaagatgctgtagcaggactgtggaaccacaagatggcaccagagatgattattgatggctttctactgtcattcttgtttacttgacatcattttgcttcttctccttcatcttccttgcattttcattttcccttccccagctttattttaacaaacatttatatactattgttctaagtgttttacaagtattaactcattaaattcttacaaacctctatggaaaaaatattatccatattttacaaatcctctttattttcctagtaacttatatattatatctggctgacttttcctctagtagagactgtgctacagaataggctattattgcctgaaaagagatttcctttgctgtttattatttcctgaagttctggttctaaatatatattctctttctccaggaaatactggatttttggataagggagttttaaagaactctaagaggttgtgatttcctccgaagcattcgctctaaataaatagccaggcatttaatcttttagtcacccagaaaatcgtgcaggaagccacccttgggctttgtagtccacatgtggggcagctgctatgggaaagccttgataaatactgtctttttgctgcccatcacaccctaagctcctccttatgtcccctgggacctgcaaggttagctgcgcagaagaaaaggagtggctaatagccctatgtatgggaacaaggctcagcagggactgtgggggtgactggggcagattgctcagaggtagctgtagaggcctctgagataattggtgcagcaagatggtagtactaggtttccaggaggaaggaagggacactgggcactgaagaataagagtacaaaaagtagggggtaaagaacattaatataaacagatgaattagtgttatttatcgtgttggtaattttgaacttgccactgacttccatgtattaattgtatagagttttatttgtgctttttcatccctcatctcatttattccctaaaacagcccaataagataggttgagtatttgccattttacaacaaattaaaggacatagtagagattagcaatttgcttagaaacacacaactagtcaatgataaagatgggatctttatgtcactattaaagaaaaaaaaatattctaaaataacaagatgtatattttttctccagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctgtgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccggtattaagaatcagttattttcatttttaaagctggtaatgttagtttacatctatctgaaccagaatgccttagtttagtatcactcaactgagatatattacctgaccttgttagcttgtgaagttttacagcttccctgtaggtaagcagaggtgtaattacagtaagctttttcattctctagaaaattaagcctgggaatttagcatatgtgtgtctgtgagcagcagagatggtatatagaaagtcaaaaaaatttagttcggagtctattcttaaaagtacaatgcaaagcaaaaatctgtagtatcattttccaaactaacccaaagggagggcaatcagaactgaaagatgcaatttcacattgagttcatacatccaaaaaatgtctagtttacatgaaaatcaaggtaacctggtccattccaattcataataatttatttcatataatacttttgaagagtatcatctttaagtaaaatggaattatcaagtatataactatgcaaacaggtcaaactgtgtccttcaagatcttagaaaaggtaaacaggaaatagaaccatgtggaaagacttgaaaagaacatacagacttttctcattctgttctatatttgttttgtttttgttaatttgtttagatgagaccaatatatgcaatggtaagccagtagatggactgactactttgcgcaatgggacattagttgcattccgaggtgagctatgtacacatttatttttcttctcatcattctgttttggcatttatgagaaccaaagccgtggaagagtgctagtttgggttgttttctggaggggaatctgattgataagcacacctcacaggagaatccgagagtaataacagaaatattggattaagaaaattagacaaagtaacaaaacaaaaccaagaccctgaactgatactactgaggttttttcctactgttaagatttaaaaagtagttcattttttttgggggggggggggtagttaaaatttaaaaaataaaataaaattttaatttcataccaaatgaaatgacaccagcatgcatattcactgctttatttgaaaataacatctcaattgtgatgtgttcaagtgttacactctctgtcggagagtaacagaagaaaagttatttcatgttaattctctgctgtactctgctagtccagtcttgaaacatatttagattaaatctgaaagcaattccttttcgtacagtagaggctaaagagatgttagtcattaaattataattccttagttctaagagataaagaaattgagatctaaagagatagtgactgtaagtcacaaagccaaaaggcttttttgagaccggatctccctctgtcacccaggctggagtagagtggtgcaattacggctcaatgcaggctcgatctcctgggcccaagtgatcctcccatctcagccacctgagtagctgggactacaggtgtgcaccaccatgcctggctaatttttgtatttttttttgtatttttttttttttgtagagacagggttttgtcatggtgtccacgctggtctcaaactcctgggcccaagccatctacccgccttaacctcccaaagtgctggattacaggtgtgagccactgcacctggcccaaccaataggctctttctaaagaaactagaaaactaaagtatctcaaaggttatgctaaatttcggacttgggaaatacctgctctcagaaatgttcaaatactaccttttgtatctgactaaacttccagtcatacaatgcataagaaaactacattttttttcattttggtttcttttgtgataggtttagcattcagcttgtaggctgatgtctttccttaaattttaggtcattatttctggatgctaagtccattcagtccaccatctccagctcgcagaattactgaagtttggggtattccttcccccattgatactgtttttactaggtgcaactgtgaaggaaaaactttcttctttaaggtaacacaaatatctttgtgagagaaatttaataataatttgtaactgcattatttattacaacatatattgccttaacctccaatatgtgtccttttaaatactctgtcatcaaaatttaatcataattcaacagtttgataacagtaatggtcaaaattcaaccgtttaaccaagttaacacgttctctctatacttaaatctagaaaggagttccaaatcttttttcccaaagctgataacataattttctcttttaaattatcaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtatgtgttacataattgacaagattacaaaacttttaaagaattacactcagcattttcatttattattgactttactgtcaaaagatatctttaatggctgaaatcaaatattttcagtgaaaaaaatcaatattgagggtagtattcttattgccctcaatttttattttcatttcttcacaggcaagtcacaattcatttgagttttcaggtcactgatagaatgtcatttactttcgcttcacaaatgtgcatgtcatccttgcacaagggccatgctaatctctgtatcattccagttttagtatatgtgctgccaaactgagcacttgtcactttcaattgaaattaaatatataactatgtaatttgctgcatctattcattcaacaagtatttcagtttaataattatttttataatacccttgactaatagccattattaatatcaatatattatatgaaaaatgagaacaaaactgtttcctatacattgtaaaagttgttttccaccttttctgagggtattaaaattaattttcattttccatgtgatattctaatacataacaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtaacatttttattgtgttaaaaaaatccttaaacataagtagatgtaatacagtttcttatacagtaaggcttatgaaatatggatactgatcaaacagccctaataatttaagcttactgatgaaaaactcatccacttgccttagtgaataaccaaagaccaatactttctttttccttgtgggtaagtaaagcagtttgttcaggtttgttagttataaccaatactatttatcaagtacttcttaccaagaacattatataccagtctataaccctcaatagttctacatcagagggctaaaactgagattaaaactcagatgtctggctctttccaagatagtacattgccttttaatctggtatcttttattaaacatgccacttacaggtgtccttcataatgaagttaaagtgagtatactgtggagaggacttccaaatgtggttacctcagctatatcactgcccaacatcagaaaacctgacggctatgattactatgccttttctaaaggtaaggtattaactaacagtttcccaaggaggtgatatcatttgtgaaaacatgaagataaagtaaaaatgctggctgcaatgatgactgaatgtgagaagttacactacggtacttattctaattgctgtggaaaagagttaagacttttgctttaatttcaattaaaatgatggcactgcaattcaattctgctctaaccttcatgagattacgataaaacatccagttactagagtaaacttgctactgacaatagtattttacttctatcatttgtggcatttaacagataccttgtttggcacaaggttataatgatttgcatcactgcagagtctgtaagatcagaaagaagttcctgagaaactaattttattaattaaattatattactcaggatgcttttctttgaaatgcccagaaatctaagttattctgcctgtaatttcataatatgaatgacattggcatgtattttttaaaaggaataaccccaagtaaattatttttcaaacttggttactctttaatgtttacttcataaaggagagctgaacctgattttacaaaaagatggtgaaatgtcaatcttttgaaacatcaaaaaagctgaaaagtctaggcaattgtttttctttttgttataaagttcaaattaattagtaaaaacatctctattaaaatgataaacattgtctttgagcataatagtcaacataagttattttttagtttgggcattgttttctttttaactaaaaaaatgttttctcttccatttagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggattagaaaacttgttccatttattactattccacattctatcatgtaatccagttatgtcagaaattcacctctctgtctgttaaactgacgaccacggacaccttgtctcaatgttgtctgaagtcttactcgtctgaaaggctttggttgactactactagtatctaagaaaaacattaagataaaagaaaagcaagtgaaaaaatgagaaagcatttataatgatacaaactaattactaaatgaatgaatgaataagatgtagacttgttcatttgatttcaattctttttttcaaacaatgaggaacatttaacaaaccgaaaaagggtaaatggttaaacaacaaaaaaagcagcactttgggaggctaaggtgggaggatcacttgagctcaggagttcgagaccagcctgggcaacacagcgagaccctgtttctacaaaattataaaacaattagctgggcatggtggaacatgcctacagtcccagttactcaggaggctgaggctagaggatcacttgagcccgggtgaggttgaggctgcagtgagccatgatcaagctaacagtactccagggagaccggtgagatcctgccttaaaaaacacccaaaaaaccaggcagaccaaggccctgtctcaaaaaaaaaacaaacaaacaaacaaaaaaaaaacaccaaaaaaaaaccagaagtgcttgactttttttcattcattcacttatattaataaatatttacttgttgactacccatgtatcaaacatactgccaggtgctgagaaatacaacagaaaacaaaatatcaagtccctcagcaaacagcctacaacagaacacaaattatatctgattctttttcagacaccccaaatgcaatcattagcaaatcatgaatgctcaaatttaaatatatatcccaaatctgacaacttctcacaatcctaactctaccatctcacctaagccattactatcttttcctgacttactgcagtagcctccaaagtttctcgtttctgtccattattcatttttaatctcttctgtatgcagcagccaaactgatcagatcatgtcatgtcattattctgtgtgaagccctccaatagcttctggtatccatgacagccaaggcaattacaatgatctactcgatctatcctctcccgcctcttaacatatctcctgctactctctgttctcactcactgtgctccagccacagtggcctccttgttgaccctgaacacaagcagacacactgctgccttatggacttggcatctattaatattctctttgatctagtatgctcttcattaagtaactgcacagctttgatccctttcttctttcagctcttaaatgtcaccttctcttagtgatgcttcctatgaaactgcctgctacactgtcaaatatttgttgaccaaatgaatactcagatgggggaagtacagttttacattatcaaataaatttaaagacatcgtaatttcatattatactttaaaggaaacaaccatattttctcatacaagctctgataagatataacaagtgctaattctattgaggaaagccaatttttatgggacgtcaaaatataactgggggcacaaaacttcagtaatcattaatatgattgttatacattttttaagccttactgcgtatgaaatggttctgtaatttacatacattattttaaatcctgattgcaagattagttatgagtatccatattacataatgtatagaaatttaaagttaccagatatgaaacggtagatattagggatattaaccaataggctgatgtgtcacatcaaagcagctgagaatcaggggaagagattttgggatagcaaagttctgtgatttaaaaaagtaataaataactgagcaggtctgccataaaatctgaaggttccatggcagagtttgagaattaccactgtaaacaattaaaaattaaaataatcagactgaa

SEQ ID NO: 16699 - DNA, 65415 bp, Human
ctaaaaatgtatatagtcagctttccacatctgtggtttccacttccatgtattcaaccaaccacagattgaaaaattatttttttaaagcatgattacatctgtatcattaaagatgttttttcttgtcactattccctaaacaatataatataacaactatagcatttacattgtattaggtattataagtaacttagagatgatttaagatatgcaaatgctacaccatttaatataaggaactggagcatccatggatttcatatccatggggtgggcaggtgagagggtcctggaaccaatgccccacggataccaagggacaactgtattttgccttatagggtcataattttccagaaatgttgtatatcagccaaagcctttgtggtccaagcactgtgactgacacaactcaacctttctgggctctggtttcctaatctataaaataaagcatttgaatcctagcagatctgaaaacctatctaattttaggattctgtgaatctaagtacagaaaaatctacatttcccaaatgacagatcaacagtatgataatactgtgggcttaggacatagcataatacttcatataccagcaactttaattacaatgcttatctaaaaaatatttttggggaaaaatcaaccttaagctccgctgttgatttatttttccttagttattacaaaatatcataaaatgcttccatttatatttcttagacggcttcacaacatgattcaaaagtaagaactagagaaaaagaataaatttcatataagaactaaatcaccaattcacagaaggcccacgactgtgggaactgcagagagacgacactgggaatgcattatttacaatgaataatttaacaaattctttcataagagtaaacacgaaacaatctacggattgagctttaaaactacagaattatgatctggaaccatacaagttctgttactgtagaaattaacaatgtgtttaaaaacttcagttacaacagttttcaattttaaaaacaatataatgttaggtaaccgtttctgcaacgaaaaatttaaaacataggctacactcaaagtgctaccggtttcttttaattctcctcctgaagaattaacccgggtccttaaattcccgggtactgaatcactcagtgccacctccccaccaccaaaaaccatttaggtacgccgtttcacacaaggtaagttcgtcagaagtgtgtgccggagtgactgtccatatggttccaacactgtcccttcctttttctcttgaaaagagagcacacacacacacacacacacacacacactacacttaggctgacttacctgttttcagaatgtgcactcgtggcagacaattacctcggacggtctctccgccggagatgggggtttcgggcccaagtaccagcctctaggggccagattccctccggtctcaattcactgccactgaattcatcagaaagcgacctacttcccacacctcacttcccactccaaagccagggacttgggagtcaggtggcgcagattgatgacgtaaaagccccccctcccttccccgcagagcctcagccaaagcgactgcggtcgccaccccgcccccttctgggcgccatagagagcgtggcggtatcccggagcctgccgtccggccctaccgggaccgatgccctctagtggctcagtgtccagaagccgccaacgaggacgatccatggcatcccggggctttgacggtaaggtcaccagctcttcagggagggccaaggggtgacgagtacgtatgtggcgccaccgtgcggacagcggttacggggccgagataggagagccaggggagcggggagaaaaacggaagctgagagggcggtgcagcattgggctcccggaaaagaatgagaaaaacactacatttcccagagccctacaaggcctgaagtgggtggagctggaagccggaaaattgggtgcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcggtaagtgagatgctctttccgtccttggttttgggctcgactcccgccctttgggtctggtcttcccccatcaagttggcactgggtaccgctctgttaacctcacttcctgggctctgtggatatcctgagccttcgctttcctgctccttacagtttgataagaagcctttgaaaaaaaaatctgaatctaagttcagtagcattttctttgtagttagggtaggctcatacagggacgcttattttccttcgtccggcagacgggaaacagacttgatagagtctgcgaacccatctctctaagcctagagtaccttatatgttttgttgcacttcaactgatagtggctccgccctattttctaggcacctgcattctaggcctttgccaaattgaccactctgtgcacttgttcttagtgtgtgcgtcgtcccgtggctccagaacgaatcagatgtttacaaaaatgaatattaggtgcataagagcgctggaaacacagtgaatgtgcagtacataaatttaatatatcttgatttctcttaaaaagttggagtttgatagaaaacattaaaattttcttgtaattacctaaagtaggcctttaagtaagaaagttactgacaataatggcttgaacatccttgaaaaaaatatgaagaatatagtcattaccattagtaaaatacaaacttcccgttaatgtgttttggtttaccatttgtttggggaggttcatactgttcttgctaagttgactggaaattctgaacaagtttttacttcaaaaaaagtgtaactgtcaagcagaattgaccttgaaaattagttctctgatcccagagctgagtatagtacattgcattctatttattaatttgcaccataaatattgaatgtcttacatgttcctgatactatgctgaacatgatattcaatcccttcccttggaaagtttacacatttacttttacatatatttagtagttttatgctttcaggtaatatcttgactactataaaagaagtcttttaaaacaaaggagtttttttttgtctaaacaattttttctcgtgtaataaatactttatttattaagcagtttactgatgtctggagaaaatactaagataaatgaggttacctgccttgaagacattgatttgtaaagccccttttaggccttatttttattttttattttttgtcatgtaagtcgtttggaaatgctttaagtccttttcagtgctcagtctatttatctttactcagattctcttatgtggagcacaattctaatactgtatcttaagttttaaaatcaaggttattagaaataaataacagtattcacaatgtatgtacatgtgtttgattttgttttttgttttttgcttgtctgctgtagaacaacagtattttgaaatagaaaagaggttgtcccacagtcaggagagacttgtgaatgaaacccgagagtgtcaaagcttgcggcttgagctagagaaactcagtaagtatttaattcatctttgtaagtattctcggagtatcgaaatcttcagagactcctttatatactttggaaacatttgcttactaaacatgaaaatattgattaagcatcattggtttttattatggtgatattttgatttttcacttagtggtaaagattttgtgagaacacagaatttaatggtcaggaggtctggattcttattctgattttgctattaaaattgcttttgccacatgtaaatcttaacagtatctgattattgtttataaaatggttagacccacatgtctgtctacctagacagctttgtaaatcaaatgagataagagttcttgaaatctttttaaaaaggtgaaagcattatgcaactaaagaagtagagagtggcttgtttttatgttgaagaatcgaagcctattgatttcattatatttatgttttaactccattttttaataatttttataaatatctatgaatctcaggatatttcccctttaaggcctaattcctataaaagattgatagctaatctctttcttacttttcttacatcattaagttttagaaagttcacaagatgttaaagatcctgacatttcttaggaggatgatatgtcttgtgctttgcttttcccatccaagttctgaccaggccccaccctgcttagcttccgagatcagacgagatggggtgccttcagggtggtctggctgtagactgcttctgctttaagaaagcaaacatcagaacattaggaaagatctctataaaggtgtaattaattttttttttcctttttttttggagacagagtctcactgtgttgcccaggctggaatgcagtggtgcaatcttggctctctgcaacctctgcctcttgggttcaagcgattcttgcgcctcagcctcctgagtagctggaattacaggcatgtaccaccaggcccagctaatttttgtatttttagtagatacagtggttcgccatgttggccaggctggtcttgaactcctggcctcgagcgattctcccgcctcggcgtcccaaagtgctgggattgccactgtgtctggctggtataattaattgatacttaatatagttcaattttaatttgattgatggagaaggaacacaggaagttcataatcaaatgattaaaattgcagctttccttcttaatgggtccatgaccatcaactatttaggttataacttttttcagctacttttggtacacctcattttaaaaacgtaatgtatatgcatacatgtgtgatggagcatatatagctagatctggttcattatctatgtagttttgcctagccataataaaaagatctgtttagtagtagtgccgaggaatttgagaaaaatgactgaatacagcttttacgagatctgggagaagagaaaaagggatgaacctacagatacatcagataccttcctgtggtatacagttaatgtgtgcgcgcgtgtgtgtgtatttatatactctggatcagtaagtctggaaagcagtaaataatattaaaacaaaatagaaaatttagacacatttaatggggatttttttgctttaatggtcctctttaaatagaagttaagattagaattaattaaaatgtatttgcttattaaattgccaacatatgtattttagtgaaatacagtttcaaaatgtatatttttggaaaaattttaaaaattatattttttctagttagcctatgtttagaagagaaactgcatgtaagggaaaagagcccattttgagtggcaattgagagattgataagtgcgttatcaagcataatgttttttctttaaaggctctatttagagtgataaatgataggaattgcaaatattcattattgtgatttgctgtatatacatgttatatagtttaaatgctttttctctcttgatcctgtctttttaactccattttcttactgctaagtacagttcactgtttcttatgatatatgttgacttagaagatggcactgaaaaataaaggaattactaattgcatgtgactttccccataaatgttggctaggattattatacatttgatttggagacaggatagcatatttaaaattttggtctagaacacagtaaattttgaatgcattcatgaatttggaatgtgatgtacaatgcagtctttctgggcttctgttttttcatttattaaaatatgtaaggttggcagttgcataaaaacactcattgcaagttttaagcaaatgtgtatgtattcataaaattccttttatccagacaatcaactgaaggcactaactgagaaaaacaaagaacttgaaattgctcaggatcgcaatattgccattcaggtaagagatatttcttagaataagctcattgtagacattttacttgaagggacattctattctgattgtttatcagttattagtcaatgggaagatgtaactgatgtcctattaggggaagctaccaacaaaaatatgtaaatataaattccttaattggatctatgttttattgatagattggacatctcttttattcaacagaaattatctattgaatgctgactgtagtccaggtattatatcaaatgtgatacagttgggaatttgggtgaatccacattggtagtcatttccttagggtagttttataagaatgacagtttgaatatgatcacagggattgctgacaaatttgttaattaaagtggttgcatgcaattattttttaaccagatacaactttatacttttgccattgcttttttaaaatttgcattttatttggtgttaaaagataatttcttcacatttctgaagggaaaaaaaaatttacttccagaatctgaataggcgcaaaaaagcctcgtagtatacctagaaaggctttgtaagaaatgtatttatatgaagaatgactcaatacccaagaaaactcaaatacttctctgaaaactgtgagaatatacctttataaatgaagatattgcaaatttctggatggaaatgttttccaaattaatgtgttggtaatacattttgactcttaagtccaagtcagatagccagaaacttgttaatgtagttctaaagatgattggggaaaaaaacatagtaatagctaggatgcttctaaaaaaaggaagtatcaatttaaattaagtacttgcatagccacatattcaagttttataaagctatggttattaaaatattacaatgctgatataaaaatcagtacagagaataaaaggcagtccagaaataaaacccaatacggaggttcttaatcttttggaaagaagcagagctgtcacaaaatctttataaatcttgtaaaaactatggatctgtaaccgaggaaaatagtgtgcacacagtcacataaaatttttcagaaaaaaaaaactatgaagtgacttaaaaagtaatagaatttatttaactgcttggtggctgaaagaaagaaactgaaagctttttcactaagatccaatgcaaggctgggatgcccactcaccacttgtattcagtatagtactggacgtaccagcaagagcaatcagacaagaaaaggaaataaaatgcacccaaattggaaaggaagaaataaaattatctttacttatagattatatgatcctatatgtagaaaacctgaaagattccacaaaaacctgtcagagctaataagtgaatttatacaattgaaggatacaaaatcaatattaaaaaatctagtagcatttctatacacaaacaatgacctagctgaaaaagaaattaagaaaagatttcattagagtaccatcaaaaaacaacttaggaataaatttaacctgggaggtgaaagattcatatactgaaaataatataacattgacgaaagaaattgaagatgcaaataatgggaaagatataccatactcatagataagaagaattatattgctaaaatgtccacactataaagtggtaaaaagattcaggccaatcctgtcagaattccaaaggcattcttcgcagaaatagaaaaaaaaaattctgaaattctgatggaatcagttttaaaaatcctgaataataaccaaagcagtactgagcaagaaaaacaaagttggaggcatcatacttcatgatttagaaaactgttataaaactatagtaatccaaatagtacagtactgacataaaaacagaaaagtgaccaatggaatagaatagagagcctagaaataaatccaaacatatggtcaactaatttcaacaagggtgccaagaagacccaatggagttgtgatcgtctcctcattaatggtgttgagaagactggatttccacatttgaagaaatgaatgttggatgtttgtgttgcttacatcatataccgaaatcaagccaagatggatgaaagatctaaatgtaagacctgaagccataaaactcagagaagtgaacataggggaaaggttcttgacattggccttggtaatgattgtttggatcacatcagtagttcaagctgcaaaaagaaataaacggaactacatcaaactaaaaagcttctacacaggaaacaagaatattaaaaggcaacctacagttctgacataggtagcttgagatagatatttctaactcaaaaacatgtagattgccattgttttgctgggaagcagtttgacaagttttttgtttttgagacagggtctcactctgtcactcaggctagagtgcagtgatgcagtcttggctcactgcaacctctgcctcccgggctcaaatgatcatcccacctcagcttcctgagtaggtgggaccgcaggcatgtgccaccatgtctggctgtttttttctacttgtagagactgggtttcgctgtgttgcccaagctggtcttgaactcctagactcaaatgatcggcccagcttgatttcccaaagtgctgtgattacaggcatgagccactgcacctggctgacaaaatatattaaaagttttaagtaattcaatttttaggaatctttcttgaaaaataatttgaactaaggtgtaaatacagtgatattctaagttattaggacatttccatgtgattaaaagagatatgagaaaaattttcataagcctagtaaaaatgttttaaaaatccaaaatttaaatagaaacattggaattacgggtattttttaactttgatgtgtaagttataagagaaagccagtcatttacactacagctgatgttaactaaagtgacaattctatgttcgctttcctgtattgctctacttgattttcttacttattacttctttatatgacagagccaatttacaagaacaaaggaagaattagaagctgagaaaagagacttaattagaaccaatgagagactatctcaagaacttgaatacttaacaggtatgaagaagtgcttgtagcttttagctccattcctttatttttcttctgttagtgctaggagttagtgctcagcccatttctgttgctgatatttttttgttatggttgagtatagagttgtcatatcctattatttctcctactcatttatctttaaatcattgtcaagtgtttaaagaagtgtctagaaagtgcacaagtgaagaacatctcaaagaagtagtaatttggaccagattttacatgcaaagattttcactacaatgctgtacataatgtcaaattggaagcactttaaatatttgcaaaggctgaactactgttctttatttcatatggacatccttgctatataataagcattcaatataagaacatatactcagcctatatttataaacagactgaaggaggcagagacataaaatacataaacatagactgtagtatataatacagctgatgtagtcaggtgaacttgactctgaagcagttaatggtaagaagtttcctttggtgcccaggcacggtggctgacgcctgtaatcccagcactttgggaggctgaggtgggtggatcatgaggtcaggagtccaagagcagcctggccaagatggtgaaaccccgtctctactaaaaataacagaaattagccagtcatggtggcacgcacctgtaatcccagctactttgtaggctgaggcagagaattgcttaaacccaggagccggaggttgtagtgagccaagattgcgtcactgcactccagcctgggcgacagagctagactccgtatcaaaaaaaaaaaaaaaaaaaaaaaaggtgttttgggttcttttttttttaatggtttttgaaatttttttatttctataaaagaaaggattttcagatatttatatcattatacaataatattccattagttaagtatactttcccagtctcacaagagttccttcaaaatacttgagtgtgttgatcaacaagtggtagttacaactaaacgaattcataaaatctagatatttaatagatagttttttaaaaatgtgtattccatattgagtaggtttttatattagtgctttttagcttaatgattatttataaaattttaataggtctttggatatatatcaggaaaattaaggttaacgttgaatatttagcttaacacactgtatttaaaataaatttggataattcacaagtttggatacacaaatttcaattttttgtcatatatttgtagaaattgaatttgtaattaactatggcagaaacaagttaaaataagagagttgagaactacagttgacccttaaacaacacagtggttagggttgctgattccccccacagttgaaaatttatgtgtaacttttgactccccaaaaacttaactactgctgttaactagaagccctaccaataacatacacagtagattgtcatacgttttgtctgtgatctgtattatatactgtgctccttcaataaagtaagctagagaaaaaaatgttaagaaaatcataaggaagagaaaatacgtttactgtacattaaatggaagtggatcatcacaaccatcttcatcctccttgtctttacattacctaggctgaagaaaaggggttggtcttgctgggtcaggttgcagaggtagaaggggaggcagaagagggaggcacactcaatgtaactttacgaaatacagcctaatttctgtctgacttgctttttcatttctctaaaaatgtttctatacattaccaatcttccttccaccgtttgctatagtttcagtgcccatgtaagagaaggatccatgtcataaaagaaatcaaaagcagtcttgggtaatcagaacccttccaccagatagtctgttaccaatatgttttctgacactgctagttctacattctttttccacatcgtctggcactggtttggaagcactcatctccatccagtcatcttctgttaatttatctgatatggtggctattagctcttggatttctccaaggtccgtatcttgaaacccttcatcccactttttttgccatatccacaatctctttcatgatttctttgattggctctgttacaaattttgtgacatcatgcacaacatctggagagtttcctccaacaggaatttattatttcagccttgatggctttcataactttttctgtaatgaaaaagaagggatggcctcttcagtgtgttatcctttaaaactttcatgatattttctctgttggggttctcttccacagtgttgacattttcttttcacaaagtatcatctctattgagccgtaaaggtccttatgactcctgatctaaaggctgaattagaaacatgtttgggagcaagtagactgctttgacaccttccatgttgaactcctgggttctgggtggccagggacagtgtctaaagtcaaaagaactttaaaggcagccccttggccaggtacggtggctcatgcctataatcccagcactttgggaggccgaggcaggtagatcacctgaggtcaggagttcgagactagcctggtcaacatggcagaaccccatctctactaaaaatacaaaaattagctgggcgtggtggtaggcgcctgtaatcccagctactcaggaggctgagtcatgagaatcacatgaaccagggaggcagaggttgcagtgagccaagataatgccactacactccagctagggggatagagcgagactgtctccaaaaaaaaaaaagggcagcccctttactagcaaggtactttctgactttagggacaaagcatgagtggaaccaattcagagaagggggtctgtcattgtccaggtcttcttcttgtgtaaccagaagacaggcagctggtgtttatctttttcctttgggccctggggttaaaagctttataaataagggcagtccttatcataaacctgactgcatttgctcagtacggtagagttagcctatcccttcctgccctaatcctggtgctcccttctctttcttactaataaatatcttttgtggcattgttttttccagaatagtacacttctatctgcattaaaaacctggtgcaggcatataacctttctcaatgattttcttagcagcatctgctgtttcttggttgacagaacctgcttcttcagttttgttgacatttttataagtcaaacctttctaaaattatcaaaccatcctttactggcattaaattctccagctttagatctgtcaccttccttttgcttttagttgtcatataataactttgctttacctcgtatcatattagagtctataggtatgtgatagcaatcctgcaccccataaaagctgcattttcaatgcgagataggaaggtattttgcagaaatgcacttttttatgcttgctggcgtagctgcagtgatggctttacgaattttctttttatttctttttttttttttaaacaacggtccatatactggattcatttgtcttgaaatggtgggtaaccatcgctgcagtcctcaatctgtggtacatatcaagcaattcaactctttaaaatattgtcgtgatatttccctgcttcttagaagaagtacttccaacatcactagtggcagttcttatggatcccatgttgttattcaaggtttatggtattgtactaaacacaatgacaaatatgcaaaaacttcaaaagatttcaagttttatggtattgcactaaacacaatgacaaatatgcaaaaacttcaaaagattactattttctgcattatgcaatttactgaagagagaaactgctcacaatagagtcacacagcattctatacagacactcaaaacacttgagcttactgcagtagtatcaggaggtggctatgaaagtattccagtaatacagtatgtattacagttaattttatgcagttatggtttaataaagcatatttatatttgcttatatttctcttgattgcagatagggttgtgtagtgtttgtgtgcataagttttgataaattttttaagtttgtatcatggatttgtgcatattttaatggtagtaaatgataaaatacactaatatctacatattagtacatattatgcacttacagtagctttttcttagtttgttcccatttctgggctgcctggattggtctgtggtctctgagtttttcaaattgtaagtttttgggaaaaaattccaatatatttattgaagaaaatatgagtggaagtgaatctgcatggttccaatctgtgttattcaagggccagctgtgcatactttgtattaaaggtttatattcctagaaatatatttttgatatttggttcccctgagtgttaattagttattattttttaattctcttcaccattctagaggatgttaaacgtctgaatgaaaaacttaaagaaagcaatacaacaaagggtgaacttcagttaaaattggatgaacttcaagcttctgatgtttctgttaaggcaagtaccagatgattcctaatgcataaactatagctttttattaaaactcacctaaattaaatttcaaatataggcaataaagtaattaaaagctgcattttgttttgtttttaatgtcagaaaattaagcattaggacaattctagttcatctgttttgcttgtttgaaatttaagtttgttacagttcttaatgttttctagttaagaatctatgcaaatacttaatttctgttttgaaataaaattctgcttgtgtcccttagctacagacaaaatcttttgaataatcatatatcatctttaactgtacgtgttattttcttggatttctttagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtaagttagtaaaattgtgtttttcttcatgttgagtataacttacatttgtatgtcagtttattaaatatgtattcagtagtgtgtacctgattagttgtaagatgagtggttaaatgtgaataatgcattacatttggcgtaaaaaatcaaccaattgcgtttacataaagaatttaagattctttgtcaaatctggttagtatctactgtcttacgatatatctttcctaaaatatgtgtttgtttaagaagtggtggtaagtttttgtgagctaaatctaaacattgttctgtgagcagttactcttagttttcttaaatatgcatattttaattgctttttcaggtggggagggggagttacttagcttttccttagcagcataaacctcatgtcagagtaatttcagttaatatgacatcctttccccctgctctattttttgtttttaggtttctagactggaagaacaaatgaatggcttaaaaacatcaaatgaacatcttcaaaagcatgtggaggatctgttgaccaaattaaaagaggtatatatgaccattaaaatgtcttttttacaaaatactaaagcacttacgaagctgttatttcacaaaatgatgtcattttttaatctgtccttggccccataaaacagtgagagtcctccttccatatgctgtagctaggctaaaatagaatcagaaatagcaattatatgttatattgaaaatactatctaaaaaatgagtatgggttaattttattgtttaattattttactttgaatttaaaatattagtaatattttatccttaatttatctttgtcatgaagactgatttgaatttgagtgttttagatttagctcttactttacaaaaatggaatttttcatcttgtcatttgataagcattctaaatttagttcaaagtagactgctataattgggctatttttttcaggccaaggaacaacaggccagtatggaagagaaattccacaatgaattaaatgcccacataaaactttctaatttgtacaaggtaaatatcccaccacacatgttagtatctaaatgttgcattgttgactgttaggtaactttttaagattaacttttagagtgccgctgatgactcagaagcaaagagcaatgaactaacccgggcagtagaggaactacacaaacttttgaaagaagctggtgaaggtaagtgttttcagttatgggaacattatttttgttattgtactctttttttttttttacccttgttttgtatagatgattggatttaggtgttagactttatttgggacagaattaggtacagaagaaagaactttggattaggaaattcagaattatatcttaagcaaatgtaagtttatatatttttgaaaatacagacagcagggggttttgtttgttttttatctaataatcttgtataatttgctgatttctaatgagaaagttttcttttttgaaacatttactctgattatgtttgaatactcttactttataaataagacatcctctttatttgcattttgtaaagtcttttatttcctcaaatttttgcttttttcaatgtattatatttatggtcttttccaataatttcctttacttaggattaaagatcaaaatcgaaatcaaagatatacctagaaccactttttaccctttgggtttccttattttctttgtgggtaagagacatcaaaaggagaaacaccaggcgaagacaattccaaaattataagtagagcaagaactttcaatagatactgtcagctgaagcctctctagaaatttaatattatctgctgaggggagaagtgactgatctgttgcattttgtaaactaaaattttaactgtatgtttgaatatttggtctttaaaattgttttttagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggtatggctaatagatgcttgttagtgagttgaaatactacagctttcctacataaaagtcatttaatttcactaatagtatttatctgtcatgctgtgatgtaggaaactccatcgagttatattaatagaatttgttttaaaattaatactcttacctgtatctttacagaatcgggcatataaataccatttgatcacacacagtcttgtaaattcccaggttattgcatgattttttagaattagatgtgttacatgactttttgatgtcatgtatttaaaatttttataggaattactatataatgtacagtacatgtcacttaccttgaaaaattattaatggcttttagtttggaattttacaaattatactagatgtgtatttgttggcacaggagccatattgtctgaagaagagcttgccgccatgtctcctactgcagcagctgtagctaagatagtgaaacctgggatgaaactaactgaggtaagaatggtattaaatgttgttaaattctttttcttcagcaaatgtatacaaatctcttcaaaatttaattctcccaaaacttatttttaaaatcatcttataattagtggatcattctaggaaaggctttctttggttcctagtgctgtgtaactaacatagtaaacattgccattttgtgttagtgttaaagaatgtttattatgaaactagatcaactaaatatttgcgttgttatggttagatttgaaacaaccctttgtctactttcagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggttggttccattcctaaaatttagccgtggtaacaatacaaatgagaaatgatttactaggtatttttttttcttaaggtgattgagtcagaaaaatctaaatacgattttcaataaacacattttgaaacttattaaacactgctgatctcaaaacgtcatacctttatttagcaatttttatgtatttcaatttttatataaaattgtgaaagcattttaacctttttttaatgcatttactatgttttccttaggattctcaactagagaataatagccaaatctcctaaaactgctcttcaaattaaaataatctctgtgtaataaaactctcctatttgccataatcattctttatcagacagttgtaatagcctgcctagaaataataatattgtttgaccataggtagaactccttttttataccatttcacaatttggcgtgtctctatatgcattattttgttattgctcatttgcttattagaagtgttaatgaaattcataaagattttttccttttaagagatactgatggaaaaagaggttatactctgaatgttttgccttatggtacaactattaacattactgagggaaattgtcaagatttcttgaacaagttttatggaggaaattcagttaaatgaatttatatctactcttctaaactgataaattgtttcccttttgttggaaaagaatataaatatatccctatttcaaaattaaatctctgttgctgttataatttagaagtcagtttaaatccaagtactttattatatcagctggtttttttcttcttcatcaagtgaagtctagcagtcccgcctgcctgagaatattgacttttttaccagcagtgtagtttgcaagagagcccttggatccaattagatcttccttgaatttttctctctgttgaaagtgagggttttacctgaagcttgttattgtctgaatgagaaataacatattcaaatttatacaaaacttcttttttagtggctacaatattatgtaggattttatttagtgtataagttgattactggtggtgtttgagtattgtatgtctttattacttgtataaatcctagaaggaagtacaaaattttcacttgaatttacattttaaaggagattcagcgattgcaggaggacactgataaagccaacaagcaatcatctgtacttgagagagataatcgaagaatggaaatacaagtaaaagatctttcacaacaggttagaatttttttgtttgttttcctacttttaaaaacctgactgcccagtaatctttgaatctgtttgaaggtacctaagatagaactaccatgtatgaaattctaattaattaggaatagtactcgagcagagttgcacccccattgtttcttttcatagcccctcccttttttcaaatgtttgataaatttttaaattatacgtgttggttgtaataaatgaagaaataattcaaagataaataaaagctttctccaatttctacccctctaccctctgaagtcccaaagtgtagctaagttaacagacagttgtgtatttttttcacatccttctctgtatgtgtatatacatgagcatatataaacatatgtaagaattatttgattttactgaagtaagactggactgtatgcattactctgacacttaacaagcaaatcaataaattaatgtctcattcatatattttaccctaatttgtgtgtgtgtacatccacgcaatgcacaaatgtaaaaatttcacatgaatggcattatatatatgctttttgtttaaatgtctatttttcatgctctgccctatcatatatacaaaagcacacacaaaaaaatagatatttgtgggttttatttgatcactgttttacaaaactggagccatgttttgggaattgtaatttggctactttgtaataagtaatagccttcaatacatacttaaaagtaattttattctattaaaatttgattgtttagattttaatatccaaggatgctttatttttaaagataatttgaggcagtacaagttgaaggttttataagtaatgttttaatttgaaaactttcattctaaacttgtccagaattgtaactaatactattttataacatattaaaactttgtttttagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaagtaagtagtcacatacctcagcttgttgagcaaacatttatgaaaacctcagctaggctcagtgtctcatgcctgtaatcccaacgttttgggaggcctaaatggggtatcatttgagcccaggaggtcgagaccagcctggacgacatagtgagaccatgtctcaaaaaaaagtaaaaaattagctgggtgtggtggcacatgtctatagtcccagctactcaggagacaggctgaggtgggaggatcacttgagtccaggagtttgaggctgcagtgaagcatgatcatgcaccacactctaagtgggacgacagggtaagaccctgttgcccgcaaaaaaaatctatgtgttcctaacagtgctagatacttgggatatagtgatatagggaggaaagaattgagcaacaataccaaacaaaaaatttctactccaagacctcaggttatgggtaagacagatgtaataaatagataataaaataggcaagtagacaatttgcattcactgtgattagtgcctatctgtgggatcatagcggtagaggacttgtcctagatttcagggagcagaccggcttcatggagaacctggagaacctatgtaagaattagtcagaggttttttcaaaatacatgtataatgtcttctagaagaggaagaatggctaagaaagcaagaagactagagtttggagtgagtggaactgatttaatttttacaaacaaatttttcagattgcattggtaagtataagtacctgagtcctgtgtggtggggatttaaaaagtagttcataaaatactcagcatgaaaaaaaataatgagagagacaaaaatggtatgatgaatggtaggcaaagatgcttggttaattacagtagaaattacaatcagttaactctcagttcagtcctgtgaattaggccgactttttctacagaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatggtaggtttttataaagttattttaaggaataatttagaaatgtatattaagggattaattttgcaacataagcaatagccactctaatgatggtagcttcaaatttgactaccatatataattgcttataacatcccatcaactgtaaaacataccattattttatgtattgctaaaaagaaatgctttctattgttgaaaaaggtgcatttcagaatcaatgaattacagtatttattttggttatgttttaatgaccaaaacagatatgttttaataaaacataaatatggattatgttttaacccataaatactgaattatctctaataaccatcaaaaaatcttaatacattgtttagtagattccttatttaaaaactcctataatcttattgtttcatttcaataagtttagcttgtttatttgataatagtgtatttgcaaagaagcattagattaaagctgatttatgaaagccaacaaagcattttattagtctttactttcctgaagcttcaagcttagatgatgtttctcttgcatcaactccaaaacgtccaagtacatcacagactgtttccactcctgctccagtacctgttattgaatcaacagaggctatagaggctaaggctgcccttaaacaggtaaagatcacacctttgtcctgggttaggtttttagagaacacagtgttaccttctcataatctccaatatttagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacggtaagttttcttttgtttcaaattaattaagtctaaatgttatactttacaattcaaatcatttaaattcaagagctaatttgcaatagtgttgctttttttgtgaactgtgttccagaatgagaacctctggtagttcatttttttcatattgattaatgattctctaggcagtgctaagggtttagcttgtttgataagttgaagccaggcgcagcagctcacgcctgtaatcccagcactttgggaagccgaggcaggtgggtcatttgagggcaggaattcaagaccagcctggccaccatggtgaaaccccatctctactaaaaatacaaaaattagctgagcggcagtgttgcatgcttgtaatcccagctactcaggaggctaaggcaggagaatcacttgagcccaggaggcagtggttgcggtgagccaagattggggccactgcactccagtctgggcaagagagtgagattctgtctcaaaaaaataaaataaaataaaaataagttgaagttcatgtgaggaatgttggtagtttaccttcctaagattaaaggacttgtttcggtaggacttaattcttttaaaaatgcaccagatgatgagagaaatgagagcaaattttattccaccttttctattctaggtagaagagaagcaagtgctatgtagttttaggagaattaattttcttggtcacatccaaagaaataataaatatttcatgattatttgttattaaattcattgaatgcttgttagtttagtttgttaggacaatatttatttttatatagtacatgataaaactgtttctgttttatagcaggcaggatatattgcaggcagttacccctatacatctaatagttcagcaaccccaattaaagcacttcttttttctctgttgatacctctagccagccattatgtcagctttcaagcacataagaaaataaaactgaggattatagaagaaaaaaggattagcaaaaatccatcactaaccctgtataataacttaatttgtatactgcattgtagtgggtgtctggtgttatcaatattgcattgtcattactttaaatataattgattttttaaaaataagattaaaaagttacttagcatgaaatactttgcttacttagaacttgaaccactacatttggaattgggaaaaaagaatgaaggttttaccttattacacaagccacttcttcataaatcataaaattaacccctttcccatttagaaaaaaaaaagtgcagcttgctgccagcgctcatttaattttacataagcatgctgtttgaggttgaggcaaatctgacagattttcagtgtgaaaataaaatataaaaactgttcctggagttatttctaagcagaattcaacttaacagaaatatgtatgatgttacattaggattagagacaatattctcagggcatttggggaaatgggttaagctattgtgaaatttcttcaagggattaagctaggatatcatttcagttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtgagtccaatatcccttgtccaacttgcattataagttgcatttgacatttctttagtttttactttgaattttactcactgataggacttaggtatttaagaagtttggaggttacaccaagtaattaatacatagtttgcaaatagccagtgtgcgttagtggggtgattgtttctattaagatagaagagggaaaggaatttgtttttctgctgggctaagatatactcgcaagtcttgcatttcaaaataaatttgtaggtcagtgtttggttctaacaaagacgtttttttttttggttttttttttcttgagacagagtctcactctgtcgcccaggctggagtgcagtggcacgatcttggctcactgcaagctccgcctcccgggtttacgccattctcctgcctcaacctcctgagtagctgggactacaggcgcccgccaccacacctggctaatgttttgtatttttagtagagatggggtttcactgtgttagccaggatggtctcgatctactgacctcgtgatttgcccgccttagcctcccaaagtgctgggattacaggcatgagccacagtgcctggccagacgaatatgttattcattcttgctcatctgtaataaaaagcaatataaaaattacattgcattgaatttatatttctgaattttaacttgaatataaatgtccatttgaaattattacttttaactaaatacttagttttgtgatgataaattttttatatagttttctttgttattcagttatctcttctgtctttgatcattacttgtaagctaggtatagttgtcccccattttacctgtgtaaaacagactcaagagctaatgtataatttgcctattttgggacagtcatgagagatgggttggttaggacttgaacccatgtcttataatgctcttataaggctgtattctttatttttatcttgctccaactccattgtgaggagtgggcagcagcactttttcaaactggtagagtgaattttatcattgatcatttatatgaatctgtgtgtaaatatgagtacttgtgtgtaaatatgagtactttgagctttcaaaacactctccctggtccccttgagactcagactcttggggttgaggggagggagaaactttaaatagatcaatcatcacttttaaacaggtactttgaaaccggcttggattctaaaagttacataatttaatagtagtcaggtatgaatgattacagcagtcatgcaattctgctttcttcttctcacatattaaatttttcttgctgttattttttaaactgtggattgttagagcaaggaaccataagtatttgtaattgaaagattttttcattgatgatccccaataatttttgcttcgtattttagcacatgaaactgttttgtatttccttatacaatgaggagatatagtccctaagagcattaaaaaaaagtagtgatgtatgaatcattttaattttataatcttaatacacttgacaccatgtttttcagcattttttatttcatttctacttatgtttaggtaagagcagaaaatttgaagaaggaaaaggaaatgcttaaattgtctgaagttcgtctttctcagcaaagagagtctttgttagctgaacaaagggggcaaaacttactgctaactaatctgcaaacaattcaggtaaccaaataaaaagcctatgtagaaaaaatgtataaaagttaaatttagattttttttatcctctcaatttccttaattagaaaatttatccatcacttttgtcatccattatgatcattgaattttgcagtttattaagacatttaaatattttaaataaaatattgaaagagaattgattgaaaccatacattggtaagtcctcaggtatatttacagtgtcctgtgcagttttactatttataagattaattctttggtttttattttctttaaaactttgggaaatctgaatgacgattataatacattccatctctttcctgtataatagatgttttaatataaaaaataccagaatactttcttgataaatactgtagattttagctgcttcatgtagaaatgggttgtaatattgtaattctttcttgccttcaatttttatttttttgtattgcctttttcttaagcataaccaaaaatcttttctttgctttagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgtgagtccatcagagttctgaatttctgtagggtgtttatgttcagtaattaatctggtgtgtggacagtctgccatccaagatgaagcatgattttgaaaaactttgttactaagtttttcttgcctcactctatacccagtaatttttttattgggtgccatatattgtgagttttaccatgttgggtgctgagtatttttgtattcctttaaatcttcttgagctttattctgagatgcagtaaagttaatttaaaatgatttgattcttttgacttttgccttttatgatgtattaggtgggcccagagcagtgtgcattctggaactgaggccaatactttcatgagtattagtgccagtgtccattgcaattgtggggtttttttagtctggctgcagaacaggcattattcttgactttctttgagtaacaggtattcttcactcttaattcctttggacaattcttcccctgtctggggtaagctccttatatatttgcagcgatcgctactctgatgaatatttaaggaggaccctctgtagagctccagggtactctgtgtgtgcaactctcctgtcttatattctgtcttacaaatttgagctactttggtctccctggactctcagatctgtgttctcaattcagagagtctcctgggctctgcctcatttcctctttcctgtgtcatagcctggaaacttttaaatcagtaaactaaggcaatctaaggttcacctctttggttttctgtctcaggatctcggttgtttcatgtgttttgtctggttttttttggctgtttcaggtgtgacggtaaatctgttttctgttactctcttggccgagctccaaaggtctataaaaagatagtttgaacctttagttacttaggaacctaaagaatgttataagattaatgtattttataggttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtaaataaaataagtagaccaatataattgtaaataaacaagtacttcttgggattataatatatcctgtcagtaaatagcctaattctttgtgaatgctagtaaaatgaaacaaacacaaaaaaaaacccaactttttctttatatagtggtactcaattttgggcctaaactagtaaatttgctgtcttaaaagattcagaatagttcagcttggcatttgatcaaggtatgtacccagctttctaattcttgaaactatttattgatactttaaaaattattctttctgaagagggttatttgattttttaacccgggccccttggaaataaggttgcttaccaaatctgcaagaataagtttctcttaaagaatgagttgatttgtgatctcctttaaagcagtattcccaatatttgctcgttggtagcctcaggtaaaagatttgtttcatagattttgcttccctttttaaatacatctttcaagttcgaagcctttgtgtcttgataatctttctatatggttttatttatttatttattttttttttttttgagagagagagtctcgcactgttgcccaggttggagtgcagtggcgcgatctcggctcactgcaagctccgccttccaggttcacaccattctcctgcctcagcctcccgagtagctgggactacaggcggccgccacaacgcacagctcattttttgtattttttttttttagtagagatggggtttctccatgttagccaggatggtctcgatctcctgaccttgtgctctgcccgccgcggcctcccaaagtgctgggattacaggcgtaagccacagcgcccagccagttttatttcttaacacaagggaaataaataactaataattgtatgcagactttctgatttacacagtttttcaacctgtggtgcaaaagcagtacacattcagtagaaactacttcagtatagtatttgttcagtaaattacatgcaatactcaacacttcattataaaataggctttgtgttagatgatttttcccaactgtaggctaatgtaagtgttctgagcacatttaaggtagtctaggctaagctataagctaagctatggtgttcagtgagttaggtatattaaatgcattttcaactcatgatagtttcaaattatgatgagtttatcgggatgtgaccccactgggagtagagaagcatctctctgtatctgtccatatatacagacccataaatatctgatccatataaataatgggtgtataattatctagtagataattatatactttcctattgatatcatgtgataaaacattctttccaatttacagttttctgcctattttatgtacttacaataaaaattgggctaaattttagatttaagatttagtgttttagagtaaataatgtttaattattgggagaacacacccccaatctttcagtgtaggttctttctattttctatgagtgtcggctggctgagaaatagacagtacaaagagaggaattttacagctgggctgccaggggtgacatcacatatctaggaccgtgatgctggcctgagtctcagaccagcaagtttttattaagggttttaaaaggggaggtagtgtaagaacagagagtaggtgcaaagatcacatgcttcaaagagcaaaagcagaaccactgataaggatctaacaaagatcacagggcaaagggcaaaagcagaatccatctgataatgggtctgtgttcatgccctgtcatggggatcgtcttgataaacatcttaaacaacagaaaacagggttccagagcagagaaccggtctgaccacaaatttaccagggctgagttttcccaaccctagtaagcctgagggttctgcaggagaccagggcttatctcagtccttatctcaactgcacaagacagacattcccagagcggctgttcatagacctccccccagggacgcattcttttcccagggtattaatattccttgctaggaaaagaatttagcgatatctctcctacttgcacgtccgtttataggccctctgcaacaagaaaaatatggctgtttttgcccaaccccacaaacagtcagaccttatggttgtcttcccttgttccataaaaattgctattattctgttctttttcaaggtgcactgatttcatattgttcaaatacacatgttttacaaccaatttgtacagttagcagttatcacagtggtcttgaggtgacatacatcctcaacttaggaagataataggattaacagattaaagacaggcataagaaattataaaagtattatttgagaactgataaatgtccatattaagatgaaatcgtcacaatttatgttcctctgccacggctccagctgctccctccattcggggtccctgacttcccgtaacatttaataaattaagaattctgtcatttcttcatatagctaactcagtttagtggaaatatttgattgttctcttttgaatatccttttcttaatttttgtaacagatttaaaatattaatatttgaatttttttgtttttgaggaagtaacataacaaagtacctgcttttattttggtattcggcatggattgaaatatactttctaaatatatctgtatttgaaccttaatgctaatttcataagctctttataacagtcatctctaatactattgaaaatgttaattttaacagagctgttatgtcttttaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtatgtataattctgaattcagaattcaatctcaacacatttgttaactttgtttttagtaactagaggactgcttttttaaggcactcgtatgaattagaccagggtcattgcctttaaccttgtgaaagtacttgagtctcataagccagataaaacaaaaacacacaaaattcatgaagcaaggaggttatccttgctgtaggaatggtccagataaaatgttgaggagactgagaggtagggattgttatttgtctactgggtatgcatgccttcacaagagagatggcatttgtgcaggcaaagccttgaatgaaggtatctgtataggaaatagagtagaaaggtattttacgtgatgggaaccctcagccatggtagaaagtcttcagaagatgacaatttgtaaagtgagtagtgaggggatacagttataaatgtagttgataatcaaatgtgaaaggttttgaatatcatgttaaattatattctgtaggtttattaagagccattgatttttttaacatgtcataatcagattttttttcttttttctggttagaaaattaatgtggtagattggaagataccgtgttcattttgaaggctgtagcaatagtctagggcttcaattttaaaagatccttttgtggttgacatcattgtaaataaatcaaaatgtgtgaggaaaatacctttcgattgtagaatagatggatttggcaagtggatatgaggattgagggagaaatgagagattggaaatttcatttcaaaagagaaaaatggccagtagccaagatgaatggtaaatgcttgtagatttatatggtgtttttgcttgttgttgaatcttctaatcacctttgatggattctttttttaatatacaacaaacattaattttattacttctcaaattagttttgatttggagaaaataattgtatgactttaaatgtgtgtaatttttatatcctactgtttgtaatatggtaaaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacaggtaaataggttaaccgtattaattttttttttaacttgtaaggatttgaattctttcaactaagtcattagttgccatttagttcatctcaacagaaatttattgaacacataggcaaaattttagttttatgttttactcttttctgtacctctatatacatttcccgttgaaatttttagactactttacagaaataggtatcactggttctttttaaaagcccctacctgagacttgacttatgcaaatgttagggaatggatatggagttgcaaaactgattatatcagggtgtaaacattttaaatttagcagcagttttttgggctaattggatcttaaaaaatgagacttcaatttagtaacactacaatacagtattttccaagtaagtttgcaattaattttggttttaatcttgttctttctgcttagttatctgaattgaagaaaacactttctagtgttcagaatgaagtacaagaagctcttcagagagcaagcacagctttaagtaatgagcagcaagccagacgtgactgtcaggaacaagtaagtatagccaattattgagaaatgagcttcgatcctagagaatgattcttgaagtatatttatgcattataagaactggtggaccttacaaaaattcaagataatttccacttttgtggaacttagacaagacaaattgaaaagtatagatggaaggctaaaaataaatacatagggcaatattcattaacaaagcaatcttgacaatgggaaaataaaaacaggactaggagactaaaatttgtacttggctctcatttgcaaaaattattttactattgtccttcactagatctgattataaaattacagatacagttgattagaggcaacctttgctaacaaaacaagaacctcttgataacattgttaatgcattaccaagtttgcgcagatatctatatactatttataaaatgttaaaaaagtatcattattttgagtgtatgtatgtatgtgcacacagtattgaagctttttataatttttttatgaacaggaaatgataaaacaattcaggattcagagttactaaaatggtaggatgggatagcagtacatttgagcatattggtaatgttcttattttaagttgggtgtcatgttaatagctattcatttgcttactattctttattgcctatatatatgtgacgtgtatattgctattttaaaatgtaatacagggaagaaatgcttcaaagtaaatttcattaaaatcaatggatctataatttagtacttaatatagctgagttatgtttagcttcttatatcaaaaagtttgtccaaattgctggtcttctaagcttcatttctgacagttttataatattaagtaactaaagcattaacttttaattattttcttattttgctacatttagattgtctttacttttattatttaaaaagtccaatgtgtatctttggacaagtgctaactagttttatggatttttaatctttggtatcaattgggtaataatttcttataggctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggtattattgtaaatctgaatagaatgttctgttgaattgaaagagttgtttttttctttattttataatgttttgagatggagcctcgctctgtcacccatgctggagtgcaatggcgtgatattggggtcactgcaatctccacctgctgggttcaagcaattctcctgcctcagcctcccaagtagtcgggattacaggcgttagccaccgcgcctggccaagttgttttttttaaatatgcattggaaaatctgctattctgatagactcttggcttgcaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcaggtaaatcatgttcttactgcttcatttctgtggtataacaactatgaaatgaaactacaaatatataaattagagaaggagattatacacgattttgatataaagttcattcttttatttgtcaaagaactcataacttttaacatttacacatattaaacaagtgactttaaagttgaatctgatagtaagaactagagcagttttctcttgaaaaactaaatgcctttcagatcattttagagataaacattctaaagccagtgtctataaaagaaaatagaaatacatctcccattattatttattattaatgaaaacgtgtaatagttattaaagtcaatgatttttgtcatcttaccaaattacctacgttttgtaatgttggctttttaaaattcacataaaattttaatatctgtatttttgtagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattgaacagggaaaagtaaataatgaattttatgggatttatgtgttcagcaaaagctaaaggttccagaattatatcctgtttaattcaaatgtatctcaccatggaaataatagagcctccagttcaatagagttaatacttggaggaaaagggacagaatcagagtctctaacaaagactgcatattgtttcagtcttttccgcttcattttttattcctttgggctatagaaagtaaatactagaaaatgcccgcctacgaatgagttcatagggggaaaccaactcttaaatacaggaagaagagagtcaacaagtaacatagattatataaaaaataatataatgggccgggcatggtggctcatgcctgtaatcccagcactttgggaggccgaggcgggtggatcacgaggttaggagattgagaccatcctggctaacacggtgaaaccccgtctctactaaaaatacaaaaaaattagctgggcatggtggtggcaggcacctgtagtcccagctactcgggaggctgaggcaggagaacggcgtaaatccgggaggcggagcttgcagtgagccgagatcacaccactggactccagtctgggcgacagagcgagactccgtctcaaaaaaaaaaaaaaattataatagtaatgtaatgtctgtctaagcatgaacagtgtagcatggcaaccacgaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcacagaaaagtaaacgtgaactttcaaaaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtttgttgcttagttatcaagagtggaagcatgttgtttttaataataaatgaatttttacatttgttgttaaatattggcatgattttcaggtgaggaaactggagttagatattttacccttacaagaagcaaatgctgagctgagtgagaaaagcggtatgttgcaggcagagaagaagctcttagaagaggatgtcaaacgttggaaagcacgtaaccaggtaaatgcagttaaaactcttccaaaacatggaaacacgtgtttttaataataggggaaacttaggggaataaaaatatttgaggaactagtgaaaattactgtgtttattagtgaaagtctattatgttattaatacatgtaaatacgtgacagatgttaaacttataacccaatttataaaaaattttggttatattatatatatttctaaaaagcagttattttccataattttaaagttttagcctttcattttatctctaaaatatttttatacatgaaaatagaaatctgaggccagacacggtggctcatgcctgtaatcccagcactttcggaagccaagatgggaggattgcttgagcccagaagtttgagaccagcctgggcaatgtagtgagactccaactctacaaaaaattaaaaattagctgggcgtggtggtacatgcctgtagtcccatctacttgggaggctgaggtcagaggattacttgagcccaggaggtcgaagctgcagtgagttgtgatcatgccactgcatgctagcctgggtgagagagggagaccctgtctcaaaaaaaaaaagcaaaataggaatctgtataatttattgaatttattaaagcactttaaaaagacttgttcactggaacgtttttagggagatgaaaccatgtaacatactgtggttcgaaactccagccctttattcaaacaaaaggttagaaatctgccttgcatgtattatttatatgacttgggagagtttcttaacctcttggagctttagttttcccttatcacctttcgtgtgataaaaatttaacaaatgtgaagcacattacctggcatctacagaaggtttgtgtgtttaacttgtaatgcattgtctatattttttttcttgtaaatgtcacttcaatgaaattaggtacttaatattgaaagttttgattcttcagatccctttatttggcttcattgtaactaatatgaaatgtttattcacaaatatgaaaaaataatgaacatttaatgacattttatttttttttcctcttgtattgtgggtagacttcttagccaaacaagccaaagcttagtttgatcttagtatcttgtagttccatgcttgattactttacatgcaggacacctaatataaacataatcagatattctgccattttattatagcacatttgtttcataaaacctaaaaaaatcaagtatgcatttttgttattctagcatctagtaagtcaacagaaagatccagatacagaagaatatcggaagctcctttctgaaaaggaagttcatactaagcgtattcaacaattgacagaagaaattggtagacttaaagctgaaattgcaaggtatatggaaagaagccttaaatcatatataatataaaagaagtttattttacttatttacatgactccccaagtgcctgcctcctggttttagaaagaatggaaagtgctagagcacctatatctgacttccatctactttgtagagtcaagcagtgatttaatattatgcctttgtatataaaatatatatgagactatcctcataattatttctctatattttattttttaaagagctactcagtagaagtctaaagctaaatttacagctatcaaaaacttacaaggaggttttttttttcttttggttagcttatatttgtgactctataagggaagtgggttttattactttggcttttgtgttcctttttgtggagaacagtgtttccctctgttgcccaggctggtctcaaactcctgggctcaagctgtcctcccacttctgcctccctaagtgctgggattacaggcatgagccatcatgcctggccaagggaagcttgtaagtctaattttttctcacatgaactaatagcaaagtattgcccctttaaaattaagaaattaaacattaaaattaatgtttctggtttaccttttgtaagctttagtgtaatttgtccatatcatggtcccatttatatattgctttacaacttacaaatttttgtgatatatatacgtacattctctttatagcaatcatctagcatgttaagtaggagagttatattttaatcttaaaaatgaggagcctaagattcaaaaagattgactacctaattcaggccatctgatttcaagttcagttcagaattaacccatactcttaattcaggccatctgatttcaagttcagttcaggatataggacaggggttggcaaactgtagcccatagaccaaatgtggcccatgatttggttttgtacagcctataagctaagaatgatttttatatttttaaagcattgtttaagaaaaatacagcaaagactttgtggcttgcaaagcataacattctatccggcccttttacagaaaaaatttgacaatactcagtgcagtaggaagagggtaggttttgctcttaaagcaagtctgaattaaaatctgggtaccatcacttgattttagtttgtaaaattgcgcatgttacttgaccattggtagctctgtttttctcatctctaaaatgtgcatgtaaacctatgtaataagatcttgccgaagggctgtaaattcgtaaggtcttacctttgaagtatatgggtattttttaggattttcaaaaaaaaaagttattaaagcagtataacataaagttacattggacttcaaactttgaaaaatgtctcatatatttaatctttcttctttcctccattttttaaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggtattttgaagaaacttatcttacaaaaaaaaactaggatgaatgttatgaaatcttatttctttgtaattttgaatattactagcttttagataccgaaatcgtgtaagcatatatgatatctttatttaagattagttctttaatatgtctgaaaatgcattataaactcacaaattttggtaaatactagatagttcagtcttcacctttcaaatactctccattttcaaagctatgttcttataactcattgctaattagaattgtgtatattaaaaaatgatgactaatctggttttgtatagttttaaataaattgtttatgttaaccacctatcaaaaaaattcagaaatctttgttatatttatattttgaatctaaatattgtttttaattcctgaaggtaaggaatttgtatgttgagaattatgtatttatttcatgttggattagaaaataaatataaagaaaaaaaattcacaattaatacccctttgttttagccactattagtacattagtatcccttttcatacatgtaagcgacgtttttccaaagaaataatattatatgcttatattcttttgtatacttttttcacttgattcattatcatgaaaatacagttaagtgttgaaaattcaactataatgcatcattttgattagctgtttagtattcagttatgtggaaaaccataactagttccccatttttggagattacagttgtttcatagaaaattctgttttgaataccttcagggataaaatttctttgcaaagctgtgattattttcttagacaaacttgcagaaatggaattactgaatataaatatgtgagtgtattattactgtttgttgtcttaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaaggtatgagtgtgagaacagtctgttcctaattctttcctgttatacacctaaagaaatatgtgttaactactgacactttgtcttaccatgtgggaatggatacattttattctttttactttgaatggctcatgtatgtaagtagtacccaatcatcttcaagtgtgcatttagttggtctgaccaccatttttatacttatacttccatttaatcttttaaaaagcaaattaataagttatactttaagttgctaccacatacagtttatattgaaatgattgaattccatggtgaatactttgttttcctttaaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtaaatatctgtttaaagtttgaacttggtagtgaaagttgattatgtgttgcaggcctaaaactaaatggaatagaaataaaaggtatctacttatgaagggtgtttgtgtgtgtatgtgtgctttaaatattaggaataattagttggacacaaagagcaatcctaattttcaagtgatgaggatatccttgatatgatgaaatttttctcaattgttggctggcagtagataatggaatactgctatccttctgctttcatggataacaattctatcttgtgacagagatcctttgagcccagaccgtgctgtctagaaaccttatgtagactgcataaagatctttaccagcccagggatttttttgtgcctcgtttggtggaggacccctctagcttttcagggagagtatcatgtcaaatttatgaagaacctagttcttcaaggctcagggctttattcagccttgcctatcagtctgctgagtagttaaataaaatgtcaaatcagttggattttgttacaggcatttttttaaaatgatctctaagacagtgtcctaacaacttacttgattttaaaagttcttgaattatttttaaacagtgctgtagattatatgaaataaaaattttgcaattcatagtaatgaattgcatgatacattgaaatataaacgggcttctgttaactaggatctttagctttttgagattttagttaggaaaaagtaaatttttatgttggagtaagtatattttatattctagtaataagttaaagcatgaatgtacttagaactttgctcattgagatgtatgatgtatcataactaatgtagatgttatagtagtagaatctgatgtgaccatgtgccaattaagtgcataaatgctgttttaaatgtttgattataatattaatataatcgcctggttacttctttaggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtgattagctaattctgcttaagtaacaaattgtttttctttgtacattttacttgaaagtgcttggtgatataggagcctttgtcagtgaattttggctaaaattcaatatatgcggagagaattaacaataatgacaatttttttgtggcatttttagtggactcttgtgggctaggaacaacaatcaagagctttctctttataggtccctgaacagcagagacagatcacattgaaaacaactccagcttctggtgaaagaggaatgtgagttttagttatttcatagtctgttatttttcttttaaagctcagggaatatctagtgatctttctgtttaggaaaaagaaatctgtgtattctattgtaaaaacatacactaaagagttgttttctctgcagaactgtatcatgtatttgccagcttgttttcaccatactttcagtcctatcagatgaagctttgtgacagagaaaacgtctctcatcttttagtttacagttggtttctaagttaggctgctactgattttccccgtgatgttacatgatgacagatagaaaatgctgggctgagacttgggttcagcaattcaacagctagatacattttacattgtcaggatgcaccactctggagcattccctgtgtagtttttaatgcttaaattcaaaacagctttaataaggctctgaaatatttagtgaacaaaaaaatggagacctatactcactgtgtttttaaaagtatttgcataataatttgttattaattattcttccattttctcctctataagtgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaaggttagtaaaataatacagatctgatgagactgcttatttagatttattatgagaagatgacagtaatttcaaagacaaatgaagcatccactacagctgaagtcacgtcattgtaaaaatgggtgtttaatatttgaaggacatacttctaggaccaaaattttcacttgtaatgacaaagaatatatgaaatccactttggaaaatcatactgaattactggctcaatccaacattgctttctcactgaaactgaccatttcattgctttcttcaattttttcccatgacactcttgttattcattacagcaattacaactttgtattttattctgtggtatacatgctttttactccactacattgagctcctcaagggcaaaaatctcagcttcttattgtttaatccctttacctaactccacagtaggtgttcagtaaaactttgctacctgcatatttccttagattcttatcttgacaaatgttagaattcagtaaattattcaagtatttctgtgctgtgaaagtagagaatgttttatttcagctacatccaataaactaaatatattactaatcaaatttactatctgttatatcaattaaaaactaaatgatgcttaatgaaaaattctaattttactttgagcttaatttcattaattttattcaacagtaatttaaatgaatagatgcaaaatcagttacagatatttatttaattcaggcaacattttattgcatgctaccatatcaattacatagggaatataaaaatgcataatacattacctttacctacaatgtatttgtctaccaagtgccaaatctgtgtgaaaggtgacatgtaccacagaataggaaggataatttcagctttgataaaagtagaaggcttatattcagcattataattatttttcagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacaggtaaaagttaattttaaaatcgaagtcagagtagacctatgcatttataagatcttgagtgtatcttgcagtatatatatcttgagtattctttgtacaaatgaagttagaatagacctacgcaattataatatcttggatataatacgtatcacaagtattctttgtgcatacatgctttctaccaggaattagaatgaatgaatatattactaacattttatttcatgtttactactgaatatgactattttaaatcagttgtttgtcattaagatgattctccccctccagttattttttttactggtcttacatattaatgcaaaacattgtatataatttaacggaagtcctgaggactaaaagacacctaagataagactatatactgatttacatacagtgtacattttttcttattcaaggagtcctgagttttatagaaggtcccatgtaaactttgtagataacaacatagtaatacaatctcagtgaaccagatatattgtaaaaattggctggctttattaagcaaagcttgggttggtataaaaacattgactcagagcataagttgctctttgtttacccatagcttagcagaaacaaattatgttgatggacattgatctaggagttgattgattgtattttagtaatctgtacaattaaatgtttactgtgttctcctttagttaagtgaccatattgggtaaactatctttatctaaattgagttattatcatgctctaattcaagatttatataatttcaaagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggtgcgtaaagttctttctgtgtattttaacttttaccagtagagttaaggtactcttttcagctacagcctaaagaaaattaaccttttggggccaaaatatattatctggaaaacacttttattgaactttctacaaagattccactgacaacccaggtattattaccaacagtgttttatattcttgcatatctttaattgcatttgtttctatttcaataaaaaagctcagtcataaaaacataagttgaatttcatctcgaagtttctaagtctcatggacataaactgttacctgctatctttttctaagattagccaaaattatattcctttttgtggttaagattaaattgtaatgaagcaggtttcaaatcaaacattaaggctactaaattaattgtattagcatgtattaatgttcataaaccttactttgtgtatactgaggaggaatgtgattataatttttaaataaaatttttttatttttctatagtttcataaaatatagatttgaagggttttttcaaatgagagaactaacaaaaacaggtaacccttcatctactacactgatatggttaatatattagtgtattatgatacaggaagaagttatggcagaagaaagtactgatggagaggtagagactcaggtatacaaccaggattctcaagattccattggagaagtaagtaaaaacatacctaaagtaccacaccgttgcttttcgtgaatgaaattagctttgacaaattgaaacattatttggtctttttttttttagcttgttcttattatatgtaatgaaatactactagaattaatcattgcagagtctgctttcttttactcctatgagtatagtgtactgccttctaaacttatattaaagaaatgtttttgttcatatatagcacagatttccagattttttagagttgtgagccaagatttttccctattttaattacatgaaatacaagagtgctggttgcatcttgagttaatttatagtgccccatttgctggttctctcttactcccctgtattatttcccttacagaattaaagtaatccataaaaggaaatgcatttatatacctcttcattttttgatctctcattgaggttcccctagcagttttactagcggagagaatatagaccctgaagttacaaagcatgaggtgtcattcctagctccaccactaggaagctttgtgactgtaagcatatcattaattccctgcattgtctcacttgtcaaaaaatataatttttaggattgtaaaatacctaaagtagtacctgccacatattaggcactcagaatattattactttcctttcttccttctgtcccacaaaatgagaattcatattgtcatcaagaagacccccagggtggctaaatagtgtttaatagaaaggagagctttattagtgatatcattttgctcatgaggaagaaatagtctccagcgtggaccaaaggtgttctgtcttcacacagggcagggacaggtgtggttttatgcctcacagggtccttattacacaatagagtcatgcatattcagcaggttttggggaaacgctatacatatttatgaggggaactgagcatataaacagtaggtaaatatatataatatacatcccatgttcactttggggcagcgttttagcatgaaaatgagctggaatttggctctttacgtgaagagtgaacaaaaggtgaactacaggacacaaagacagtttgtgcgcagcctctttaagcaggttgaaactagcttaaggtgtctgcagttccttgccagtgctctctacagtcagagttgtagtggtctggattgtaaatcagagataggagtctgataacttgcccgatagttccagttagaggagtttagcaaaggcttatatttttttattgtaaccatatgaatttagaaatttaccatgccagacaggccctgaacccttgacctacgggtaacttttgtttccttaaccttagggtttgtcttagttgagaaaatggcatctattttggtctctcaaatcacaatgtatgatagtaattaaatatcaatatttaacacagaactcattactatatgccaaatgttgatctaagaaatttttatttattaactaatttaatcttcattatacctcatagttacagaaactgatacccagataaagtagtgtaccgaagttcacatagcattggagctcagattcaaacccaggctgtgtagttttcaactgtcctaagcttgaaacagtacttttgtctgtataaactttctggatcatcttatgctataattattttatcatgtaaaattaaggaattgtctcaagctaaccataaatagccatatcgcaagtaaattttagtttcttagctgcgtttattttgtaagttaattttaccagctttctttgactgaaaacactaaactaaatcttcagatgattatgtagtacaggttgaacatccctaatttgaaaattcaaaactttttaggtgccaacattgcaagccacgtgtgtaatgttccacacctgacctcatgtgatgggccacagtcaaaacagttagaacttcattttatacacaaaactattaaaaatattgtgtcagattaacttcaggctgtgtgtataaacttcaggctgtgtgtatacacctttgtatatgaaacataagtgaattttgcatttatgcttgcatcttatagctgtctcattatggatatgcaaatattccagaattctaaaaaatccaaaatctgaaacacttctggacccaagcattttaaataacttattcagagcgtactataaatgatatctttttcatctatccttcagagagcattgtttctgaagaacataacaatttgaaaataataagattttctgccttcttgtcagacttggttaaattatactgaaatcttctgcaaaagctttttcttgaaattagcaaaattgtctgtgactccaaaataccatttggatttttattccacccctctagcattgtctactgaatgtgtaacagttcatttttctgattttctgacagtgaagcagacgttcttttcaagtgttgctttttctgaaataagcatgtcactttgaggcactttttaaattataccatgacttactcattttttccattacggcatatgtaattttttatgaatgtcttagtttaaaagatactgttgctagcttgtataaaaaattgattttagtgagtgcttaagccaaaaagacatttaacttttgatagtaaatattataaatgaagttaaaataatagtttatttcagtagttaacaaaatagaattgtggaaatagattgagcaaggaattatttagtatctgatatatttattttggtttgaaggcttggaataattggaattttgaggagggaagaagttctttgtaaaaggacaatgatactaacttatgtattcagtgcttttctttgtaaaaagacagtggtaatagcttatttattcactgcatttccaaattagttctagtttgggaaaaccttctgtttaaacattgcagacccatgagtattttttttttcttttctgactttggtctgcagctgtattgtgcactaaccgccctggccattgagcaactgaaatatggctgtccaaattgatacaaatataaaatatacatcagatttttgaagacttagtagaaattttaaaatgtgaaatatctggttaataatttttacattgattacatgttgaaataatattttggatatattggttaagtatattattaatcacctgtttttaagtggctactaacaaatttaaaattacatgacatattcctgtctcacagcactgatacgcgatatcacgctagtagttttgaatgcacaaatatttgtttatatttttttctctttttcttattggagtattaaccaataagatttatgataattcttctataggaagacattaaggaaactcaaaggttcatcttctttcttcaaaaatacttgaaatgccatttttaaaattaaatgtagctggctgaggtagctcacacctgtaatctgagtactctgagaggccaaggtgggagatcacttgaagtcaggagttcgagaccagcctggccaacatggtgaaaccctgtctctaataaaaatacaaaaaattagccagacttcgtggggtggtgcctatagtcccagctactcaggaggctgaggcaggagagtcgcttgaacccagtggggcggaggtttcagtgagctgagatagcaccattgcactccagccagggtgacaagagcgagactgtctcaaaaaaaaaaaattaaattaaatgctgctagtccataagtactcattattctttactttgacctataataatacctcacatatagttttaggtatgtttatagggctcttaattcttttttaacttttttatttttaaagggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggtaagtttgatttgaaatcatctagtgtttttaaactattggatgaaagtgctcaaatccttgggatactaatgcattggctgtaaattctggttcccagtcagcttaaatagattatatttatttatattatatattaaatatgtaatatattatatattatatatttatatatattatatataaatatataatatatatttatatatatttatatatataatatatatattatatatttatatatattatatatataaatatatattatatatttatatatatttatatatataatatatatgttatatatttatatatatttatatatataatatatatattatatatttaatatattatatattaaatagattatatatattgtttttcttctatcttaattagttcagaaatcaacattttataatgaaaattagtgtagagccagtgatggaatgcccatttttaaaattttgtttcattttgtttttttgacaattgatgagtcttttaggatttgttatcaattagacctaattttaagtcttattgataaatgactgtatggctttaaatgtaagtgctatggtttccggagataaaaagaagaaacaagaattgtttttgtttcctcttggagccccatagttcatttttgtcatttttttatatataaagtgtattttatatatataaggtcaaattgtttgttttattttggggtttaatcctatattgacagcttcttattttagattaataaacattttttaaatagctcctgatatagtgtaattttatcattttcttcaactccacctgtttaaatttagaattaaactggaccacttgatattttgctgacacctgaggtctatattatctttgagcaatctcatgcaaacagttagaattcagaattgatcattattgcactaattccagtaagtatcacagttgtggtatttggtgctgctgtactaatcccatacaactctcaggacaattcctatcttctgattaatgagtcacttaaatttctaagtgtggtatctagacatgcagagcatgtgggccatattctaaacttttatttatgcctggggaactttctactaggattatgaagaggatgaggaagatgatgatgatgatgaagatgacacagggatgggagatgagggtgaagatagtaatgaaggaactggtagtgccgatggcaatgatggttatgaagctgatgatgctgaggtaactggctagaattttaaccattcatagttctttctatgagctttctttcacttgctgttttccaaggatatagaaaggcttatgaaattcactaaaacctttggttgttttgttcatttgttttgttttttgttgttatggttacttatttgtttttgttgtggtttggtttggttaattattctgtccggtttttttaacatatttattttatttgagcattatgttaccacgttttgtttttagggtggtgatgggactgatccaggtacagaaacagaagaaagtatgggtggaggtgaaggtaatcacagagctgctgattctcaaaacagtggtgagatttttattagccttttttgaattgaatatctctggtattttctaaactagaattgcacttaattctaatatataaatttatttattgaattggtaaaaagagattggcccctgttctagctttgtgactgttgtgctctcataaaaagtctactatatttatgattgttaggtgctgtcattatactcttttctgcctcattgggctgctgtaagatgcaaacattttgtaacccttacggtattataaatgctatatgctgccattaagaggaaaaattaaattagggactacttgtaacagcagttcacaaccagaggaggtcagtctaatcaagctgcatgcttcaagatttggggctattggagctttgcagtatggtctgcttttccaatgaataaaagatttttggatcaatatagcatatattttgttaaatcttggataagtcctggaggtccactgaaaagttgtgggcattaaaagagtatggaagtcgtagaaaataattttattttgaaatgtgtattaaataattagtgattatctggtaatagataactaacaactgatactaagctgaaatcattagtgttgacatagtaaaaccttagctgtttagactaatgggaaaatactgtatctgggtttctgtagaggcctgggtatttaaaagggcaagatatattctcattttaactaaagaacagacaaaacttttaaattttttaagagaaaaatacattaatgaatattaagccatataataggtaatactattcttacttttaaagggagatgagaaattgatatactttgaacaaaaatttacatttataaacaatttgtaggttaagaaacattttttgtgtatcacgtagttgaaatatagagggaggaatttttgctcctctaggtctccctccctccctcccttccttccttccttctttttcctatttatttttatttttatttttgcaaccaagcaaaaataggcctagtgccctgaacaaaattaatggatggatttgagtacatttcaagcaactacacttgtattgaattgtttaattcttgtagtaaacttaataaggtttaggtatcaatgaagaatctgaatcgcagaagtaaagtgacttgaggtgtcgcatagcttactaagtagctaagtagcttaagtattagagcaaggatctgaatctagacctcagacttttaaactatgaaattctgtgacatcctgttcaacttttcatagttgaagatggcttcttttgttgctacagtgtatgtagaagaatacccagacatttgagagacatttgttaaaattcaaaattcaggaaaaccaaaagattaaaatgtagttgtaaggcttctcctctgtctttatcctttttgattgttacactgattctctaatggtctaacctttaggtaatttgtctactttattaaaattaatccagatttattaaatgttaattttagttttattttattttattaaatgtttactttaattttagtgtttttaatgtttatcataggtcgagctaagagctttatgttcattatctgaaatctttagaaaaaccattttagaaacaccagacttggaggttacatttgctctattaaccaaccaaaaaatagactcaaagaggttaagggacttgcccaaagccacacagcgaataagtacacatcccattgtctctgggtgtaaaacccacatttgcttccatcacacctcactactttacttctgaaaatattcgtacggtgaacattcctgttggcaagatttatacttctagggattgtccaagtttttttgtggtaaatttagcagttcaaaagtaaatttctcttttcctacaggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcaggtattaaaagtactggtcattatgaaaaatgaacttgaaaaaaatcttggcttttctccctttccattatgtatttctctctctctcttggtttttttaaattagcaatcccatgaactttttggtattttggcatatttttataaaattctttgaactaaaactaatctctgagggatgtttagaaaggcaagtgttactaaaagttgtgcatacattgaaatggttatagtcatagcaaataaaattgttatttctcaagtgagaaaagaaaaagattttcttgggttttaattaaagtacattttcgcagctcaccattatctgatttgaaggtttctttctctacagtgcacgtatttataaaagataaaggaatttctgttgtacttaacagaagaatattttttctcatttcttggtaatcacatattttaacttttaagtttaatgaaggtatgtatgaccccttatatttagcatgtagtagggtcgggcatctcttaatcagaagcacttggaaaaagagtaggaaaagtacaaaagttctattaatttagcttaagtttttccctataaaatagtatgtgtaaacactgtcaaatatagattctactgaaataccactagtgaaaataacttcatgatgggaaaatataaagtcttaaaggatcctgtatggaggctacaaaaatatatccaatctgtccatttagaattatcttaactggaaaacagtttaaaaaacaatactgctgtttgaactccaaaagaatacttgctaacacttccaactaaggaaataggaattaaatttgtttacatacaagatggtatcatagatctgttttaagtattggttaataattggtctgttggttaatagaatgatttttattggttaatattatagactataattaaaaatttgtcattgacaaaagtgatttcttggcaggttttcctgggaaaatgtcctaattacctgtctgctaactattttgttggcagcgtaataagctgtatctgttgatatttggtgtttgtttcattgcctcatttcttaaagcaaatgtaattcctttatcttgacacgcagagaattcagatgacccgaaggcagtctgtaggacgtggccttcagttgactccaggaataggtggcatggtaagtacttacccattatgtaaaagtaattcatttcttgagcagatatttatatagtccatatgtgtggtgttttgtttgttaactctgttttctttgttttagcaacagcatttttttgatgatgaagacagaacagttccaagtactccaactcttgtggtgccacatcgtactgatggatttgctgaagcaattcagtaagttaatgaaagagaaacatactttataactaatcaaacttttagtctttctctgttagtttgtttatcatttggttaactcattgtttgttgagtccctctctactatgtactaataagtacttggggtaggtcagttgaggatgtattgttggggaaaattatacagaggtgaatgacatacagttacttctaccaagaattttgaagttaaagacaatataagaatgtttaagaacatggcctctagagttagaatgcctgtgtttgaaacctaactctactgtttactagcggtagcaagttccttaggttctctgttcatgagcaccttcattttaaaaatgggaataacaatagaataatttctgttgcataagttataagaattaagtgaatcagttaatttgtgttaacatgtttaagatgttacctgacacatgataaattgctttatagttgttgattaagtgttggtaattacaatgatcataatttatagtattcttgtgaaagctaagcaaatgagcaactaactgtaatgtaaacaatgtagaaggataatagaggaataagcagtaggctttgttactacaaatgaagaagtaatttatttcaacaactaatgagaaagaatatgagatgatttaacgcggatgatattgaattcagtcttgggaaagaatagctagcatttattgagcattttcatgcattagtttatttaacctcataacttatgagagtagacattattaatgttgtcatcttatagtatactgaagcacagacatgttaacaaatttgccagaggtcagacagcaaggaagttgcagtttttagtttcaaaccagttagtctggctgtagaggctatgctaagtgttgtgctataccactcctcttaaacggttgaaaggctctccgtgtgaaagtatacacatttattcgtggctaaggtattagttgcttaacaggatgtatttgaagatcagaatttaaaaatttctacaaacttggggaaaggttgattgttctgtagatgtaacatgtggcggttagaaccagttttaaacttgctcagttagccacaatttaccttggctaacacattcttacaaaccagccaatcaatttcagctccttccttctgaaagtcagcactcaggaagagactcactccaataaacatgcagaattctgagtaccagcaatcaacagcattttcactcaaataaatgtcactacccctgtgcctctagaagtcaccacttcctgaactccatgtttcctaaagacattaatagctcactagctaaggaaagataggcagagttaaataatgctaagttttatgtcctgaattataggcagaaagataaatgatagtgttattaggataacaaagaaagcaagtttttagctatctaatattagaattttcctaaaccttgggagctagctagtgaactcttaataagctagacaggtgacttgatttttctatgaccaaatgaaaactaagataaaactttgtctcatgacttcattctaacaactctttttgttatgttttatgttgagtttgtgttgctttcagtttatctatgtgaggatatctgagacattcaagaaatgtgaggcatagttcaggagagctgaaaattaattacatataaatcacaggttattcttattactaaattcattgacagctgatagtataaaaggatttttataagtaagaaaccctttaaaataaatagactttattttcaatctgtttccttcccagtttgttgatgttcattcttccttcttcctatatttttttcaccattgtggtttaaataggttaactttaaatttcatcttaaattagtttttgtccatttagttcgccgcaggttgctggtgtccctagattccggtttgggccacctgaagatatgccacaaacaagttctagtcactctgatcttggccagcttgcttctcaaggaggtaaatagttaaacctttagatcccctgaatttgtatgtatttggtaataaactattaagatgtgatttaaggggggaaaaagagcaaatatgaatatttttaaaattgatattgtttgctaatttatttttttaaatgctgtagtatacttattaagcactgccttacatcttatctttccaacaaagttctaatttctttgagcataaggattagcttttacattagtatctcttctggctcctggtgtaatgtcatacacgtagtttaagtattcaggaatatgtgttgaaccaataaatataggtactactagccattttaaagttgttggaaggaatgcagcatgttttctgtttacagcttgacacttgtaacatttctaattaaatgtataaggctagttatattttttgtattaacattacttaaaaaaacaaaaaataaaagatcaaaatatgtggaataaaatggccactacattaagtagtagaattagctagttttccacatgtgaattatgctgtttgtggaattgattaccttttaatcctcagttggaattcatattaccctctttatttctgggaagctgtctggcacttggtaaatgaatagagaatgcatactactattacaataagctcaatctttagccatcataaaagtcatgtaatgtaacatctgcttgtttaggatattagttctaacactgaaggcctcttcttatatgaaattgtaagttgactttgtaaatttaaaatgttatgtgattttgtgactttgtatgttaatacagtttcctagacttgggcatctaggcttaaattggaatgccaacattttaagcttagtaaccttggtaattactttgttaattactttgtaattaacatccatagttggatactcaataaaattagcttgtatgaaactcttaagagcattttagcgaatgttttaagggtactgtagcattagaaagtttaaaggatgtctttaagttgtatttaaaattttgaggccaggtgcagtggctcacacttgtaatcccagaactttgggaggccaaggcaggaggatcacttgaggccaggagttcaggtgcagccttgacaacataacaagactgacccctgtctctacaaaaatgaaaaataattagctgggtctgtgttggtagccctagctccttgggaagctgaggtgggaggatcacttgagcccaggagtttgaggctacagtgagctatggtggtgtcactgcactcttaacttgggtgacagaacgagaccctgtctctaaaataaaataaaaaataaaagtttgagagatggatttttgcttgatggaataattaaatcgtggactttagtaaagttgtatatctccaataattaatatttttctttcacatccctgacttgttgataattttatgtttttttcagtcattcattaatattcagaattgtctttaggtttaggaatgtatgaaacacccctgttcctagctcatgaagaagagtcaggtggccgaagtgttcccactactccactacaagtagcagccccaggtagggatcaaaggcagatagtaggttctgttttattggtaaaatgaaaacctatgaagtatcttctggctaaaaatgtgataaaccacaaagttttaaagttctttttcttgtgttgtctttttaaagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaagggtaaaagtttattttgttgtttttgcttgctttagtctcaacagacttgtacatttgttttcctttagccaagaaacaatctgcaaagttgtgttttgtttttttttgtttttttttttgagacagagtctcgctctgtcgcccatgctggagtgcagtggcgtgatctcggctcagtgcagcctccgcctcctgggttcaagcaattttctgcctcagcctcccaagtagctgggattacaggcacccgccaccatgcctggctaatttttgtagtcattttgtactgaagttttcacatgacttaaactggagcagattcatgttattcttgtactgtctccctcatttgtgtcttgaatggaagagagaaagatggatgtagccactgagccaggaattttacatacccatagcctatctcatctgggctagagcccgtggtttggttactggtatactatttagtagtgtgactgttgtgaactttttatagtactgtgctttcctaaaatgttgttttgagatttatcaaaatctggaccatatatttcttatgagtgtcaagaatgtgaacatccttgtcaaaaggaaacataagaagaggaaaatcataaactaaaattggaacatgtcatagtgagaaaaggaatgaggaaaaaacaatttgagctcttttcccccctgctcctttgaaaaatatatatggtaaccaaatcagtctataattttttgtttaagggagctctggattacttaagtgataaaatagatttaaaagagtggatataatttatgattgactgtaggatcagttttgtattttctcatttttcttttccttagtattagttcagaagcaggcctagaaattgatagccagcaggaagaagagccggttcaagcatctgatgagtcagatctcccctccaccagccaggatcctccttctagctcatctgtaggtgagtccctgcccttgactgcaatacagtttttatacatcaaacttgtttgtgaaaacactgctttattagtaacaaattaataatccttttttcctgtattttaaaatgctttatttaaaagagaaattttattattaaaaggaacttggtttatattgaaataattattctaagaatattctggcatcaataataagaaatatggacatggtggatccatcccaaaagaatagctcactcatgtttcatctagactattggttgtcaacatatgttttgtagagctcttgggtcttttagaggtgctacaggggttgtagtgggtgggtatactgggagggaggctaaggagtgctagggcactccaggcctcttgcctctgtttgaaccacagcagctccatttttatgtgttctacatattggggttctacatgagatttgatgtggagagttaaggggtaagagctcagttgcttaaaaaaattgtttgaaatttactgatgtaaacagtttcagagtttggcttttcaaatttttgaagttattttgaaaaaaagatatgtattattcctgtaatagaagttattttttagaataacagttagcatttactgaacacttaactgtgtatcatgtagtattctgagccctttacttatatttccttatttgattctcgcaactcagtgcggtagatattcatccacattttatagatatggaagctgaggcacagaaagggtgaataacctcttcaaagtcaaatagctaataagtaacggacaagcaacgattacactgaagaagtctggctccagagaccccactcttgaacaatacactatactagctcatctatctcaaatttttagacagagaattacctttactattaaggatatacagtacttggtcattcagtctgattattttaatttttaattgtttacagtggtaattctcaaactctgccatggaaccttcagattttatggcagacctgctcagttatttattacttttttaaatcacagaactttgctatcccaaaatctcttcccctgattctcagctgctttgatgtgacacatcagcctattggttaatatccctaatatctaccgtttcatatctggtaactttaaatttctatacattatgtaatatggatactcataactaatcttgcaatcaggatttaaaataatgtatgtaaattacagaaccatttcatacgcagtaaggcttaaaaaatgtataacaatcatattaatgattactgaagttttgtgcccccagttatattttgacgtcccataaaaattggctttcctcaatagaattagcacttgttatatcttatcagagcttgtatgagaaaatatggttgtttcctttaaagtataatatgaaattacgatgtctttaaatttatttgataatgtaaaactgtacttcccccatctgagtattcatttggtcaacaaatatttgacagtgtagcaggcagtttcataggaagcatcactaagagaaggtgacatttaagagctgaaagaagaaagggatcaaagctgtgcagttacttaatgaagagcatactagatcaaagagaatattaatagatgccaagtccataaggcagcagtgtgtctgcttgtgttcagggtcaacaaggaggccactgtggctggagcacagtgagtgagaacagagagtagcaggagatatgttaagaggcgggagaggatagatcgagtagatcattgtaattgccttggctgtcatggataccagaagctattggagggcttcacacagaataatgacatgacatgatctgatcagtttggctgctgcatacagaagagattaaaaatgaataatggacagaaacgagaaactttggaggctactgcagtaagtcaggaaaagatagtaatggcttaggtgagatggtagagttaggattgtgagaagttgtcagatttgggatatatatttaaatttgagcattcatgatttgctaatgattgcatttggggtgtctgaaaaagaatcagatataatttgtgttctgttgtaggctgtttgctgagggacttgatattttgttttctgttgtatttctcagcacctggcagtatgtttgatacatgggtagtcaacaagtaaatatttattaatataagtgaatgaatgaaaaaaagtcaagcacttctggtttttttttggtgttttttttttgtttgtttgtttgttttttttttgagacagggccttggtctgcctggttttttgggtgttttttaaggcaggatctcaccggtctccctggagtactgttagcttgatcatggctcactgcagcctcaacctcacccgggctcaagtgatcctctagcctcagcctcctgagtaactgggactgtaggcatgttccaccatgcccagctaattgttttataattttgtagaaacagggtctcgctgtgttgcccaggctggtctcgaactcctgagctcaagtgatcctcccaccttagcctcccaaagtgctgctttttttgttgtttaaccatttaccctttttcggtttgttaaatgttcctcattgtttgaaaaaaagaattgaaatcaaatgaacaagtctacatcttattcattcattcatttagtaattagtttgtatcattataaatgctttctcattttttcacttgcttttcttttatcttaatgtttttcttagatactagtagtagtcaaccaaagcctttcagacgagtaagacttcagacaacattgagacaaggtgtccgtggtcgtcagtttaacagacagagaggtgaatttctgacataactggattacatgatagaatgtggaatagtaataaatggaacaagttttctaatccttaagcctccaatttatttttttaatgttccaaagttttattaaataattacatgttgagcaggtgatatttaccaatctgtaaacttcatgtagacagatttgtataccttagatatataataaatatgtgcttatattttatatttattgatttcttccttaaatccaaattaagatttggaaaatatgaagtgttatagtgttatattcatttgttgtatctctacctattgccattatattgttaatttttttatacaacacgataaagctttgtgattatgttttagctagtaaaagtgtaaaattttaatatttccatgttttccaatataacttttagattgtacttgtgtcacaaaaagagggattaatctgcttgtaataatttccattgaagttgtagaatacccaacagttttatatccacaatgcctagatattttttataatgaactagggtaagtgaatacactagttttgaattcttaaaagatatattcaatttgattcttttttcttttacaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaaaaatacatgccaatgtcattcatattatgaaattacaggcagaataacttagatttctgggcatttcaaagaaaagcatcctgagtaatataatttaattaataaaattagtttctcaggaacttctttctgatcttacagactctgcagtgatgcaaatcattataaccttgtgccaaacaaggtatctgttaaatgccacaaatgatagaagtaaaatactattgtcagtagcaagtttactctagtaactggatgttttatcgtaatctcatgaaggttagagcagaattgaattgcagtgccatcattttaattgaaattaaagcaaaagtcttaactcttttccacagcaattagaataagtaccgtagtgtaacttctcacattcagtcatcattgcagccagcatttttactttatcttcatgttttcacaaatgatatcacctccttgggaaactgttagttaataccttacctttagaaaaggcatagtaatcatagccgtcaggttttctgatgttgggcagtgatatagctgaggtaaccacatttggaagtcctctccacagtatactcactttaacttcattatgaaggacacctgtaagtggcatgtttaataaaagataccagattaaaaggcaatgtactatcttggaaagagccagacatctgagttttaatctcagttttagccctctgatgtagaactattgagggttatagactggtatataatgttcttggtaagaagtacttgataaatagtattggttataactaacaaacctgaacaaactgctttacttacccacaaggaaaaagaaagtattggtctttggttattcactaaggcaagtggatgagtttttcatcagtaagcttaaattattagggctgtttgatcagtatccatatttcataagccttactgtataagaaactgtattacatctacttatgtttaaggatttttttaacacaataaaaatgttacctttgtcttgataagccagtctggcaggtgaatattgaattctgatggtgtgtgtttgagaaggtcctatagcacgttcaaagcgacgtctcctaacctgtgtcgtttctccatacactggataatttagagcaggccttcttccagggcacttctgtacaggttcctgtttataaatatactgctgaatgctgccacctgttatgtattagaatatcacatggaaaatgaaaattaattttaataccctcagaaaaggtggaaaacaacttttacaatgtataggaaacagttttgttctcatttttcatataatatattgatattaataatggctattagtcaagggtattataaaaataattattaaactgaaatacttgttgaatgaatagatgcagcaaattacatagttatatatttaatttcaattgaaagtgacaagtgctcagtttggcagcacatatactaaaactggaatgatacagagattagcatggcccttgtgcaaggatgacatgcacatttgtgaagcgaaagtaaatgacatt

SEQ ID NO: 16700 - DNA, 30922 bp, Human
tttagtctgtatgctctccctctaatctcaatatgagtctagaatggggaccaaactaacctcagcttctgctcctccagaaggctgtttgtgggttaaactactggcttattactctctcattacatcccacccatttctctggcacacccaagtatgtccggaccccagaaatggcagaatcctggctcaagctgaggcagacttccccattccacaaaggtgatgcgcgttcatgccaaccctgggccaacgggcccgatgtagaatccctgagaacccagaggcagcaagttcactgatgagtcacagctgaatgacacccaagagataagggaagaacttcattgtgaaagagcccagcaaacctcttaggttatggttgttctcactccctatcagcgtcacgtggagttttgccaaaggaaggacttagtcatcaaacagatcctgccagtcatctggtggctcctggagtgtgccaactgagcctttctatcctcgtggtcaggagaacgaggcttgttaaggactcttctatttattccatcttcttaggacaagccatcagcccctctagcaaggctgcctgctagtccattcggcacctttgtgcaaactaggaagaagggatccatctggggggatggagaaacagcttccacagcacaagtcctccagagcagacaggagacggaaagtatggcacgtcacggccatcatgacctaccttttacatgtggggaacaagcccagagagggcgacgaactcgcccagggtctgtaagtcgctggtttttaaaaagtagagctcgagtctcctgaagcccagcccatgttccttcccctgatccagtgtgtgataagcagtagcttcatggccccataggagggaggccttccttccccagggcgcagagcaagctcaaggacagacaaactcagagggatgtcttctctctcactgttgtacttacccatgtcagagagagacatcatttctgagtctcagaggggctgatgacataaaggtgaggcctaaatggaggcaggtgactaacaatgtcttcagttcattccccgcatccccaaccacatggggagtgccgcttttgcccgcctgcgacagtggttctcaacatttgctgtgccccgaaataaaaacagattgtgggccccgcccccagagctgtcgatccagtgggtcggaggtggggcctgagcacttgcatttccagcaagttccagggtgatgctcacgttgctggcctagggaccacactgagaaccactgtcctagaaatacggtcaacccaccctttcctccctcaccttcttcactctcttcctccccttctccgcctgtttctccttttccgcttcctccaattcctctctggtcctcttctcaccttccaatcagctggctctgccactgactggatgcctgactcgggcaagtcacctcccgtctctaggcccgaggagaggcagtcggctaggccgagatgcccctgcccggctcccccctcgccagggcgctcggcctgggctcccccgtatcccagatcctctgtgcagctgtggccgagatgcccctgcccggctcccccctcgccagggcgctcggcctgggctcccccgtatcccagatcctctgtgcagctgtgctgggagggagctgctgcgtgaatgagatcatcctccagctgccctccagccccgactctgggattctgacctctccttccttccacgtctgagcttttctctctccagttagacacggtatctggagtctttctagggcgcgaggaggggaggataccctggaacgcggggtaggaggctgaggcgagagccccgagcagcggcgcccgggcccgagcgggaggcctccagcagggggcgcgccggggccgcccaggggcggggtccggggtcggcgggaggtgacctgcgccccaggggcgtggattccgcccgggaactcgcggccgcacttaaggagctcgggccagcgcgagggggagcagggaggaagcccggctgctgcggacctcctcggacccggacccagccccagcccggccccagccagccccgacggcgccatgcggggtccgagcggggctctgtggctgctcctggctctgcgcaccggtgaggccccgctgtgagagccaaaggcgggcgggggtcccggggcgccgcggcccggctgagcaggtcccggggctggaaatgtgcctgagcctgcggctccggggcagtgagacgggggaggcaggggctcggggtcgagtgaggacggcggagggaactagcactgaagcgcagacggggaagtctggaaggcttcttggaggaggcggcctcgaacacccgaggcttccgacgctccaaggagaagcgcgggctgaggcgtggtggggaggcctcggggtgtggagaggagctcccggagggcggcccctcccgacgggcgcaggaactcaggaagactttgggggctcggagcagctctttctcccgagcccccgcgggagaagattcagagggactgaccggcaggcgcgggagtccgcccgggggtttctggcacatgcagggatggaggtggagacggaggccgggtcccctcgcgtcggcgccccggggagtcagggcccgggatggtgggacgggaggcgggacctcggggagcggctcgcggggatcgcgggcggcgaccgccgaggggatggagttcgtggcaccgctgtggccgcaggcgacgcactcatcaatgcaaacgatgaagccaccgccacccccgccccgtctgaactttgcagtttcccgcctgggtggtggggggcttggagcgctgcggaggggagggcagttcgacttcccaggcctccgccaggagtggggaggggagggctgtggcggaagcttcagtctcggcccttgggctggtggggctgccacgggagggtgacctggtttcgggcggagtcatgcgtttccctccctcctgcacaggcctctggcagtgctggctggggcagggtgaatggcagaggagctcaggcctgaaagtcatcggccccaaggggctccagcaccccttcctctgggcccctagcctgggagctctcggggactctgacccggtcagatcctgaggcataagcagaagtccactgaggatgtgggtgtctcaggctctctacaagggggtttactttcaacacagaaggtggggtttttatctgctctctcagaagatgaagcaggctcagagaggcttgaacctaccctgatgggtcctcagcctcccctctgtgcctgccgtcttcccttggcagggcctggcactgtgcccaccgagggtggctttgcagccagcatcatcgcagacactccccgaggggacagggctcctggagggcagcccacccacagccccctcacctcactctcccgtcccagttcatgaggaaggcccagggacactgctgggtgagggaacctacacgagcaccctcttcgggaggcctggagaggggaagaagcttccacttccagggcctgccgagactccctagccagtgctcccaccaggtgggggtagctgagaagcgacctgtagaccctcccattcctccataaagggccgggttctgagccattccatttgccagcagccgtgctcctggtcagagaggccctgagcacaggaataccagcccttcccctgtctctgcgcctagtgcctccctgtgggagggcagggctgccctagaggactggctgtccaggcgaatgggctcacacagaactgctggagccaccctccatggtgggccggggctgggcagggcgggggagccgggcctcacggtcccctgcccgcagtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggtgagtcctctcccttccaccctgccagacaagagggctgtgactcaggagggagcacacaacagccccattcaccaggaaaggagccgacctcgccctgccaggcccggccgataggatctcccgagtctccctggccacgaggccagcttgcctcccgccgggcccaggccaggaggtgggagcctcaggaggacccgctgctcagagggcgccagcaaagaaaggcacctgagaggcttcccttccacaaggcccctgccaagggggcccagatggtggcggcccctcagtggccgcaggcggttacttgctcatcttgccatggggctctccagaatggggcttgtgtggtttctggggaaggaggagcaggggctggactcccaggtgggtgagcatggggtaggagagcaggtctgctgagaactgctaaatgacactgacaatcctccgaggcaccaccagagagtggcgtccctcctgggtgggtgcaaagaaagctggcttttcattccagctctgccccccatatgcccccaagacctaatccaatcacaggcccacactggggccaaggctgtgggtcaggctccatgtgagggcagaaaccccaagcacagaccaccttagagaaaaaaagctagaaaacctagggtagcagtagaggcgcagggtggagggacagaaagcgagggagactcacttgtcactgcgcaccgttttctgctatctgatttttttactatgatatctgagtcctgcaaaatcaatgattagtattttttttttaacattattaggaaaacaaggtgaatccctggcctgggaaagggggagagccctgggctctggttgggctcctgggacagatgagaaggacagcacagccctctggggcttggggtggggccccaggccatctggtaggtgtcccgagttctttgctgagcaggccagctgggccaggcttggctgagccacatttccttgcaggcccaggaggctgacgccatcactctggatggaggagccatctatgaggcgggaaaggagcacggcctgaagccggtggtgggcgaagtgtacgatcaaggtaagagggtgcagtgggaggagagaggacagcctgcgctggaagtcagctctccaggctgcccttgctgggcctggcctgagctggccatcagccctgtccacagagcagtcctggagtcccagccagaagaacgccctaaggctctctcaaattccccagggacaggagctccagggacacagagagctgccccaagtctgctcttgcccgcagggagcccagcagccccctagcctgtgcccactcagctcttactgcgggctgtcccgggcctggcgtggtgccgggcacggtgctgtgtgcgtaactgccttgggtgagcaaggcgtccttaatgccgagccacctgcactctcagggcctcccttcagaagcccggctccgggtagggaggtgctgtctggcagcggcacagctcagcagacccagcccttccccttcccatgacttctgtgaccttggccaacctccacttcccagactgtataatggggatagtaacacctgcgctgtcacccagactaaatgagccaggccgtgtgcccacctgacatgtggtatgtgctggaaagtgtgagttcctttgcccagtccccgcatcacacatgggacctgcctccagctcagccagctcctgtgtctcccccgccacctctgcttggccggtgcctggcctccatcacagtccagcgcaactgtcacctcctccaaggtgctccctgagcccctccctctctggagcagggcctctcttgcccgcacccacatggcctctgcaagcctctgcctgctcagtctcgttagtcctcagaggagggtccagtcttcccctgtgtctaccctctggaactccacacagcatctcgcttggagaaagcactggctggttccttgttgaattaatggccatcaaatgacacacggcacagtccaaccctgcacacccatcagccagaaacagctctgcctccgaggccccacgcacctcttcctctttaattaactcgacacctctactgagcacctgctacccgctggtcataagcatgcagcagtaaacgaagagaccttcctgcccccacagagcagagagtaaataaacacacccaaaacaatacagtgacacatgttggggtgctgtgaggaaaagggaagggcaggacagagaaaacgagggttgcggggaaatccactgaaatagagcaggcaggacggtgctctgcagaggtgatgggtaagctgagccccgcaaccatctcaggcggtccagaggattggtaagaaacaaggcgggtgagtcagaggatggtaccagacggagctactcaggttggcgggggccagaccctggtgtgcaagaagtaacactggctttatgttctagaactcaacttcattctgatatggcctcccacaccaccgggcagtttgtgcacgcgtgcatgcctgcgtgtgtgcgcccgtgcgatgggagaccctctgggcatcagttcccacagctgagtctgtgttttgcctgagcagccccttggagccaccttggcacaggggaacgctttgcaaggctgcagagccctggccccaccacacacaccctgcagcattcagggtcgtgagcgacttggggccacatcgctagttctctctgtctctgcctctgtctcactctccttcaaccccctcagcaccaggaaatcgccgctcctcatctggggaagcccctcctcggctcccctgctcctcccagacacccttcttcccatgaccctgacaccattcccccaaaccctccaagttctcctaggggcctaggctcttggaaagcaaggacttgctggcttctgctttctgtccagctaaataactcccctgatgtgagcaaatgtggacccagctaagcaccagctgctggggaaggaagagggggaaatcaatgaatacatcaatatctcaggatcgtctctacctcaagaggctagagggcagggcctcttaatacatgcagatgaagcccacttgctctcttggtaacgagaacgctatgcacacatccgtgtgtacagccgtgctccgtgcacacacctctcccacagcccgcccaggcagggtgctggtgcagcctctctcgaggcctctccctgctgccctcacccactcccctcccctcctagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaaggtgagggctttgggctgggcaggagggtccccaggcctccccctcctttccttggcccatgctcgtcccttcactgggtagcctccctccggcctcgccaccattcttcattcctggaaggcgcagcagcccccgcccgccccgtgcctcccccgcctccactctgccgccggcgccgccgcttgacttcctgcttgcttggaccctgtggggcgcgattcttgctcacgcatcgtggtgtcccacatggcacagccaggcacaggcccagcccatgagtgggaagcagtgaatctcccaggagtgcttcccaccagtatagaccgggcgcaggtcactgtgtctagaaatgtgtcctcggctttacaggaccagaaatgctattttttcaggacccaaacgaggtgccgacttgcacccagaaagctcccaagtggctcatcagcccaaccagccgtgtaaacccgcgagagcctggaagcctcaccctctcagctggtggccaggtgtgagtggctcaccaggcacttggcatatttattaaatatctactcctctgggaggtcacaaaaaaaaaaccaggaagagggcttactctggaaaagctcagtctggctggcgatgagcgtggcccgactggctcaggtgccagcagcagggcctcctcgcgcggcacaggataaatacttgtgggttttggtgctggcagggccggaagaaccatgcagggcggcagaccctgacctcgtcccccgtgaggctggccgccgggcgtgtgcctccctccctgtgccgtgagaagggttgtctacccatcagtgatcttcaataattctttatttcccctctgtcatcagtcacagttggctgagctggaaatgaaacccacagtgagaagagcatctggctgatactgagttatcccacgtggtcatttaggaggaaatgtttagttcccccgaaccatttttaaatgacagtcgctcccagtgctgtctgctgccttggtggacccggtttgggggtcactgatcgggtccactccccagctttgctcagactgaagctggaaggtggaaccattctcagcagagtccagatgagagcccgggccccctgctgaccctgggggcttggcttggctctgaagaaagttctgctgagtgacctctctacctccttcccacagctgtcagcgactattttgggggcagctgcgtcccgggggcaggagagaccagttactctgagtccctctgtcgcctctgcaggggtgacagctctggggaaggggtgtgtgacaagagccccctggagagatactacgactacagcggggccttccggtgagcggagtgggggcagggaggggccgagggcagggaggagctgaggccacaaatgctggggaaaaacacctttgcccagagagggccgtggagggggaagtggcatgttggctgcgtctcatcaaagcaccctttatatagttctgtgccctggttagtttaaaaacatccagctggaatatgccaaaccggatttgctcatgaaatcaacgtgtttggtatatttagtgaggtgagggctccaagagaagaaaatggaaaaaacagccttttggccactcccatgtccccattctcagaccagcagggagcggggtcaggggagtgtgtctggacacctggggccggcccgtctctgctgctggttgcggctggcaccttgggtaacccttccgtggatgcaggagactctaacagctcgtggtccaattccatctgcctgcagaggaggaaatgtgctcagcaggattggaaaggaagcttctcgggcccctctagctacctcacgtttccacctggagcagggaagcctgctggtgccccacactccagatgttatctgactggatgcggttttcggcttagagagaagaaacagtcctcagcacccctgagcgggacagccttgcccctccactccccgtgtccttggccatgcacacattctctctggctctcttggagcctcagagccctctcctgatgtcgcccgccccgatctgctctaatccctgtgcattttctgcccgtggggacccaagcagaccctttgcccaggaggtctgacctgcctccaacactgggcagtgacatcagcagatcgtgtaaaagtcaatggtcccttccactgaggattctgcggcatggcatgaaaaggccttctagtccaatcccctgcctcagggtagaatgctcttcaaaacaccctgaaaattagcccagcatggtggcacacacctgtcaccccagctactttggaggcagaggcaggatgatcacttgagcccaagaggtcaaagctgccatgagctatgattgcgccactgcactccagcctgggcgacacagtgagaccctatctctaaaaacaaaacaacgaaaacaaacacacagaaaaccgacgccctgagagtcaaggctgctgatattataatagcagctgccctgggagtgcctgctccctacaggcctgagctaagatggagagggtccatactggattataaggagcctctcatcctcagagcagccctgtgggagctactttcccacccccgctttacagatgataggggctaggaaggggccacaactcggcaaaggcacacagccgaccagccagggagctggaacccagaccacacaactggaaagcccatgcccatcatggccacccctacagcccaagccaggcctccagaggtggaagatgggcaggggcaggggctcagcccatccagacccacagcttctcctccgcaggtgcctggcggaaggggcaggggacgtggcttttgtgaagcacagcacggtactggagaacacggatggtgagtgggggaggggcacgggcccagaggagcagggagtcaggccaggccggcttggggcagggaccctagatggcagagttgggatcaaacgccctagtgcagtgctgctctgagtctctgggtgaccttggacaagtcccacagtctccgagcctcagcactcccagctgcaaaagagcagaggcaggtgtcaccagtggagtgcccactgcccacagggcaggagaagggggccagcgagcagctctgctctgctttgatttgaatatggcattgggttctggttccacctgaagatgagggtctgattttttaagcaatttgcaaacccctgcactggatctcacctaccagcccttcctggcatttttctcctcttgcctggagaatttgtccctcatccctgggaaggtttaagatatagtttggtgttgaggctgggcacggtggctcatgcctgtaatcccagcactttgggaggccgaggtgggcggatcacgaggtcaggagaagagaccatcctggccaacatggtgaaatcctatctctgctaaaatacaaaaaactagccgagcgtggtggtgggtgcctcaaatcccagctacttgggaggctgaggcaggggaattgcttgaacccaggaggcagagattgcagtgagccgagatcacaccactgcactccagcctggtgacagagcgagactctgtctaaaaaacaacaacaaaaaaaaaacccacaaagactggtgttatatattgagccatcatgtcatttaagttttttaattttgaaagaactgagctttggaaaacttacaagaataactcaaagagctcccttctattcttcacccaaattctaactgtttagcattttcccacattttattgtgtgtgtgtgtgtgtgtgcgtgtgtgttctgacccatttgagagtacatttgcctatgtcataccccttgaatactttggtatgtatctcctaagacaaggaggtgtgtacctagccacagtaatccaaatcaggacacgcaactttgatacaatcctgttatccagtctatagccgatattgcagattcactcaccgtcccaattctgtccttcatgcccatttcttgcagaccaggacctaaactcttaccacgcatggggtttagttgttagatctctttactttcctttatcttggaacagtttctcagtctttgtttttatgacattggcattttgaagcatcaggccggttattttatagaatgtccctcaatttagatttgcctgaagattgtttctttttttaaattgagatataatttacatgcagcaaaatttgttctttttgaaggatagttctatgagttttgccaaatacatgcagttgtataaccaccaccacaatcgagatcttgatggggcagacccttcagcccaggagttcctcaggcccctgctagttatctccccgcacctgccagcaagcagcaaacacaccgttctgtctgcagttttgcgtctcccaggacgtctgatgattgggttttttttttaaatcattgtcattctttgctgttattaaccattgccttttaaatcagaaagtccatcacgaaggcaaacatggaccagatctgaggaggaagaaggcgagtgccctgcacacgaggaagcacgtaggacgatgcgctctagtgctgggcaagcctggaaatgggctcccgttcacaggccccaggacgagtctgacaaaggagaatttggaaaacgggcaaagagtagggatatgttgggttaagaatcagctctttcaaacttggggttttttttgagatgggggtctcaccatgttgcccaggctggtctcaaacccccagcctcaactgatcctcgcatctcagcctcctgagtagctgggatgacaggcgtgcacctggcagctttttcaaagtgttgatggtaatctgaggcaatctaagggagtcattttttaagtgactttatacagaaagattggtaagagccaaggggtagaagtggcataaatgtctaaagcagggaagtgacaggactttcattgttcttggctgaggagaagcgggagtggctgatggaagcacctaaatgatgcctttgtctgtgggaaggcaaatgatgccccagagctctaaccaaaggttttgcagccgccgaaaaacaggaaagttgggaagcgggggtaggactacactgaatcattaacagtgctgtaaactaccatgtggccattaacaatgacctttagggagttttcctaaacgatcactctggtgcgggtgtttggttttgttttaaaatagctttgcagtgaaagctttcatgaccatacaaattatcttttttcttcctatttccttgtagaggtttttttcctccttgtcttaaggtcataaaaatattgttatgtgggaccatctgtggtttaattatagtccttaatattcgtcttctcaatatccctgtttggtgttaatagttactcttgcaaattttcttttctatcgagaaacaaatgaacttatggaaagtttccaatactgtggaaaaatactctaccaaataggatgcaaaattgcctgtcaactatgtccttaaccaggttaaaagcggtcaaaaggaggctgggcacggtgcctcacgcctgtaatcccagcactttgggaggccgaggctggcagatcatgaggtcaggggttcaagaccggcctggccaacatggtgaaaccccatctctaggaaaaatacaaaaattagccaggcatcttggtgcacacctgtaatctgagctactcgggaggctgaggcagaagaataacttgaacctgggaggcggaggttgcagtgagccaagatcatgccactgcactccagcctgagcgacagagtaagactccatctcaaaaagagaaaaaaggccaggtgtggaggctcacgcctgtaatcccagcactttgggaggccgaggtgggtggatcacgaggtcaggagatcaagaccatcctggctaacacagtaaaaccccatctctaataaaaaaaaatacaaaaaattagccgggcgtggtggcgggcacctgtggtcccagctactcgggaggctgaggcaggagaatggcgtgaacccggaaggtggaggttgcagtgagccgagatcgtgccactgcactccagcctgggcgaaagggccagactccgtctcaaaaagaaaaagggggggtgaggtcaaaagacaggaaataaaatagaaaaaaggacttgaaagaaatccatcgcaatatgaatagttggagttatgggagatcccccgtcctctctagtcctggggtgggtagattccttcggggtttgtttccaccgtggcccctgctccgggagccctgccccctgccccctgctcagagccaaacgcagtgcctcatggcagccgcaagctcatcctagactcttggtacattcatctgtctcacccaaagcctttctttttttttgagacagagtttcgctctgtcgcccaggctggagtgcagtggcgtgatctcggctcactgcaagctccgcctcccaggttcacaccattctcctgcctcagcctccccagtagctgggattacaggcgcccgccaccacgcccagctaattttttgtatttttagtagagatggggtttcaccgtgttagccaggatggtcttgatctcctgacctcgtgatccgcccacctcggcctcccaaagtgctgggattacaggcgtgagccaccacgcccggccagcctttcttattttcttactttttttatcttgaatagttatttataagtattgtattactgtcagatacctccaattcactttagcaatagaaattggtgagagctagaaaatgagagtaacgagatagagtctgtgtaggtacctggagttgggtgcggccaccaagctctgccaccttctgaatgctgggttctcatgtccatgacacccagccacccctcagattccctctcctgggccttccccgccacccgccccaacccctttcggagctggctcagcccaggcttcctgcttcccagggaagacgcttccctcctggggccaggccctgctgtcacaggacttcgagctgctgtgccgggatggtagccgggccgatgtcaccgagtggaggcagtgccatctggcccgggtgcctgctcacgccgtggtggtccgggccgacacagatgggggcctcatcttccggctgctcaacgaaggccaggtgggctcagggtcccccaaccacctgcacagcttcctagatggtgccgggccttgtggtcgctcagcagggtgggaccaggaggggcaggacccagagactgtccttgggacggaccccagcatcgggccaggtcagagtgaggaaccgactatgctggctggccagaaggagggctggccaggagaggggggcccagaggagggggacccagggattcaggcaccctcagaagaagctcctgagacttgtgtctctgagagctaaaaccaaaacatatgagcaaataaaccaagtaacaaaaccagcgcctttcaaagcacaccattaattacatgtggcgaataaggtttggctaaaaccgccgcttgtgacagcaatagacttctgactgctggtgccccaggctcagttagttttgccctatccaggctgctaccaccagccccacggcgtgtcctcaggaccgtcccatgcctggccacagccatgtgtccaaacagctgagtgtgaggaggccaaatgaactcagagtagacccagaactgacagggcccaggggaaggaggccgcagatcaggggaggcgccgcagaagagggaggcctcacctggccctcagggtgggtgcctggtctgaggtcggggaagaaggaggtaggggccaaagtgggagggaaggatatggcctgtcagcaccctcaccaccctgtaccacaccccttgacacacagcgtctgttcagccacgagggcagcagcttccagatgttcagctctgaggcctatggccagaaggatctactcttcaaagactctacctcggagcttgtgcccatcgccacacagacctatgaggcgtggctgggccatgagtacctgcacgccatgaagggtctgctctgtgaccccaaccgtaagtccacctgtccccactgctgccagctccagcccagctcaacctcgggcatggcgaggctctctgggaaagtggccgggggaagacgctcaccagggaggcctctgcgggaacctgtcatttccattcctctgcccctggggctttggggaggaggcatctcttccactgtatggcctgttgtacctcggaagccccacctggccgcagcgggggaggatgcagaccatcagaatctgtcttgggaagggtctcctcgcccccccatccacggccatggcatcctgtcagctcttctacagcctctcgctcctactccccgcctctaccccatggctacagccctggcgcaggtgccatctttcgcctggactattgcagtagtctacaagtgagcttcttgcctttagccccctggccccatgtatcttccacctccagccagggaagtgggtaccacacactgagttacatgcacgccagccatggtcttcctcaggcctcacagttgccccttttctgtgtgaggaagtgggatccgatggttaaataacttatcccagccacacacctgacaggagaaaggcccagaatttcccttgggtccgactccatgctcttccatggcagtactggcctggcagtgaccgcttgcttgccccaccccagggctgcccccctacctgcgctggtgtgtgctctccactcccgagatccagaagtgtggagacatggccgtggccttccgccggcagcggctcaagccagagatccagtgcgtgtcagccaagtccccccaacactgcatggagcggatccaggtgggagtcacgcaggtgcagcgtgggccaggtgggcgggtggtggcagtgcctgggcagttcttactacccacaccccctgctgcctggggaagaggagagtgtctactgcaacaagcccacagagacgggtggggaggagcgaccgcaggggccagcacccaccccaggggacagagacaggcggggaggagcgaccgcaggggccagcacccaccccaggggacaggcagataggggtgagtcccctggagagcctgggagctcctcactaagtgggggtgccaggagcagaagaagcgctggcccagctgggcactgacgccctgtagcctggggcaagccccttcccctttctgaatctcagccttcccttgtgcaatagagagtgggcgtggatcattgttcgactttttttttcttttttcctgatttttctaaatagacaaataataattgtgcatattcatgagatacatactgatgttttgatacatagaatacatggtgatcagagcaggataataattaacataccatcatctcaaacattgctcatttctccgtgtggagaacatgcaatatcgtcctacctgtttgaaactatgtattattgttaactctagtcatcctacagtctatagaacactggagcttattcctcctatctctcctggctgggtgcattggctcacacctataatcccagcactttgggaggccaaggtgggtggatcacttgaggttaggagttcaagaccagcctggccaacatggtgaaactctgtttctactaaaagtacaaaaaaattagccgagcatggtggcacacagttgtaatcccaactacttgggaggctgaggcaggagaatcgcttggacccgggaggtggaggttgcagggagccgagatcacaccattgcactccagcctgggcgacaagagagagactgtctcaaaaaaaaaaaaaaaaaaaaaaactctccctattcctcccttcccctacccttcccagtctgcagcatcctctgttctactttttacttctgtgagatcaactttttttagcttccacatatgagtggaacatatggtgtttaacttgctgtgcctggcttatttcacataacacggtgtcccccagttccgtccgtgttgctgccagtgacaggatttcattcttttttatggctaaatagtattccacggtgcatgccaatgacattttctctatccatcctctgttgttggacacctgggttgattccacatcctggctattgtggccagtgctgcgataaacatggggtgcgggcatcccttccacaggctgattgcctttcctttggacagattcccagtggtgggattactggaccatatggtattcaatagttcgatttgtagtttgtggagggacttccgtactgttttccatagcggctgtccgggtttacatccccagcaacggtgtgtaagagtttcctttattctgcatcctcactagcatttgttattttttatctttttgataacagccaccctaactggggtgagctgatacctcactgtggctttgatttgcatttccctgatgatcagtgatggctgctggcattttgtatgtcttcttttgagaaacgtctgttctgatcatttgcccgtttttaagttggatggttttctgctgttgagatgtttccgttgcatgtgtattctggatattaatcccctgttggatgagtagtttgcaaatattttctctcattccataggctgtcttcatttcactctgttcgttgttttctctgctgtgcagaaacttgtttgtttgatacaattccctttgcttattattgcttttgttgcctatgctttcgaggtcttttcataaaatcttttctcagaccaatgtcctgaagcgttttgcctatattctcttcagcaattttattgtcttgggccctgcatttaggcctctcatccattttgagttggtccctgtgctgggtgaggggtagtttagggccccgttcattctgcacttggacattcagcttcttcccagcagcgtccactgaagaagagatcactcttttcccaaagaggttcttgaaacctttgtcaaaaatcagctggctgtaaaactgcgggttaatttctgggttctctattctggatcattggtctatatgtccgtttctatgcctctatctttgttctttttgcttaggattgctttggctattcagggtcccttgtggttccatacaaagtttaggattgttctttctaattctgtaaagaatgtcattggaattttcatagggaagttcagcattgctgacagcaccgagcactcagaatacattttgcattgatcacaatctagtgaacggaaacttttctttcagatagaaatttaaaaatgtatgtcctttatatacagagatatgacacaaatggtacccactattttctaatgtattctattctaatcctttttttcctgacacttgtcatgacccactcgatttggcccccatgaataggctcaccatccgcagctagaaacactggcctgatctctagtgcctgttcagctctttcctggttctcttctctgcctggagactaacgccagatgcagagggggcccccgtggccctgcagtcagggaggactgctgtggtcacgggtgtccagcctcggcccagagccccggctgtcagcccttgggtgttcacactccccagtttttgttttcagagcaagtaggtggggcctgctcagggggtccccaagcacaggcccctcagcagtgccaactctgcccaggccagggaaccacatcgactggaaggccacaaagaggagaccgggcaagaatacagggtgaccaggcttacgacgatgaccatcgcgcaagctgacactccccgtatgccccacacagtgagggccattgtgtggatcatctcgtgtaaccctcacaacagccctggcggtggctgtgaccatcagccccacttctgggtctggaaccggggagagagaggctggggaagtaacttgcccaaagtcaccagccgggatgtgctgtatgagcctccccacaccgcgttgcctgagccaggccacagccctgtcttcacacttctggatctcaggagtggagaccaccccagcctcaggccaaggagtgcccaggcccgaggcgggggtgttccgggagcttccgcaggcccgatagaagcctgtccttgtgcagagctgagcgcgactgtgtgtgacggtgacagaggaacctccaccggaactgcggaaagggctcgttgggagggtctttatttcctaatgcctggcaggctgccctattgttccaagagccccagagcagggagaggtgcagggagggaggtttcagctccctctgagtgacagcctcctctcaatctgggctcacagagggccacggggctgccctggggcctgcaggaagaggagagacttcaggggctcctcagaaccccagcaaagggctcaaagaccctcagttctagcttctgaggttctcagagaggagtccagtgtggctgtaacacccattcctgccctgccagttacccagggaagggaccatcagccagaagcgccctgggctgtggtgcagggtctgtgtcctgcccgacagcacaataggaagggggaggtctgagtggtggaaaaagggccccgagctgtgcaccctcctggccccaaatatcaacgccgctgcctgttattaaccgccatcacttcatgcctcttcaggaatggcgtgggacaccttcctggggcacaggtgtccccactctcccccactgtcacactgtcatccccttcccttgaggttaatcacactactatggctctgttaccagttagccccttggcggggtcctgggaccacctgtcaataggcttccgaatggacaagcggggtgggtgcaggtgacctggaggccccaggagggtcctgggaagaaggcactggaccctcccgcgcctccgcaggcagagctccatccctcagccctgaagcctcctccccaggccctgagactgccatcgtttcagatccggtcattcttccatctgtacacgcatttaacagacaggcattgcagcacacgctgtgctggcccttggccaggtgctggagaggcggtgcccggctgtctgggggctggcagggcacagggaggcccacgccaagcatgagggtagggatcgcgcttgctttgctcagagcagggacacaggggaccctgggtggccacgcgcaggagtgctgcgtgggtgtttctgccccttggtcctccaggcaccactcctggccaggcgtcttcacaaggagaggaagggacagactgccaggatggggtactccccacccacattccccaggggaaggaagcctgaggccacaaaccccaagagaccaggccctgccacctccacaggaccccgacatccagagccatcctgggcccaccccggcccagtggcttcttctattcccttcaggctgagcaggtcgacgctgtgaccctgagtggcgaggacatttacacggcggggaagacgtacggcctggttcccgcagccggggagcactatgcccgtgagtgcagggcctgccgcctggcctcagccgggaggtggggatatttttataaatataaaagagtgcccccctcagccattttcaaaagctccatgcctctctcctggggatagtggctgcctgtcaccaggcctgcccctcctgccccaggcctcagtttccccaactattcaacaaacgtctctaaggggctggcaaactttctgtgaaggactagaggataaatacatgaggctttgcagacgacagacagtctctctttcaataaccttttcaaaatataaaaaccattcttagcttacaacccaggccatacaagagcaggcctcgtagtttgccatcttggactactggggcctcctcagcctcttctggccctaagcagccatggaaagtggcccttcagagtccccctggcagctcatttgcaccttctcaggggcctgggctggggctttggcctctgtcctcttactggtgacctcagaggcctgggtcccttccacctgggtgtgagcaatctctgggctgtaggaaaatgcttctgcagcctcagctgcgcctccactttcctcctgggtagtgagaaaaataccacctgggtttaaggaaagaaagaagcccctgtggggaaggactgctggggccagaggaagacaaggctggaaagtggaggcaagaggctgcttctcacaggggacgcaggcaggggcccccgctgggcctgctcccagaacaccctggcctcaggcctgggtactctttggcctgcatagctcaggcaaagagacaggaaggagtgggtttgaaggaaggacccccccaggcacttgcccgggctctcagatgaggggcccctcacgtgagtccctctctccccagcggaagacagcagcaactcgtactacgtggtggccgtggtgagacgggacagctcccacgccttcaccttggatgagcttcggggcaagcgctcctgccacgccggtttcggcagccctgcaggctgggatgtccccgtgggtgcccttattcagagaggcttcatccggcccaaggactgtgacgtcctcacaggtacccccccctttttaggaacgcagactggggaagccttctctggggttagctagggacccgcagcctgttggggagaggaccttgttggaaggtggccaggcttctgcatatgtgcccaggtatctccataagctggggacagaaggacccaccatatgctatacatgaagcccctccagtgtgttagatcacacaatattcatggaaactggcaagacccttgggctgacaggccacacacctctgtcctggctgttaactcagaaaacatacaagcacttttttttctaaccactgacacaagcacacagagggcactagggttggcagctcccactcccagacagctggacacctgctctgattggaacaaaatagtgaggtagtgagatccctgtccctgagggagttcaagtgaaggctgggtgatgtttggtgatggagatgctgtatctagacaacctctgcattccccgcactgagatcctccaggagacactccactcagagctgaggggagcggagcagacaggtggccttgcagtgtaggatccggggggtgggcagacctgtgggggagcggcccgcccagctccctcccacactttccactgctggcccctcatcattgcccttccctccaccccagcagtgagcgagttcttcaatgccagctgcgtgcccgtgaacaaccccaagaactacccctcctcgctgtgtgcactgtgcgtgggggacgagcagggccgcaacaagtgtgtgggcaacagccaggagcggtattacggctaccgcggcgccttcaggtacccgggtggcctggcagtctggggctgtgtgcagaggctgggaccctcctgccgacgcctgccctgccctctgtgtggcaggtgcctggtggagaatgcgggtgacgttgccttcgtcaggcacacaaccgtctttgacaacacaaacggtaggtgggggcaagagcagggccaaaggtaggtcggggggactgttccccatcttcagcaccatccagacaccatgctgggctggggccaagcagcagctcagagaggctgagtctagaaggctgtgccccctgggaagctgggagccccaagggtcacagggtaagaacagacctcagaccacacatccaggggtgctggatacatgacggtttttactggcctggaattcaagtccctaatccaccgaaacggtagaaactcaatcccagtcaatctggaaagacccccttctgggagtattgatgtagtgccaaggtgtgaggtgggagtggcatgagcctctccacagggtcatgagttcaatcagtatctggtctgtgttcctgagcaggtcactgcctcatgcaaggaaatctctctgcagcccccaagccacaccgaggcagggcacgcccaacataccacacagggggttttcttcctggagtcaccttcctgggctccgcctgggacaaagagctcaggaacgctctgctccgggaccccagtacatacatggtcctatcagagcacacgctcccctgacttatatcacttccccttcttcttgttctccgtgaaggaatctgtgtccgttttgaagactagaggctgttttcctccaacaccaaaggcttgtactgtctgcataccctgcctacaccccaggctttgaaaccccaaatgctggaggcccagtcttctccactcgctcccaacatgtctcctcctatagacttagcccagaaaggcacaactgtggcccggtggggaggggactggacaatgggaagcaagacgtgcagggaaaaaaacgaaaacctcagttagtgtttcaaaacttggatcttgcctcctatgggggtcaccaaggcggtaggaccatttgccccagcagagctagggagggctccaggccctgaacccttcctgttgccacagcccagctcccccacccagcctcctaccaagaacacctgaaaccctcccccagggaggggctgtgtgctcctgcacgagcccagcgggcctgcctggtcccagatctgtgcatggtgtcgtctgggatggggtcaggggaggcgggcaggtgctggagaggccttgggaggttcacttgcagtgagtcacccgcctcccagggccactcctttcccttttatctttagctctcctcaaggcccacctggatttcctggaaatgggaggaggatggatactaagtgaatgcacagagacatgaaaatgtgattcctgagggcagcattttctcaggcagcccgagaccgcctgctttagaatcagtgggatgctggtttaacatgcagattcttgagcctgatctgagacctcctgaataagattctttgcaagcaagggcccttgaagctgccttctgcatccacaagtgatgctataccctgttccatttgagaacttcagcccttagggacaatcacccaccaccttcagggagccaccccacactcaggcttgaggatgtaacacatagatggggttctctgcctgggagtgattaacagcctcagtttcctcacctgtaaaatggggacaaaaacacctaccctgcgttactgttgtggggatcaagcaacgcgtgtaaagtacttgtcacatagtaggtactccctactccctgctaattaatggcagctcctgctaatggcatgaacacagctgggttctttcaccccggtaacacagcagagcacgtggagaatggagagggttggggagctggccagatgttgccacctccctgtggtgaaggccttggggtcccaggatagcagcttctctttacacttctctccactcccggaacgtccccacacacactgctttacccccctcaggccacaattccgagccctgggctgctgagctcaggtcagaggactatgaactgctgtgccccaacggggcccgagccgaggtgtcccagtttgcagcctgcaacctggcacagataccaccccacgccgtgatggtccggcccgacaccaacatcttcaccgtgtatggactgctggacaaggcccaggtgagccagggtggggctacctcattgaggggtgtgcagcagaggtaagctgagcccctgggaggcctcagtctacctggagcagacctctagagaaattgaggaagcccgggggaaattctgtgattttcacttacgcaaggacatccctccagaaactgtcccctctgcctcctgcatcgttgattttcccttctcagtcggaccattttcaccaacatgaaacatgctgtgacttctgccatccttaaagaacaaactaacctcttggtctcacatccatcctcttgcagctgtaatcctgctccctttttttcttttttttttgagacggagtcttactctgtcgccccaggctggagtgcagtggcactatctcggctcactgcaagctccgcctcccgggttcacgccattctcccacctcagcctcctgagtagctgggactacaggcacccgccaccatgcctggctaattttttctattttttagtagagaaggggtttcaccgtgttagccaggatggtctcgatctcctgacctcgtgatccgcccacctcggcctcccaaagtgctgggattacaggcatgagccactgtgcccggccaatcctgctccctttcgaagcaaaactcctccaaagagtggtctgctctggagttaacaagtcctctcctctggcctctcttaaggatggagactgagttagcaagtcctctcctctggcccctcttaaggatggagactaccccagacaggctcccaccagggccctgaagctgttcttgtcaaggtcacagtgacccatgttgctaaacccagtggccatttctcagtcttcattttacttgacctctcagtggcactggccacagctctccctcctcctggaaacaccttcccctgcagatgcccaggtcctcagccctgcctggctgtcctctcactctctggccactcctcagtcttctctgctgatttcctccccatctccctgacctgttagccctaggattcagttctcagccctcttccctgtctacagcttacccttgatctcatccaatcccatgtcatcaaataccatctatatacagatggcttctaaatttacatcttcagacatcagtcccaaacttgcatatttaactacatacttgacattttgacttgtgtttctaacagtcatctcaaatggatcaagtccaaagttggacccccgtccctccttcagtcttccccacttcaattaagagcaactttagcttttccatttcctcgggagtcatttttgactccggtcttcctctcgtgctctacagccaatctatcagcagatcccattggttgtgctttcaaaatatacctagaatttaaacccaggttgtctcacaatggagccactggtttctaaccactccccctcccccgacttatgctgaaattgccttctccacacccaccagcaccacagaactgcagagctggctggctcgccaggcctgttcctaaactttgacattgtgaactgacgcatgttccttcctgtcatcttccccacagaacccctctatcccaggagtgctttactctgggtccctgggcttccctagggggttgctaagtcctctgaagtaatgtgggagaagaatcctgggtggatgtgcatttttctggggagaaggctgacagctttcatcagatcttcaggaggatctgcgagtccctccaaaaagactgagagccacctgactccttcgttcctccttgatcagtacttaacactttacatagacattcatgcatgttctccagatgtcctttatttatattcgtattcataagttctcatactacttctggtctttttagtagctcttttagggctgtagccacagaacggtcattctagtgattctgagcagggtggagaggagtgcagcatccctgggcgggtgggtcagtgaagacacgcccagctcacctgatattctgtgactggttgcagaacacaagtccctctcgaaattgtttaggtttgtggggagatatctgtaagacagagtgagaaagccttatggaaaaggccaagaagtgctcagcaggcctagcagaacgctcaggaatcccacccacaccatccctcatttctgggtctttcttcctggacatctcaggcctcagacctgcatccaggagctggagcaccgcagtgcttctgaacgcctcttccagtggcacctgcgggcctagtgtccccacacccgcttgggtgacagaggccaatcagttgtcaagcttatgacttccaatcagagtggtggggccctgaaatgacttgctctttgggtcactgtatgtaaagcaatttgcagctagcggcactgggcgggtgaccctgcctgagcccagtgaggagcaggtcgtctgcctgcggtgcttccaggacctgtttggagacgaccacaataagaacgggttcaaaatgttcgactcctccaactatcatggccaagacctgcttttcaaggatgccaccgtccgggcggtgcctgtcggagagaaaaccacctaccgcggctggctggggctggactacgtggcggcgctggaagggatgtcgtctcagcagtgctcgggcgcaggtaggacaggcccgccctgccgcctcccctggtgctattcagaccccttcaccccagaaccctgagggagcggggggcgctgcgggtccggggaggcgggtggaggcccgttcgcagcagtccaggtggggtgtcccgggaggattttggccaggaggctgcgggccgggagggcgggagcccggcgggtctcccagacggacctgggtaatgagtgtgaacgctcaaaacggcggcgcggggaggatctggggccacggcagagacatgcgtgtgctgcctttctggaaagagcgcatctggaagggcagcaggggaaaggagcacaaagagggaggctgcggcgagttcggtcccgaaagatgcccccacccccaccccagagcgggcgcctgaggcggccaccgcggcccgggcttcggggcctgacccgccgcgttcgtccccagcggccccggcgcccggggcgcccctgctcccgctgctgctgcccgccctcgccgcccgcctgctcccgcccgccctctgagcccggccgccccgccccagagctccgatgcccgcccggggagtttccgcggcggcttcgcgctggaatccagaaggaagctcgcgaaggccgggcccggcgtgggcgggagcaggcgcctccccgggagccccgccgcccacgggcgccacctggcgctgctacctgaggcgccgcccccgggcccgcgcggcccttcccgccaaccgccgcctcccgccacctggagccgcgcgggccgcgccggaggaggccggttgcccaggaaaccgctgagtccgggcttcccgccgcccgccccgcggtgtcgcccgaggggcccgcccgcctcctccccgcagccccgcgcccccgtccgcgaggccccctggggacgcggtggccgccgaggcgcctacacccgcaggccgcggccaggccgtcccaggaggccccggcgccaacgggacccggcgcgtgggacagcggcctctgctggcggcggcgggagggaggccggaccggggcgacggggagaagccttcgcccgcgggaccgtgtccggggtgggggctccagttcctccgaccgcccgtgcgctgggagggaggccgagcccggggaacgccgcgtgccctgcctcgtcccccactgtggccgcgccagctccatcccgggccagccgcgtccacgggccccctcccgagtctcctcaggctctcgcctcccctacccccgtgggatgcccaccgcccgcacccacgcccgagcctggcggcagcagccgccccccgcctgaagggagccggaggtgacccaggccgcgggctcccgaggcccctgaagggctgcgcgtggggacccgccatgcttctgggttccgaacgggggtgagctccgtctcctcacccggccccgcacccgctgggcctggggacccctcactccccgtgcccgcccctccgcgaggcagcagaaagcgcccggccggggcctctctctactccatcttgccacagttgtctgagaagccagaaaaagtttccagaactggcagcccttaaaaaaaatgaagaggaagagaagaaatgggagcaggcagccctcgtcagcagaccgggagccgcgtgggcgcggagccatttgcattccggtctgcgggggctcggggatgctggtgacaggcccggttcccggtggctcgcccccacctgcgggcgtcgggaaggatcccttccatctctcagccgcagaggaggccctggcagcgccccggctgtagccatgcaaccccgaggagtcccgggcaccttcaccccaccgggaggggccacaaggacctgggcctcggccaccaagctttgtcccctctcgctgtggggggctagtgattctcctccgacctgacgattgcttggttttttcaaaagggagttttgtgcggtgagaagtgtgtttctgtgtggctaactctgggctagcgtgccgtggccattgaaggtgtggcctgcgtgggtgcagtgtaagtgacgctggattgtcaggtggcagcaggggacccctgctgtgtcagtgctaatgaaacatgttggttggtttctaaaataaagccaaacaagccagcacatgcagaggcttggaccctgatagaaacttctgctgccgatttctttcgttttgttaggcactcaaaggcctacctgctccaccgagaagggcagattccattctccaagagccagtcagggaccactctcatcctctagtcagtgaggccccccgcgcccttcttcgacctggactggttctctggctcttgcagggcctccgctgccctggcacattccagctgcctccaccccatcaggctctggggtgtctgcccttctgtggatgggtgcagagaagggtgcaaacttctctgctgccccctgccccacacctccaaaataagcggcccacatcttttctctggcaagctcgctgctaactcactggaggggggcgtggggagcggatctcccagagaccctacagtgggtgctctgtggtatctactgaggtgggggtgggcccggctggtcttcatcagtgctctgctctccctctggaaggggaggttttctctgcttccctctctcatggcttcacttggcccccacaccaccacccctcgccgctgtggccatctcccagagccaggtcttgcccaccactgcacacaggccattttccatgaagtcggctcagttatcacaaagccagtcaattcctggggacctggatggccagagttgaccgactttgtctctgcatcacatggacgagtctcagctgcacagtcactccagctcgcctcatgctaccacttccctaccctgaacttctggaaaggaaagttaacctttgggcaccctagcccctcatctgaaaaacacacagtacgatcaccagcttggtgaggtggttgtgaagatccagtctaagatgcaaaacac

SEQ ID NO: 16701 - DNA, 14441 bp, Human
tccttgcccagccgcctgaccgccctggcgcggccgaatctgaaagctaatgacattattgtgcagagacacaatgtctgtgggcatttgctgacccgagctttggtgagagcttaatccagcattctcaccctgcttttcgcaggagcacagcggtcactcatcttggcaccggcacttctggggaaggtataaatgccacctcccgctggccgagcttcacggcactcgcaggggctggtgtcactggtaagattgcctctcttgcttgtcttcccttctttctctcatcctcacccctgtccgcaagcatgggagcacccagattctgacaagtgactttgggcagagacttcaatgctgttagcctcagttttcttttctggtaactgggaagggggttaaaaagccttctttattgtaaggattcaagagaagttaggggatcatccagcacagtgcctggcacacagtgggcattggggcaatgttctttattattaatattaaacagactatcagcatccttgtttcgccagtcgctgaggaggagaatgtaactgagggttttgcaagaatcaaaccagtgacagttcagcattgtttctaggtgggtgagtcagttttcctccacatctgcaattagggggcacccactctgtgcctagcctctgggagtgctaggggataggatgcagccacaggtatgtgacaggtcccagcaacaggtgatttcaatgccactaaagcatggtagaaatgactctaataatgccacaattgctgccatttgctgcatgctgagtgtgttctgggaccacggccaagtgcttccggttttatacattacataattgaatcctcacaacctgttcacaggtattattagacatcattactgtccccattttatagaacaggaagttgaggcatagggagaggatgagacctgcccagagtctcaattctggcaggcagcagagactgctcctgaactggaccaactgagcttcttcagtctgtgaacactcaggactgggaagtgatatggcaggacctcaggcactctgacaagcccagagggctggtttcttgcgggagagcagtagatttggctgccaaggtgcttaactgcatttcttcctcctgggaaacatccagtattggcctttcatgtggaaggggcttctggaagctggcgttatctctgaagagggaggccaggcttcctctcttacccctggggaaacacagcctggtttgaccaccccttctgcaggaagggggaagaggctgacaattttccaggcttttctgatgttctcactagctaaggcaggtctaccctgctgcctgccacagtgcctggatttctaccgtcgcacccatttcttctctttcttgtaatgtgggttctgtatcagatgatttcactaatgggggagtaaaaccagtggcagagaagagaaatctaggtaccaggatggggagaggagtcccagggagagggtgggagaaggagcaggggaacagggaactttgtgagttcctaaactgggcaccaccacaccaccaaatacagccaatgcataggttttgtttgttccacacaattttatttaagaaattactgcataaaggcagaagttctgggattgaccattctatattctgtgtggtatccattgtctggggttgagtgttgggaacccactttggacctcatttaagctctagtttattactgctctctttctttgagtagacctcgtttttccctcctcctgcagctggcctggatagaaataaatgaagctaaggacagaagttgaagtagctgcttacggaccccacagctctgggacagtctgaaaccaggagaaaaagagaatgtttggggccagaggggagtggtctcaaggccccacagagtgaaaaagccagtggcccctccaggtcctcactgctgcttcccatgtcttccaggtcattcctgcacaggacagtccaccatggcctcagatcaccagacccaggcgggcaagccacagtccctcaaccccaaggtgggtacctctcagaggagggggcatgcaatgctcctcccccagacttagttgcccttctgtaaaatgggcttggcatctttcttcatgggtaccccctctcgacccctgcccctctctgggactcagtctcctctacccacacagttggggctgatactgaaagtccctccccagcccatagctggcatgctgggattcccagtaccagcctctggctttggagacttcagtttctctctcccttacctgttttgccacaccctattgtctacagggctccctgaaactggagcagaccctcattctcagtcagagatgggattagtagatggaaggtgggtgtgagtcctggctctgcacctgctgtgtgatccgggccaattatttgatccctctgagcctcagttccatctctataaaaggaggagtcagatttattgcacagggaagttgtgagagccaaagaaaccaggctcagcctaacacccggcctggggtgcgcatccacctaacaccagcaaataatgccgcctttgatttctcatccacctgtccacccaagggcggcaggatcttatcccaacgtcagaggcttgtcacacccagtctgccctcaaacctctatctaggcacggccacctgactgccctcctgtgcctccctgctttggtagccccgggcacaggttccttcaggaatggcccctttgtctgactcagtgcctcctgggccagggaagcctgagcagatacagcccctcacctgctcaccccaatctgtcccttttagggcttactttccagaagaaggacagacaataaataaatgaatatatgatttccagtagtgagaagtgctacaaacaattgtaaactaggggaaggggctcctgagagtcacagtggttgtgttagctcaggtggtccaggagggtctctctgaggagctgactttgagcagacacctgggtcaagtgaggaagcggctatatgaaaattgggggtgcctttgccaggccgaggtgggaggactgtttgaacccaaaagtttgagcccagcctgggcaacatagtgagatcccatctccacagaaaaatgaaaaatgggggtcagggttgatgagagcatccagacaaaaggaacagcaggcgcaaagactccgaggtgggaatgaactgggtgagtttggaaaaaagcaagaagctctgtccactagacctataatgtgagccacataggtaatgcaaaatgttctagtagccacatcataaaaagtaaaaagaaataggtgaaattaattttcatattacattttatgaaacccaatatatccaaaagatgagcatgttaatgtataatcaatataagaattattaggcagatattttacattattttttccattctgaattttcaaaatatgatgtgtatgttacacttatagcacagtataagtaataatatggactaattacatgtgctcagtagccatatgttactaatggctgctgtgtgggacagtgcaggcttaaaggattggataatttgtaaaattttgccctctactctattgattaataacaacgctattgagctcctgggtcctctgagcttctgggctttcaaatgcatggagaaactgctcttcctcacctgcctacccctattcaggtgggcaccccaggcctgctacctcagaaactgcatttgatcaagatcccagtgttgtgtgcacaggttagagtctgcaaagtgctgcttcaatttcatctgcatcagacaagtctgggcttcaatttcagctcttccacttattcacgtgggatctgtagcatgtcttttaattaacataattatgtctcccacaagcagcgcaaatactatgtgctaaccacccacaagccctggtctcccaggccagggtaataataaactctagccccgaacttccacattcttgagtccccatttgacagatgagggacctgaggcccagagtattgaattgctttttaggtttgtgcaactggatgtaacagaggacacattggagcccttgtctcctgaccctatctctggccgagtcagtgaccgtaaagggctgggtcactgactgtaaaggctggattgagcccgtggaatttgcctctaagccctgtgcctttccctttctttgtgtggctaatcccaggcctgggagagagggctatgtttacccagcctgtgctgaccgtgtcgattctgtagctgccccgactgagagtgtgctgacctgagcccatcttttcatccaggggcagtttgctggggaagtgtggctggaaaacctctgcctccaaaattctcactggaggccgggcgcggtggctcacgcctgtaatctcaacactttgggaggccgaggcaggcagatcacgaggtcaggagatcgagaccatcctggctaacttggtgaaaccccatctctactaaaaaaatacaaaaaaaattagctgggcgtggtggcgggcgcctgtagtcccagctactcaggaggctgaggcaggagaatggcgtgaacccaggaggcggagcttgcagtgagccgagatcgcgccactgcactccagcctgggcgacagagtgagactccgtctcaaaaaaaaaaaaaaaaaaacctcactggaaccatgaaaggtggcagctagcatcatggttaatgcttggatgtgggatgttgggtgggtcccttcactttgcagagcttcagtttccctgatggggatcccatgagccccctcccttgggctgatgagaacattaggtttgagtgttagaatttgcaacatgctgcttccatttcagctgcatcagacaagcctgggctccagtttcagctctgccacttactggaatctgtaccatatttcttaattaacataattatgtcttaattatgtcataattagttctcccacaagcagagcaaatactgtgtgctaaccattatgctcccctgaatccttctaacaaacaatatcacaaggcagtttctctctttgtttctttttctttttaaaaaaattagaagtggggtcttcccatcttgcccaggctggtctggaactcctgggctcaagcaatcctcccacctcagcctcccaaaatgctgagattacaggggtgagcccaccacacctggcctaggttctgtctttatttcccattttacagacggggagactgacgctcagagaggagaaatgcaggctcaaggtcccacggctgcttatagccagagccagggctgtttgattttatgtttgatttgtcactctggaggtgaacccttcagcatcctttgggttctctgagctccctccccacgtctaccacccagttctcactcctcttcatcgtgatgagggtctgagtctcgcttcctcttgcagatcatcatctttgagcaggaaaactttcaaggccactcgcatgagctcaatgggccctgccccaacctgaaggaaactggcgtggagaaggcaggttctgtcctagtgcaggctggaccgtaagtacctgggtggcctctcctggtcagggactttgggtgaggtgatcaagttgtggagtgggggaatctacccttgctcctgtctgcaaatctgggaaccaagttttggggtctggcagcctatggagataattcatgctttgcagtcagatagagctgggttcaaatccaggttccaccccttctgggttgtgtggtgttggaccaggaccttccccctctgagcctcagtttcctcctctgtaggatgaggctaaccatgtactctggggatgaagggagagggtcatgtggaaagcctgatacagaggtcagccacttcctcaaggcaggaagatggacatagtgactgatgaagcttttagaactgccaatctctggctccaggagtgtcctcactcctgggaggtttaaggctggatgttccagccctgcatccactcctcccttcccgaatcctgacaatgctgggtctttacagattttttggcacacttgggggccaggtctctatccaagagagaaggggagctgaatggttggctcaccttatgtgatgtagctgagcatagtcctatgtgagcctgcagagtctgggacacaaaaccacagtttctctcgtcactccttctctgtaaaagcctcaggatgtaggaatgtccgctggtggccagtaagtcagatatggctggaaatcctaaggtgacctataccacacctcaaggttctcagggaattttgcagagttccatggtcctacataggtcagaacctgaagatgtgcagaacacagctaaagcagtggccctgccaagccttggtcatctgacatgctcagggaatctgttgtgtccaagagaatccctttctggatagctgagatttgaccgtttaagcaccacatctgactttcagctgccttttcaaacattttgatgaaaaaaaatttcccaaagagattttacactcttcttctttcttttttaaaaaatataacatttagtatttttattaattatcgtttattttaaaactaagaagatatggtttaaggcaaaaaaccgtatgacttgtattcactactcagaagtaaccattattaagattttggtatgaatttggatttctctgtgtgtgtgtgtgtgtgtgtgtgtgtgtgtataatcaaatcaaacttggatcatactaaacataatgttttattactcactttggaaactttacaaggtagcatggactctctccatgtcattaaatagcattttatgttggtgtttttcaaagtagtttgaggaaaattagcatcagattcacagaagggagatgctttaaaatggaggttcttgggccccacttaagccccactaaatcaaactgagctctggagcctggaatctgcatttaacaagcttacctggtgatagttacgccaattacatttgagaacccacatcctatgtcattacttaccatggctttgtaacagtccatgattgaatatgccatatccaggtcctgattgtaggatgtttaagtttttcagttactggatattataaacaatgccacagtgaacagacttattcagatatctgtgaccccttgacaactgtttttgtttgtttgtttgttttgttttgttgagacagagttgtagctcttgtcacccaggctggagttcaatggtgcgatctcaagtcactgcaacctccgcctcccgggttcaggcaattctcctccctcagactactgagtagctgggattacaagcatgcaccactgtgctgcctaactttttgtgtttttagtagagacggagtttcaccatgttggccaggatgatctcgagctactgacctcaggtgatccgctcacctcggcctcccaaagtgctgggattacaggcgtgagccacagcgcccagccccttgacaactgttttttaaggaccaattgcctaaagtagaattgctggatcaagactactcttccaaaagaggacaataaacacgacctcctcttttgttaatgacttagatcattcctctgaacagccattattgcacattgctgaaatgttcgcctctgcactggttggtcccagaatgctaatcattttgagatttgtgccttcttccttctattttctgctttcctctattagccatgcccgacctgaaagccatcccttcctctttaatgtactatttttcttctaatgtggatctacaaaaacagagtttgggcagagtctaacaacaggaacaagagaagaaacagatccaaagagaggggctttgggcacagcgatgttctggagtcagttctcagtggtgaaggctgactgtgcatctctcttcctaacttcacttgcagccgtgtcatattgatagcttgaaatctgccacagtgggagcatttacaccatggaaattggcaaacgctacaaatcaagagtgttaattttcgttttgttttttgagagttggctattaacttaccagcatactattggctttagtgcatggcgtctatatattggtatttgttgctgggccgttatttagactgccttcttatttcttaactgtgttccaggtgggtaaaggcagcatagcactgagttctagataactgaggggattttgcacttggatttgctgtgctaaggtttgggtggggctattacatcttgccgggctgggcaagagtgaaccctaggggtcaacatcagtagccaggattctgccataggaagcttggagtggaactgacctgccccctttctctctgtctccatggcagctgggtgggctatgaacaggccaactgcaagggcgagcagtttgtgtttgagaagggtgagtacccccgctgggactcatggaccagcagccgaaggacggactccctcagctccctgaggcccatcaaagtggtgagccccctgccatcaccctactccctctctctgcccatcatcctactttctctctctgccaccttggagctggaggtctggggaccaggaaggggcccgcccctctagcactgtgccccttctgattggtgaggaacctcctcactgggtgaccttgcaaaagtcattttacttccctgagcctcagtttcttcatctgtaaaatgggcatattggtatctactgtcctgaggttccaatgtgcttattagcttgagggttgtcacactgcaactccagaaggctccaatcacaagactatgaaatgctccagagggcactattcacattctattttaggtggttggtgcccgccccccgcgcccaagggttgggcaactcccgtcattgctcaataaccaatagccatcagaaatactacaagaaattatgagtttggggctggaggagaaggtggtttagctcttcttcaagactcgtgccagtgtgagttttcagtgcttctgagatcctgattcttactagtgtgtgagagtgtcaactctcaggaaggggacagggcccatcactgctcagttacactctcaaaccctccaagcccagtctagctcctcccaggacctactggaaggttggagaacactggactttgcaccccacagacctgggttcccaagttggctgtgctgctcccagctgtgtggccttgagcacgtcatttgacctctctgtgccgcactttcctcatctgctaaatggcataagaggattttatgtctgagggataagggttttatgtgtaaaggatgagatgagataactaaggaaaatgtcatagggacaggaggatgggaagagatgtagaaatgaagaaaaatcaaagtatctcaggtgcctattagaggcacagttagcctgtgcatgtgtgtgtgtacatgtgtgggtgtgcacgtgtgtgcgcgcaagtgtgtgcgtgtgtccatgtgtgtgtgcacgcatgtgtgggtgtgcgtgtgtgtgcaagtgtgggtgtgcacgtgtgtgcgtgcgtgtgtgcaagtgtggtgtgcgtgtgtgcatgtgtgcgtgtgcacacatgtgtgggtgtgcatgtgtgtgtgtgtgcatgtgtgggtgttcacatgtgggtgggtaggtatatcgtagccaccatttataaaagagaaacttgaggaggaaaaaatgacatttcagaatcaaacattccccaaagtgttgcagagtgtctgttacatgaaaatggcccagtagaaacttaacaaacggctgtgatccaacagcagtggtcatagacacgtagtgggtgcactgggaagagagtgatgtgtgggacatgctgatcccaactctggggcatgagcatggggtgggaaggccaaccctgggccccctcacccatactcacttccccccatcctctgccaataggacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcacgtaagtgcattgccagccctggctcaccctgccccaggaactgagactctggggtcctaagtcctgctctgccctgtacacactggtgatcttgcacacatcaatgtgctctgctgacctctggcttcccactggaaagtaaatgggaattctctgcccataggtggcttacagccgctgaatttctttctagagctgcctttggggaaatggtatgcctttggagtggagaaaccttggccttaacctcagccccagtgagcaagacatgtatgtcagaggggcaagttgaggcagagggaggattaggttgaggcaggagggaaggaatgagttgagtagtctgaaagctatgagaagcaggaggaccagcccatgctgcctttgaccgcgtgtgtccctaagtttgggaacaggaggtgtcattttccactgaatcaaagttcctgggcacatcgaccctggccatcagcagtgagggatttctcatggtaataaatttggattccatgggggtccacagatgagctttgggcagcggtgtgctggaaacagcttataccagcttgtaagaactgtttttttttttttttaattgagacggaggcgcgcactttcgccctggctggagtgcagtggaatgatcttggctcactgcaacctccgcctcccaggttcaagcgattctcctgccttatcctcccaagtagctgggattacaggtgcccaccaccaagctcagctgattttttgcatttttagtagagacagggtttcactgtgttggccaggttagttttaaactcctgacctcatgacctgcctgcctcggcctcccaaagtgcagggattacaggcatgagccactgtgcctgacctggaactgactcttaaattttcagaatttgtgtgaactggttgactaatcattggtagcttgaaaccagccacagggtgcatttacagcatagaaatcagcaagtgctgctaattaaggctctttccccacaacagaaccaatttagccaaacatactggcttcttggggtttgtgaaactcctaaaatagtgtgcaaagttctgtgctcctattccccttcattccctcattcattcattcattcattcaatctgtcagtgctgccatatgccaggcattgtgttaggtgcccagggtgaaggagattaaagagatctggcttctgccctgtgtagccaacagtctagaaggggcaactgtaaatactttaagaattcacatgaatctaagctacttccttggagaaaagattcttgagctgagatctcaaggaacagtaggaattgcaggggtaaagaggccaaggaagagcatcccagacaacgagagcagcatgtgcaaaggccctgtggtgtgtgtgggggagcctggtaggtctgagaaactctacaaaggccatggtggctggaatgcagagatgtgggagcataagaatgcgaagtagagctggaggtgtccacagaaactggccaggcaggtccttgcaggccaggcctgtgtgacattttctggagagaagaccagcactttcattaagtagcccctggaaactctttcatcagaaggcccctggaacctcccccaactcttctttgaccttgtagctgggcttggaggtgggataggactggagggagacggttcaaaggcctggcttattctaagcttcagtgagcttaagatatcacccccttgctctgaccccagtacagtacagtacagtacagtacagtacaggccttcagtcaaaatttgcttcaggaggcagtgagctccccatcaagagaaggaagaaagcagaggctcagtgctggaagggtggggtggaaagggtgtcctgcttacccttgggaagtggcaatggttgggaggcttcacccttcctagtggcttatggatgctctatctctctcccctcgcctctctctctgtctgcttctcttcctgtccccctcgttcaccctcccatcacctctggccctgcaggtgggttggctaccagtaccccggctaccgtgggctgcagtacctgctggagaagggagactacaaggacagcagcgactttggggcccctcacccccaggtgcagtccgtgcgccgtatccgcgacatgcagtggcaccaacgtggtgccttccacccctccaactagtgccctccccaccatgcctccttcccaggacccaggtctgctgcccaggaaccctccagacctcccagagagtgaataaagtgtgacttgcaacttgtctgctgtgggtctttgatctcccctggcagctggtgtgtgtgtgtgtgtgtgtgtgtgtgtgagagagagagagagagagagagagagtgacagcgagagagaaatgagaatcagcaagtacctgtgctaggagtagggcaacagaacccttactgagtcttacggttctgcagctgcttagctgtgtgaccttggacacagtgcccaacctctctgagcctttgtttcttcacctgacttgcaattcccttgcctctgagcggctggcttggttgagctcctgagctccctgttacatgctggttgctgagcacagtcactctcaggggcatgtgatgggtgccccagcccttaaaaacatatccactgcccgtcaatctcacattatcacattgtccccttgagtctgggggtctttttggatctgcaagagaagccaagaaccctgaaacccccactccagcccggagaggtcagaatgccatgtttgtgagtgtgatcattcattcatcatatggctgagggcaactgttagtaattgaagaatctgcgcaacctctaagctacttcaatgaggaagagactattgagctgtgaggatcttggctgtagccaggctcaaggtgatgcaatgatctgggaatgaaggctgggtttacactgctgttctggggcactggccagggatagaggctcaggcaagtccttttgccttcagagctttgatgtttctactcaggaagatgggagagaaatagtaccttcctaacgcggttgcgatggggctgaaacaagatgctgcaggccttctgtctttagactcagcttttgttggttaatttgtagtgcaaatatccgcttcctgggtacagcctcttgtcactttgtttttggtatctcttgatgacattttaaattttaatgtggtcaaacagcaatattttcctttagggtttatgcctttcaaatctccttgaagaaattctttctttcttttttttttttccccccaagacagagtcttgctctgttgcccaggctggagtgcagtggtataatcttggctcactgcaacctctgcctcctgggttgaagcagttttcctgcctcagcctccttagtagctgggattacaggcatgcaccaccatgcctggctaatttttgtatttttagtagagacgcagtttcaccacgttggccaggctggtcttgaacccctgaaattgtgatccgcctgcttcagcctcccaaagtgctgggattacaggcatgagccactgcccctggccaaccttgaagaaattctttctaatccctggttacaaagaaattctccaatatattttcttcccctaaacttttaaaacttttgctcttcacatttgcgttcttaatccctctggagctgattcttgtatgtagtgtatggtagagattcagtttctttttcttttttttccactttggacgtccagtgtcctaaaatcattcatgaaggggtccatttcctgcactgtggtgcagtgtcaccttgctgatctatccccttccccacaggtggggtgattttataggccctccacccccgggcctcccgtggcctggaatgggggctgcacagcaggaggtggggattacagcctgagccccgcctcccgtcagaccagcggcagcattagattctcataggggtgcaaaccctattgtgaactgcacatggaaaggatctaggttgcatgctccaatgagaatctaatgtgtcccctgcccacagcccatgaaaaactgtcttccacaaaatcgatccctggtgccaaaacatttggggaccactgccctataatatgattcttcaggaatgttttaggtattcttgacctttcaggactccacttagaagcatcccctcacatttggaaaagtggaaaaccttgttgaatgagctaaagtgattaaaatgattatcataaaggtagaaaccaataagtgc

SEQ ID NO: 16702 - DNA, 12929 bp, Human
agtgagtgtgaactgagtaaataatatgccttgcatgtgtaggtattaccgcatttacagatgttgtgacagaaacttacttcaaagtattgatgaattcatagtttgcattttctccatcaggggatactaaacctattatgtggggttggaaatctctaatctcccacttgagaagggtgggaaactactgctataggacttactgtccaaatgattgatcttatatataacttgtcctgtgtttgtaccttctcttgacaaatgtcaaaatgtcatttctcatcacaaatgtctagagagggtgtgaccagatgcacactttgaatttcatctacacagtggcttgcacataacagatacttaaaactgttgcttacttgaaggtatagtgtgaagctgctctggccaaagggaaagagtttagacagagattgtccttgcaacacttacaccctggttgggctgggagctgccctgacatggaagaaccatatcttaggggagaaccagccttacttctgcctgcagcaggctgggtgggaccccaaggtctaggaagccaatggatgtcagtggaaatttcccatctcctgcctgccctgcgcccctgcgtaggccccttatcaggttccccctgagtcatcctgacccagagacgaatttagatgctggaaccttcaggtccttccctcccccactccaagtaagacgacttttgacaaagaaaagcctgcaggcaaaagttctcactcgaggctctccctctccccaggttcctctggtgctgatgagatctctcctgtcttgcgcacctttggctgtgacccttattccagcaggcttttccttgtccaggagagtgttaaactggcatccagagggaagaggggactaggagaggagccagggtgcccagcttctgtgccagtttctggggaaaaagttataaagggagtgggagaaaggaacagaagaaaagttgggtgctccaaattgggggatgtagggggagctccttagatttggggttgttgaaggctgggttttagcccgaccagttttcctactgtgggtcacctcctccctcttggcctctccttctttccagtagaccctgccaagtggggatgaaaggggcattgatgttccttggatgggaggggtattgcgggtggtgagggtggtggtgggagggtggttcccaggcaggagggggcagggaaacttgggggtcttgggggggcagtcggtgctggtgttgcagttggcagctcaagttccattggccattgttcctgactggcctggcgcccagcccccgaaatggcaactcaggaaccagtctgaagggggttggggtggatatgatcctgggattgggggagctacaaggggggcaggtggggagaaattcagtcaggtttccttttgcctaaacaacttcgaattcccttaagccacatttttaatcaactaactcattccagggagccttcctccgaggggcacaaggagagctcattccagggtgtgtgtgtgtgtgtgcgtgtgcgtgtgtgtgtaaagtctacagtggcaaacccactcgggcaccgagagggacgcggcagaccctgagaccatcccccgggcattgcgattcagcgggcctgagctggtctcctattctgggccggactgggaggggttagcggcgaagccacagggtctcttgggtcccagcccaggacactgcgtcctccccaagcccctactccacccccgcagggttaactccgcccctgcgcctgtttacccaggagtcagagcctctgggggtccccggcccctcccccgcgccccttgaggcattgaccccagagtccctgttggccatcctctccccaccccccgcctgcccgcgatcgccctctatttatagcggccccccgcattccccgcccccacctccccgccttgttgtccaacttctcccggagcagccggagagcaggcgtcgggacgcagcaaagagaggagaggtaccaggactctgggcacgagggagtcggaactcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccgggttcgtctccccactaccggttcccaccactgagtctgggggcgaaggaaggagccagagtgcaattgcagatccaggtcgtggatggggcggtgctgagggcagccgagggatccctctcagggctgagggatccccgcactccccacaccgccccaatgcggggagggggtggtggaatgttttggtgagccgagcagagcctggaagcgtccagccgcccgcccctcgccccccggccccagcacaaccctttcctgagcggcagtctgggcggggtgaaagggggggcgtgtttactgggggtctggggcgggtctgcggggagcctagcgcccgtgggcgggctggggcgggccgggggcgggtctgcgggaagcccgagccggggcgggcccgagtcaaaggcaagtgaaggtggaagcggccgcggcggcagcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggtccggggcgcttggcaccggccacgcaagggtgtcagtctccacgcggacgggctgcgtagggactcgtagggacgggttccgggtgctgggcccggccggtctcctctgtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtgtttgtttttaaattgtggagggaaacagccatgctctgctaccctcctcttactggagagctgtcaaaaattttggggatcccctattcccccgcgtttagtccccctgcagatagaaaattgaggccaaatgtagtaactaactggggcaaggtcacactgggagtggcagagccgggattcgaatccggaggttctgacagggccaccctcttacctccacatcagcacttccttctctcctccgcgcagcctgaactgatgcccttgtagcctatattgattccggctcgagcctagagaggacgtgttctctggacttaggggtagacagacactggggagggttagtgacccgaggaggttgatgaccctgggagtctgggtcttggctgaggctttccgtccctaaaagaccccaggtctgtctcccatgtcattcacctcgttgctgtgttttctcagaccccagagtcagaaggagtgagaaccctgacccctaatcccactgcatccagccaataggagcccagtaagtgaccccaccccgcaggctgcaggctccttcctgtgcaggtctgtccaggtgctctgctcctcacccactaatgttgaacttgcggagtttattcagagttgggaggaagggtcttgggaggaagggaggcattgggttggttggacagatgtcccttttatgttgttttccccacctcccccattggtcatgttgctttggtcatttttagccccctttgagctgccgactttggggctttaattgaaggtcatggtcaattgtgaactctcacagtcccgtcttttggtaccctgtcctttagaatactcagtcactgagctacaagtttcactccctacctgagagtgtggggtggcccctaaatatagcccgagaaatctgagctacacttctgccccaccctggtattttggtccagggcagaggagggagggggtctggaggtgtggtgttgagggtggcagtggggatggtgagtatcaagagaagggctgtcctgattcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaaggttattagagaccgtttgactcccatgcccaaattccagacctctaagcatcccccttgccttctaacttcccaagcgtactgatcttattctaactcacaccactgcttcaccactaccctagtctctctccccatacactataattgggagtcaggcccttgtctcgtcactacactaaccttcatcctttccgtgtctctctttgtcaatctctttctgtctttggtcatttgttggtctgtctttacttgcctctctttgtctgtttgtctctccatctgggacgccacatggtcatgtgtttctgtgtgaatccgtgtgtgtctctccaggaggctgagttagctgcccgaatcctcctggaccagggacaggtaacagtgtgggggcagtcccaaggtgggaggaggggctgtcctcttccccagtagaaggatggcctctgcttggccctctcttctctctttgctttctttccttctattctagtcctttcccttccctatctctcccctctccttccttcccctcctcttctctctctaatcttcattattctttcttatcctcaaactcatcttccggtatcatgttttcctcaattcttgctgatcctgtttttaattctttgttcccttttccctcttgcccacccactcccagctccctgaccttggtgttgctccttttctggcctcgtctcctctgagcctagctcttggtgccctgttttcctgcagactcactctgtggagacaccatacggctctgtcactttcactgtctatggcacccccaaacccaaacgcccagcgatccttacctaccacgatgtgggactcaactgtaaggaccttcattcatctcccactcctgtctgggaagaggctgtgggggaagggtagaaatgaaacccagagggaggggaggggtcagtgtgggaaggagaagttctctcctggtctgactgtggcatgaaaggaagggtgagttctgactgggggacacgagtccctgtctgattctattgttgaggtgatgtgggttctctttagataaatcttgcttccagccactgtttcagttcgaggacatgcaggaaatcattcagaactttgtgcgggttcatgtggatgcccctggaatggaagagggagcccctgtgttccctttggggtaagagttaggtcgttactgcttcaccagactgtgaggaacaggacaggtgcgggaaaggttcgactggggaggaggaaagggagggcagtggtgattctgggagagaatgagtaggacatcctgaggtggggggtgtgagggcaggttggtatcttccttaacatgcctctcttttccagatatcagtacccatctctggaccagcttgcagacatgatcccttgcgtcctgcagtacctaaagtgagaggcctgggaacccctccaaaccagagttctctttccagcacaaggagacccttagaacttccaggttcaccgtggttcctgagccagtttcagcttctgaactcaatatatcttcttccttcatgctcccgccttgattattgagaaaaggtggtgggtttggaaaattggccagagtcaacagaatagccctaatgggtggagggaaggaaaagggtctatgcttggccctgcctcaggctaaggagggccttctctgatcagaaagtcagggaggaatgaaagggggtgacataatccctgaggaaccagatagacctgtctctttctctcccactcccctctccttcatgcccacacctggtggatggggagctctgcgggtgagagagagttggggaaggaagagaacaccagaccaagtgtctttggtattcagagggaggtgctggcccctgggtgctgttcttagctaagcttctcctaggcaccagggctcagcagctctggttcaccactttgccactcttttcctcattctctccattgttcactaaaattgtgtctgttttcacatttgctttaagttccattcttcccgttcctctagaggaaccaggaactaaagcagaacaagttgaactggctcttgaaaattgagaatggacaaagagctatctatatgggaaaacagtgtgttggttggctggtggatgggtgtttgtttttaagacactagctctccagcagaaagctggggatagacttcaggtatctaccctgactacccgtgccaacctttggcttcttgggcccttctttttcgcgtcctccaaagaaaggtccgtgtctgcctttctttgtgcccgtggactcaggagggagggtgaagagtttgaagagatgggctgtggcaggttttggacagcagatcccatgaggcgtatatttctttccctttcacagtttctctacaataattggagttggtgttggagctggagcctacatcctggcgagatatgctgtaagaaataaaaagcccagaggagggaaaggagggtccagactgattaggagaatactgtttattagtgctgtttgggggaggaagtgggcactaggtggggagtcaggccctgtgggagtccaggagtgggtcgagcttagcggggaggggataaggccatgccctgtttctcatttccttccttctgctgtccctcagcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttcttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggtaagtgggtgtaggagatgtagaagagtcgaggggagcagcagggaacttgaatgcttgggctaacttccttagctgggacaggatttggggaaggaagaaggcttacctcttttcctccagtaattgttgttttctctttccatccctaatttttctccttgttctctccttcaggaagagctctctggaaattctgagttgatacaaaagtacagaaatatcattacacatgcacccaacctggataacattgaattgtactggaacagctacaacaagtgggtgggctgtgtgtgtatgcatgtgagagaaatgcagaagcagtaattgggcgtcatgggggaggcacagaggaggagagggaagtctgggtagtgtgcaatgtgcaaggaatgcagcatttagtgtgcaatgggggcagcttcaggacagagtcagtgggaaggattgcaaggggctgtcccccttctcttgtttacctcctttggattattggactcccagaagtaagatgatcttgtgtcctgtgtccttcctccccttttgttgccctctgaccagggatctagggcacaagtgactataggggctgtgcttggggcctgcctgcccctttctcctttggtttccacctttaataaccaagatttgaccgtaatttttagacaaagatagttccatcatgggagagatagcttatatctggttagatagcattgcccacctaaaattcctactcttttaacccctttctagccgccgagacctgaactttgagcgtggaggtgatatcaccctcaggtaagactttaagagataatgcattgcctgtctccctggatcttccctaggagcttgtgtcccttagaagaaggagaatcttttgccagggaacttccttgtcatgtcccaccccatcctatttggtaaatcacttccctctaggtcttccccctttgaatcctcttggtggcatcagcagggagacacagaagtgtctttcctctttggagccagatatttttccagctgcactcctaggcagaggccagtgagggagtgccaggggctcactgccttctccccaacactgtgtctttaggtgtcctgtgatgctggtggtaggagaccaagcacctcatgaagatgcagtggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccaggtggaatgtaactcaaaactggaccccacccagacctcgttcctcaaggtcagtaacctgttcctgggcccccgtccacagtcatatatcctctctacatgcagctgctaagcctccagggcccggcatgggagcaaatggggtgaacgaagaacaaaacaaaggggctagagtgaagaagctagggaagagagaccctttccacctctctgcatggctcatttatgtgtgtttcactttttctgggtggtgctctcctgaacagatggctgactccggaggtcagccccagctgactcaggtgagtgccgctgccgtccatgggatggggaagggacataggataccggtggcactgggctctgccctttgccacacacccggccccacagtgccgcagcctcaggctccagctcttcctctaacctcatctcaccgtctccctcgcctcttcttacttccgcagccaggcaagctgaccgaggccttcaagtacttcctgcaaggcatgggctacagtgagtatggggacaagagcttgctgcactagaggagagataggcactgacggggtggaaccgttttaggtgaatgcctggactcaccgctgtctgcccaatcgagctcgttgatcccctggcttagttataactagtccataatccaaggaccacaccctgagtcgccagccccccttccccacttcctctctgactgcttgtgcatcgtgctgtctccacagtggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttggtgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgttattattctttgtctaggtgtgcctgcatcatgctcctcttcctatcttctccctgtccacgtctcatattctcttctcaaagtgatataaaccctgggagagggcctttgtggcataggcacttcacaaaatatgaccacatagaaactggctcttttccaatacaacggtgttgccttgatattgtagtatttttaagcctgggagagaggaaccatttagatcttaggagacttccttatcaactatgggtaactgagaaaggccacaggatttcagagataccaccaacatcaccacctttaagaaagaattgaagaggctgggcaaggtggctcgcatctgtgatcccaacacacttgagaagctgaggtgggcagaccacttgagctcagaagtttgtgaccagcctggggaacatggtgaaaccccgtctctgcaaaaaatacaaaaattagctgggcttgatggtgcacacctgtagtcccagctactagggaggctgaggtgggaggatcacttgagcccaggaggtggaggttgcagtgagccacggtcacaccactgcactccagcctgggcgacagagtgagactccatctcaaaaaaaaaaaaaaaaaaaattgaagaagactgatgacagaagtgcccaaggatatcttgagacccaccttcctgtaggatcctccctagggggtcacctagattccattttggatgttttagtgcaatcagtagatcagggtgcatgaacttaactgtaaggggtgggctgctcatagttcattctgatctgaagactctttcaggaggggtgcagcaaaaaggaggatttaccttgagaattcctcttccctcatggaatccaagggatctgggagctaattaagtctatgtttgtggtttattaggaagctttttcacaactatgaacaatgaagaggaattcttattttgcagctgttgcaggctgattcttagggtcttgaggcacaagaagtaaaaatgaggaggcaccttgtagcattattgacaacactactgtgatggactattacaaggtcttttgctagattgctttacagaaactccacaggcaattataccctttcctcaatgaaactgagctgaggactaatgcacttgatgtctggtgctgacacactgattgacatggaaataggatatggaatatgcccttgattcttgagcatttcatcactgtccttcatagaactgggtctattttaaatgtggtaggccagggtcagaaggggaagcggaggtattgggtaacaaacagggttatggagctcgctattggatgctgagggtgttgggtgaccacacgcagggcaggcagcagagtgcgaagcaccacactgaagaaaagaagcggcataattggaatcagtggggaccaactagcttctcggaaaaacacaaggaaaaggcaaaaacctataaccagcatcaatctttactggcaatagctgctgttgtgtattatggatgggaaggcaagtcttttctgcatatctgcctacatagataacactgtcagcagggcaatctctacaaatgggagcacattacatgtatgtgtagataggtgagtgtgtgcatacacatctatcatgtaggtgggtgtgtcaaatgggtgatgactgtgtgtctttcccatagatgtctctgcataagaaatctgagtttggtagagagaaagatgccctctgctgggagctagtcgtggggtgggggttttgtccttgactgacctctctactctgttggagagcgacgaaaagctcaagaatcaagagcatattccatgtcccatttccatgtcaatcagctaaacattccagtttagcccatggggtcacagtgcccccttgtggttgacatggttcttaataactttccccagttcccaggtcccttggtgtttcctcggtcttacagctccattgtgctttgtggttctgtgta

SEQ ID NO: 16703 - DNA, 12323 bp, Human
  misc_feature (1)...(12323): n = A,T,C or G
gtctcccaagtagctgggatcacaggcacatgccaccatgcctggctaatttttaaattttttgtagagacagggtcgtctcacaatgttgcctaagctggtctcaaactcctgggctcaagccatcctccctgcttggcctcccaaactgctgggattacaggtgtgggccactgtgtctgtcctgatagatatgtttttctacctattcgcacctcagtttattcactgataaaagggggctaacaatatgactgtgaagagttgttgattcagggtgggtgtttaataactattagtggtgctgatgaggtcacaccgataagtctgatgcccatacactaaaagtgttattcagaaggaagctggggacacatttctacagtcggaagcagaaccagctgggcccaaatatactctatagatcaaaacaaatcccagatctacctaggtgcccttggcaagttgcttaatctctctgttcccttatctataaaaggaagttaataataccagtctcaaggggttgctttcagcatggaagagagcttagcccagtacctggtacacaagtgctcaatgttagtggctatgatcatcatcactattattatttcttgttgttgacgataagaggagactgcgccagaagactctagaagttagtacgaggagggaggcagggtcctgggaggcaagtgatcttttgtaagccactcctgccccatcagtgctgtgccaacatcggcgggtcattgtatctactcttttctttcccggggagtgggagtcacgttttaaagagatccagaaaactgctgtgtgtctactcctcctcaattcccacgtgcattgattttatttggtggcgatgtgagatgttgggcttgcactgaggatccccgagcctgcaggccactggggaaacagacttcctgaagcctcatttttcttacttgtaaatgggggctaatttaattatagagggttattggaaagattatatactattagataggtgaacaggcattcagtaaatattgactaaatctgagtatactacttaccagtttgtagtctagactacaatcgcctggaaggaaggtaccacttctttctcatccctcacagcgctgagcccagtgcctggcacttagtaagcactcagtaaatatttgttgtattgaagagccattaaagtgacttgaggaatggaaaatagaattcgagaggaaggcgcaggaattgtttatcaagaacggaaaggaccgaagagtaactttaataatgtttcttatacggccgacattaactatctctataatcgcccctcctcctcccccaaaagagagacagaaattgtaagggagaggctttgagataaaaccccaggaagaacttcccgagtctgtgcatgttggggcagaaagagcggcagagccaactccttccctggtatgtccgggtttagggagggaggggcagtgctgcttggaggctgggggaaggacgagatgacctttcaaaatctcttccagtctcctgttggaatcctctgtgcgccccacccccgctccctcccttcctccctccctccgacagcgccccccgtctccaaaccgcccgcaccccgcccctggcggccgcctctcgcggctcccggggtccccagctccctgtccccggagccagagcccggctcccgcgcggctcccagccccgccgcgccgccccccgcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtaacgctgccgcccgcgccgccggcccgccgcccgccgccgccgccgccgccgccgcccgctccgccgccgcccgcccggggctcgtgagtagccgctcccccgactcccgggcccccccgtccgccacccggcccccgcccccggccccctcccccctcccggagggggggcccgctcagcgcgcccggctcggagcaggtgcagggggcgggggcgggggaggggcgccggctcggccccaagcaaacttcgcccagagctcctgggggggcggggtgggggtggcggcctcggaagcctggagagctggggggccccaagggagggggggccaggtggaagagctgggggagcagacaccaaagggaagggccaacgggggggatgtggcgggggaggtggcgggtgtctttgtaggggcccgaaggcagggcgcgagggacctgggggtgaggggcggcagagccgcgagcctgagtggatgtgcaccccccaacccccggcccaggtagggctggtgggggagggggaaggagcccaaactctctgggagcacggggtggcgggggaggggaaaggatggggggtgcttccctctttgcgtcccaaacaaagtgtcacaaagagctcggcccgcggcagcagcggaggcggctgtaactcagcttttgttctcctggccgggggtagctgagccttggcctccctatctcccaaccctgccccccatcatccttctggcttatcttcctggggaggggtctggggtgctgctggaaaaacctctccggcaggatagcaggtcctaccctacttagcaatctatttctgggagggggattttcccagaggctcccttgatcgcccctacctcccagtctgaggaccgaggctcacgtgggtgctaagactgacttttctagggtcagctccacttaaagggacttagggctggctacatgcccctctttcccaaacccaggtcttccagaactttcaaaatcaaaatcggggttgcgttaggacatgcctctgggataagattccccatggtgggatggcagcaggtgagcaggtgtgccttcctctcgcctcctgctgtacctttgaagtccatggctgaggttccatgtccctaactcaggagagtgaggacagagggaaggaggctttaccaagatctcagtctaaaaaggctggtgagctgcagagtggagcgggttaggaggagctatctgagcagtgaggttcagagggccatggagaggagaccataaaagtgaactactggtgtgtctgtgtgatcaaggtagtcttttgaacgtagaccgccctagaagctccctttccttttaaccccatctagtgcagtggtaatcataattgttagcagatttgggaggtctaggattctcaagagggaaaaccatcgtgttagaggtgaccagaggcagttacaactggaccccagaagtcctgaacccttgctccttacactttgaccctaaaaacttttgaatcacaagacttgagggacagtctttgtggtccatttagcaaatacttctatgtacctgtccttgttgtttctaagtcttttcaccaaccattccatccttctctactgagtaaggtttagtggtccacacccacttccctaccagctgccccagcatgtaaggataattggcctactgcttttgaaaggtttctgatatctatccctggccccgcatccttatagaatccaaataagggcaagataacccctgattcccagtgggggtggaaagtaggtcagtgctgctgtctggccaagtctcgaggatggtgtttaaggcctgactatagaaaactctgtgattattgtccaggggcaatatatgcatgacctcggttccaaggcagttcatagtatcccagtccctgtcagttctttcccctactgagaaaaaaatcatgggatcaggtgtctggaacctggtttgatatggagatgattcagatcttcattgggcctaagaaggtatctcagtgagttttgttgattttaggccaccttctggggaaactttccgtgctggggaattcagcttcagtttgggccttcttgtatatcactctatttctgttctggaaactgctatgtgcaaagtggtttattgttgttttgttttgggataggaagctttgcccttttctgactcttcttgcctcagatatgaggccagcttcctaagagattttgcttgctatcctacagacagttttaggggccctagaatcttctcagaatgagagtatgtgcccataggttagtcagctatgaccatgcagtattcccagcccccccgccccacgcctccaccatctgcttcctctgaatataccagattggctgtacaccaggatgttccgggaatccccaggagagcaacagaatgtgatggacccaaatatgatgcctcagtaactcattccaggatgtacaaactgtaactgtcaggatgctccttatagctaattaaaattcttctagttacatctattttctattagctctttctattttcagtgacatctaaaaggccaaaataatccctctggtaccactgggtttttttctatggttttcagataggaacgaaaaaaaaatgctctagcttttctgtgttgtatctgcgatgctaaaatggcaaacagcccctctagcacctcatagctctatctatggtactgaggtggcccaagtggcttctgtggtagcccactgcactctccatggtactgaagggatgaccatttgttttaacatctctctggggtccaaaagagtcctgtgacttagaatcacaaacttttttcgagcaggaagggactaacactataaattagtccaatccccttattttactgatgagtaaactgggaggttaagtgatttagtaaaggttgtagggttatcaatgttcagactaggcctacaatagccttgtacccttcagtcctattctaattcaccttttgtgacactattcagtaagcctggctaggctcttagtcccaggaaaggatccagaggatgagagtgggtgccctaatttgaagctacagaaatacacatattaagtggtagtggaggtcgtctagtgacccttggacaaggacactttgttaattaatcatctgctaataataatcctatagcccagattccacatgtaacaggtacctgccccttcatggagttttaccacatccactaaatgtcaaaaattaaagaagccttggacctccagagccttttctctctgctgacaggcaggttgactcctggcacagttcttttctattaaagatccttaggcaaagtaatgcttgcatctttttctttctcagtaacccatttcagttttgtgatgcctattgtaaggaagttctttatatctcaaatatcctttcttagacaaaaaaaaaaaaaaaaaaaggttagacccacattcatttagccttgaccagatactattctatatgaggcagaaaggtagactagatgacttctggtcatcctcccaggtctgtttccatgaatcttgattctggggtttcttctaagtcctcatgctaaactcctctgcagcttaggatcagcacccgcccccccccccaacccctatcctcttcctctcaatgatcttctccttccccagcactggagctctgcaagtcccaggcctagggaattttagcctggagaattttaaccctttcctgctcagagcatgtgctgagtccctatctgtgcagatggcccagccccgccccccgtccctcactccagcctcttgagctcagagccagtgtaatcctcctcttgtgtgagggagcctctcccctgcagagaggaggaaagcctgcctcggaacagccctggacaaaggggctcagatgccccatcatactgcaggctccaaggtttgaaacaaggggatgaatcctatacggtatttgcagtttttagccccttccccaggctagctgtgccccttaacttccactcctcccccaactctctcttcattccctctccctctggctccctcccccttcatgcccctccccctctgtctgtcttcagactctgctgctgggaggtgtttctctcccatgcatgaatgagtctctgtaatgaatggaaatgaatggatcaggaatccaggcggagggagggagaatgaggggggaaagacagaaagacagggtaagggcagaaggaagcactgtggaacctggaaggatgtttggctggctgctcagttagggatctcagagcaactggtcccacttggataaatggggagcatggcaagcccacctcatttgctcaccacactgcatagcccaacctacatgggagaggggcatattgtgatggtcttccccaccgccagggggtggggtggtagctgtggttgttctggaccatgcatttaaaatatagaatttggggaagaaatctggattatctgggaggcttgtaggcttggcaagtcaagaggtacagtttttgagtatagcagccccttcgtgcctcaagaagcaagtagggagaatggattggttttgggaatacagaatgctgagagtctgggggtagggagtgactttactgctgaaaactagggctcatcttttcctccaaatctgtctcttgctttagctccacagcacctgttgccttcattagcagcttttcctcctcttccctgcacttcccagaaccaaagaatgtgaagggggtccatggaggtgagtgaagctctggcttcaacctacaagtacctacaactgtatactccctctcctgcctacctctctctctctttgacctcccattattagaagttaactccttggccctgacatctcgattcccatacacctccccccaccccatcttcccgaggtgagtagcaccctgtgttcctagttcaggccccagcccaccttccctcgtgttgtccttctggccctcgaggcgacgcccttgcttcctttacagctctaccttcaccctttgctctacgcagatctttctccacagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcagggtatgtaggtaccctccgctctccgggtacgccgcgtcctcctctgactcttacgccgccactccctcgtagcttccttgttaaaagaacttacgtttaatttctcctgagtttttttgttttgttttgttttgttttcctggaggctttgccatcatttgagaacacttaactctttagtcacaacaaatctaacccctcagactttgtttcctcctggaccccgaggggaagcagccctatgggatgggtgtggggtgggtgcgcggcacctggacagggtgtgggcccccctgacttcctcttaacgtatgtgttgcagaagagaatgggctgttggttggagggacccggcctgaagggggccggggcgccaccggcaaggattgtcctttctgcggaaaatctttccgctcagcacatcacctcaaagtgcatctgcgagtgcacacaggtgagggaggcagcctccggcgtggagaggggactgggggcgggcagaaaggtgagggctaccgaaacactaggaggtgaagtttgttccgaagccttcagtttggctggatgagatcacttgggaaacgctcctttattaaatcaaagtgggtgggagacgcagtgccctttcttggttctgagaatgaggtctgtaaattgggcgaaattcgggtgggtgcgtgcagtcatcgtgaccccgtgaccctatcgcacccactctccccaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggggcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctgcttccctctttgggtccttctgtcaggaaatagtcacctcttcagacacttagttatcacccaaagagtttgataagaaatgcagaatattgggttttacccccaggtttcgatgcagtagctctgatggggcccaagaattagcatttaacaaacagccaagcaagttctcacgcactgtggcctgaggacctcattttgagaactgctggactgtgctggatcccagtttgtctgtgaccagttcagcctcaaggagtaggtgcagtgtgggagaaggagcttcagagagtgtgtggaacctctgggagccactgtggaggagacacattctcccaggctcatacacagtcagctagctctgggcctgggaggggtagaggggaccttccagtcttggttttattttctgtgttctagttaagggctggttgagggaaagtgctcaagttatttatcaccttaatccagaggactactctagctccttagaggcaaagtgtgagtaaatacatttaatataacaatagtattataataacagtaattacatatataaagtctacggttcccctgtcacaccctcctattgtttgcatagcttcattgcttgtgacacctcagaatggagtcaccagggactccagttgacctggcagagatgattcttctcagggaaagtcagggggtgagaaaagaggagaacatgggctgccagggagggctggcatgggagtgatgtcctggatacagtggcccaggatgggaaagcaccggaagagggataacttccccacctccagggtatgaaggcaagcaatgtggctgctctgactcctgcaggagaaggcaccaagctagggagactagagatagtggtggcagggcaatactctggtcgttagacctcctctgtgtccaggaagcagagggaagaaattcagcgatcgcccagggctccattatgccccactgccatcccagcccaaagtgtgctgagaggagaagctgcacgcaagttctggatcttctctagaagccaggagagaagagggagatgagttgggagagggaagaagctgactcccaagtagccggggacaggaaggaaggtacatgcaagatggtaggagtgctggatgtggtagaaattggggatgctgactcacccaggtcacagaggcgtggtggggtcactcagggctcgagcatgactctggggggagagaagctacagtgaatttagggacatatttcttgtctttctctctcttttcctccattcctccccacaagcctgtcaattcacctctctttcctacccaaaatccttgaattttgctatttacttttatttttttagagacaggtgctcactgttgcccaggttggagtgcagtggcacaaacatggctcactgaagtctcaacctcctgggctcaagagatcctcctgcttcagcctctcgagtagctgggactataggtgcgcacccctcaaaagtccggctaatttaatttttttttttttgtagagatggagtctcactatgttgcccaggctggtcttgaattcctgggctcaagtgatcctcccacctcagcctctgaaagtctgggattacaggtatgagccaccttacctggcctgagttttgccattttaacccaagtccaagccaggccattggcattctcccctttccatccaccccagcactatactccttatttaagattccttttaacctatgaccttgatgcctcttagccaggtcccggggagaggagaaaggtagacaagataataaatccagactgtagcctcagctgggagcacaagttcacagttttcccccaacccccctggggttgaatgatcagaaaagcccatccagaaagcagccaaagagatcacattgttcccagcctcgttgtaggaacttacctgtcgggatagccctaagatc

SEQ ID NO: 16704 - DNA, 37712 bp, Human
atctgggaacaactgatgttcttcagctcagtgaaataaagcagtgtggggagtatccacttcgatagacattactctgtgatagacattactatttgcctctccccttcatcactcaaaatactattttcttgagtccttacatgatatatggtcaggcaatgccaagaaatgttaatacttgcctaagtaggttattattattattattattattttttttttgaggcagagtctcactctgttgcccagggtagagtgcactggtgtgatcttggctcactgcaacctctgcctcctaggttcaagtgattctccttcctcagcctcccaagtagccgtgaccacaggtgtgtgccaccatgcctggctaatttttgtggtttttttttttttttttttgagacaaagtctcactctgttgcccaggctgagagtgcagtggcgcagtctcggctcactgcaacccctgcctcccgatgtttaagctattcttctgcctcagcctcctgagtagctgggattataggtgccggccaccacacctggttaattttttgtatttttagtagagacggggtttcaccatgttgggcaggctgatcaccaactcctgacctcgagatctgcctgcctcagcctcccaaagcactggaattacaggtgtgagccaccgcgcccagccaatttttgtatttttaatggagatggggtttcaccatgttggccaggctggcctcgaacccctgacctcagataatctgcccaccttgacctcccaaagtgctgggattacaggtgggaaccatccagcctggccggtaagttatttatttatttcttgagacggaatctcacactgttacctgggctggtgtgcagtggcacgatctcagctcgctgcagtgtccgcctgctgggttcaagcaattctccagcctcagcctcccaagtagctaggattacaggcacctgccaccacacccagctaactttttgtattttcagtagagacagggtttcactatgttggccaggctggtctcgaagtcctgacctcatgatctgccctcctcggcctcccaaagtgttgcgattgcaggcgtgagccactgtgcccagcctggtaaattatttttaaaccacatttactaaaatgataaataagaaataagacataaaaagaaataattgtttgattattagtgtcatttcatttgtatgaatgaccaagaactagccatgtggctgggcatggtggctcacacctataatcccaacactttgggaggccgaggcaggtggatcacctgaggtcaggagttcaagaccagcacagccaacattgtaaaaccccgtctctattaaaaatacaaaaattagctgggcctggtggtgggttactttaatcccagctactcaggaggctgaggcaggagaatcgcttgaacctgggaggcagaggttgcagtgagccaagattgcacccctgcactccaacctgggtgacagctcgagattctgtctcaaaaaaaaaagaaaaaagaaaaaaaaaggaaccagccatgtgtattttatactcaaaatgggtctgctctgacagcttgatacaatagggtggaggatacagttgttgaaaagtttaattcccgcccttcagcatagtaatttataatctaggtcaaagacaaatattctctaaactcaccgttggtgaaggtagatggaggcatggggtttgagaaaaggaagattttgttcctcatttctaatccggcaggcctgagaaggtcttgatacatagttccctgactaaagaaagccatcatggtggagaagttccttgggaaatggatatgacttggggtgtttgctcagtcagatatctgagacctaaacagaaatggtactgagcaataactcagtaggactcaaaagttccaaggcagttggtaaatgacagttatgaataaagcaagggcagaaaaaaacatgtaggggagagaatgaggaactaggtccaggagatgctgaaactgaataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaaggtaggctggaccttgaagagctctctcaaatgtggcatcctctacctctggtttgggagaagataacttgagccatcatttctttaatcccctcacttgatcctattcttttgtgggttgtaggtaactagaatgagaacactagcaatagatcagatctacaatcaggaaaacatgacacttacctacctctcatgtatactttttcctatataatgtctttccatttgagaagatgctagtttttgtttgtttgtttgtttgtttgtttttgaggtggagtttcgctcttgttgctcaggctcgagtgcaatggcacgatttcagctcactgcaaccttcacctcccaggtacaagcgattctcctatctcagcctcccaagtagctcggattacaagcatgcactaccacgcctggctatttttttttttttgtatttagtagagatggggttttaccatgttagttaggctggtcgtgaactcctgacctcagatgatccaccagcctcagcttcccaaagtgctgggattacaggcgtgcgccactgtgcccgacctgccagtttttaatttattatgttttttaaacgttcagtttattgaaagttttgttttgtttggtttggtttggttttgtttctgagagagtctcactctgtcacccaggctggagtacagtgatgcgatctgggctcacttcaacctctgcctcccaggttcaagagattctcctgcctcagcctcccgagttgctgggattgcaggttcccaccaccacacccagctaattttttgtatattttagtagagacgagggttcactatgttggccaggctggtctcaaactaacctcaagtgatccacccgcctcagcctcccaaagtgctgggattacaggtgaaagccactacacctggctgaaagtattgaaagtgaatttctttgtcttttatccttctcatcattttagaggtaactggaatacttttttttttttttgccatccaattcttgaaattgagtagcaaattactattcttggttaccactgccagttcacccccgtcttaactcttggatctcaggagataggtatttggaacatttttaaatactgtcaaaaagaccttcatcttactactttttcctagcctggaccttaatatttagttttatcaaatttatatctcatcaagttttagtgtattcaaatagggaacggaaggaaaagaaatgtgtgaaatcaagaaaaatagaggcaagaaccatgtttaggagcacatgccaattagtatgtttgaagcacaaatgaagtcttgtaaggaccttcagggcaatctaatttaatcccttctctaatgcatgatggaaatgatctgctcactaaacaccgattacctttattccctgaaaaacacacacacagcctggtgtggtggctcatgcctgtaatcccagcacattgggaggccgaggccagcagatcacatgaggccaggagtttcagaccagcctggccaacatggtgaaaccccatctttactaaaaacacgaaaattagccagtcgtagtgtcgtgcgcctgtaataccagctactcaggaggctgaggcacaagaatcgttgaaccctggaggcataggttgcagggagccaagatcgcaccactgcactccatcctgagtgatggagtaagactgtctaaagagaaaaacacacacacacacattggaacacagaaatgcccatcctccatccaggccagggtgggtgtgaagatgggtgccacagagagctagtaacctagaagtcagaatggagtgggggtggagttggtgagatactggtttcgatgctgctgtcaaaaagtttggattaccctagtcaagtgattccctttctgttttgtgttgttattgttattccactttccactctaccattctgcaggtgtcttttgttttcggagtgcaagtagtatcacctcagtttactgagtcaataagctagagtcctcctctgtagaaataatagagaattgcttctcaaatttataacattaattaaaccttagtgggaagattaaattcacacttgatccaactctgaccatggtgataaataactacagaatttcacatttctggattatttttccccagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgaggtaagagcctctttaaacaaactagtccactctgcagagagatctctggcaaatatctctagggaagatgatgagattagaaaactaactaaataatattttgtcctgactgaggacactctttttttttttgagacagagtctcgctgtcgcccaggctggagtgcagtggcgcgatctcggctcactgcaggctccgccccctggggttcacgccgttctcctgcctcagccttccgagtagctgggactacaggcacccgccacctcgcccggttaatttttttgtatttttagtagagacggggtttcaccgtgttagccaggatggtctcgatctcctgacctcgtgatccgcccacctcggcctcccaaagtgctgggattacaggcgtaagccaccgcgcccggcccactcttttttttttttttttttttttgagatggagttttgctcttgtttcccaggctggagtgcaatggcgcgatctcggctcactacagtctttgcctcccaggtttaagcaattctccttcctcagcctcccgagtagctgggattacaggtgcttgccaccacagccggctaattttttgtatttttagtagagacagggtttcgccattttggccaggctggtctcgaactcctgacctctggtgatccgcccaactcagcctcccaaagtgctgggattacaggcacgtgccactgtgccctgcttgaggacactttttggaaaactgtgagaaggctgagcgtagagaacttcatgagctccacccatttcttccactctttgcagctcataaaatttagaatctttttcagatgaggacttgaaaagatctgtggaagagcaaacagccattagtggctgtatcatctcccttcactgctgctactgaacatgagaactaggggaaagagcacttgtgaagtcatacaggtccttgtttacattttggagtagtttctgctgctggcattttactactaccaacaactgttttatggagaatcattattactttacctgtcatatttatactcccttttaccaatgcgtttccctctacagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggtgcaaggaaagatggtacaggaaggggatggataacaggaacgtgggaaccactcacaggactgggaatgaagcaagacctaagtttccagggctgataccaggtgatgtgctatcctgagcaaacacacaatggctgtcctttgaagaacttgaggactcacacatgcccacggcaccttggcactaggagccagtgatggggccagcccatgccaatggcaagcgtaagacttctgggttcaaattttgccagtcctaggaaccaccctacctcaatgatagcacaactagtcttggaggggtctgcaaggaaatcaaaccttcttctagtgggtgaacctgcccagctaaggatagcagtcttcttgacctagccagtgccacattttttatgctctttggttttaggccactgagatagaaaagttcagacattattttgtttcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctggcaagtcttagtcctttgttctcctcacttcgggacccttccacagctaacgcctgtgttccactctgtgtacttgtcaagaagggtgcctctcatacccttagcatatgacttatccttcttgttctttatcctatcatttttgttgtttttttttgcttgtttgcttttgagatggagtcttgctctgtcactcaggctggagtgcagtggtgcgatcttggctcactgcaacctctgccttccaggttcaagcgattctcctgcctcagcctcccaagtagctgggatgacagttgtccaccaccatgcctggctaattttttgtatttttagtagagatggggtttcaccatgttggccaggttggtctggaacttctgacctcaggtgatccacctgcctcagcctcccaaagtgatgggattacaggtgcgagccactgcgcccggcccatctttgttgttttaatacatgttagcagcttctttccctccatcatgtttttctgatttctctgtagagtttcaagtgggcccagcaattgcttccaggggcttaattctgttgtgagaatgagtatcactgttggctctcagggtggtggtgtaacacacaatctctctctctctctctcattctttctctcttgctcctctcccctgtccctctctcctagtcactgtttcctcaaagcagttttagtcggataatagaacttcatcactcatctcctgttattcttgtcagtgatttctctcttaaaagctctaaaatctttgttgcaatttgaggatgctgacagtgacagggcagctggctggacactgaatgcaagtttcatattgtggtgcctcctatacttagtgtagtcactgctgaccagagcctggtctcaggcttgtttgtcaagacacttggctttgttattatacccagtggtgaaagatctgactcacgaaaaccaaattaaccagaagctgatatttaaacccaaatgtttgttattttacaatagtggctattccactgcttccatgaggaacttggaaccacagttcagggcagccctctttcgggaagcaaaatcagtaagtaggtttcttagcgagcatggaatagaataaagggacatggctgggcacggtggctcacacctgtaatcccagcactttgggaggacgaggagggcggattgcctgaggtcaggagttcgagaccagcctgaccaacatggtgaaaccccatcgctactaaaaatagaacaattagctgggcatggtggcgggcacctgtaaccccagatacttgggaggctgagacaggagaatcgcttgaacccgggaggcaaagttgcagtgagccgagaccaggccattgcattccagcctaggcaacaagagcgaaactctgtctcaaaaagaaaaaaaaaaaagaataaaagcacataagtgtctctgggccgtgatttatccatgtcagcgtgagtctgataaaagatcactgcttctacctacgtctgaagatttatttgctttagctaatagttctttgatcactggtaagactaaagagtttttctatgttcaccagttatttgtattattccttttgagaattgaccgttcctatcctttgcctacttcttaacagtatcctattgatttatagaaattctttttatgctgagattattactcctgcatcatgtaatgcaaaattttaagtatattatatttaattatattaatcttgttaattaagaaagtagtctccttattcgtgtgtgtgtgtgtgtgtcatgaagacattccgatgtgtccagaatattttattctactgctttaactcttaaaataggaccttcggcagcagcacactgtgttgactcaaatattccccaatttgaagcaggctatatatcaaagtttctgattggttggacttgggagataatacccagatttgctagactgtctacctatctttgcgtcccactgccaatatttcctacctctttccagtaagtctcttttcccactttttactccattactctttaacttataatgtactttttgccttcttatgttgaaaccaaattctgaacagaatgaaagatctcctgactgacctggctagagaaggagaagcatttcttggtgggactcaatgtaatgtcatagacactatgtctgcaacttgctattatctccacggccaatataccaaacttgtagaaatattcatgtttttgtgtttctagtacttctcttatggaattaccagttaatcatagggctgcgatgtacaccaaaacaatgtcatatataagataaaatgtgcccccagtgttttcctaagtttagcatctactttccagtcactccttttgtaccttctccctaaagctggcattggattatttggctatcggaattcaatgctcctggttgtccttctgttgcttttccttttgaatcacgtggtttcttgaaataatcacaacttggacttccaccatgtgttttatatttcttttgtccaccctcctctaccctaagaaagagctccctaccctttaacggataggcagctttctttcccctctagaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggtaagtgccgttggcttcctgcggctcctaagcaccaatgcagaatttcccaaagcctacagttgcttttctggtggtttcttattttcttcctttgtcttgttcttgatccttgccacaccatctgtattccccctgctttcacactttctgctacccaggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggaggtgagaaaaaagatgtgccgaggcatctcagaggagcctcagccaaacagctcatgagcacagttcagtcttccactctcaataagtgtttgttgaatgtgaatgaaagagaaaactgtcacaccacaactagtctggattattcccttggtcaggcttgagtctgaaatgaaagtatgcctttggagcgagctacatccttcatccttgctgtgaacagaatagcttctctgtgccattctctaagttaagtcgtgagtgccagtatctccctgaaataactgccagagccagtttgcaggcaggtgaagatcattaggtttcttcctgatccagttgggatagctgttctctagatcatagctcttcctcaccacagatcctaggcttcacctacaacagtctcaagctgcccttttcctcaatccatgaccaacatctttccagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgggagttcgaggttattacatcttcacgccctcttcccagtgttgtctccctgtcctgattctacttttctttgattacttgcttgaaacagtctctcttaaaacctgaagataaaggatttagaatattgtcaagagcaacagagcagaagacttagagcctcactacttgtgtggaaacactggcttcttctgcttcttttcagccacaaagacaacattcctaagtgggtagagccagcaacctgaattctatacctctgtatctgaataaacttctttgttttttgagatggagtttcgctcttgttgcccaggctagtagctgggattacagacatgcgccaccacacccggctaatttttgtatttttagtagagatgggatttctccatgttggtcaggctggtcttcaactcccgacctcaggtgaacctcccacctgagcctcccaaagtgctgggattacagacgtgagccaccgcgcctggctgaacaaactttttcaagctctgtaatgctgtctagtatctgtctttactaaaggcctgttgtttcttagtgcatgactacatagatatctgattataaactgagaccttaacactcccccatcattctctcacttcttttaaacactggacacaagttagagagatttccacaccagatcatgacaaacacaaatttcttggattttttttttcctcccaatgtggagctgagctccatactgtctttcctaacttttatacctaggattgtgggggtgtaccaagaggggtcaactctttgactacagtcctgggagggtgaggtgggggtatccatgttttccttaggaagtggggatagctgcagtcagaaacaaccatatttaacaagattctggatgctccaggacatgtatgcagctctctcctcaatacaactgcttaaaaaaaggctgacacttctggacacaactcctttgccaaacaggggaggcagtataagccacctgttaatcagtgttacaaatcagacatctggcatttcgaaagagccattttgcttaagttttcttgggaccacttgagggtagaggtaacagttttcttggtacaactaaggcacagtaagcatttgataatagtaataataatgcagccttgttcattggctggatgactgatgacaagcaagctgtactccttttcatacacccttcactatctcttcctgaatcctagagataacccatcttccctgattaatattctaactgcactgctgtttgattttacttctgagtgtatcatcatcgtaattatttaatggatgttaattaattgctgataaaatatgttgaaattaaaaatgggaaggaagtagataaggtgctgacaaatgctcacttgcttatttcatgtgatcaggtcttattaatatctgtttgtttctcaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggtaactctccaggactccacaggtagcagatctctgccaatcctatggagcagatttgaaggagacagtattatagttgaagtaggtgcagtggctcacgcctgtaatcccagcactttgggaggccatggcaggcgaattacctgaggtcaggagttcaagaccagcctgaccaacatggggaaaccctgcctctactaaaaatacaaaaaattagctgggcgtggtggcacatgcctgtaatcccagctactgggaggctgaggcaggagaatcacttgaacctaggaggtggaggttgcggcgagccgagatcacgccattgcactctggcctgggcaacaagagcagaactctgtctcaaaaaaaaaaagaaaaagaaattccctctgtgagtgtcatgtgtcctgtgaacttaatatatatccctcataatgccatgagactactgatggagcgaaagcctgggttttactgcggaaaagagagagaaatagcatttctcagctccatgaggagagaaatgaagtctaacactagttcccaaatccctttcttgtgtttctaggttgttaaactaccagcttgtaatgctatctctgatctttctattcaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagaggtaagaccttaaaaactctgaagcactaaattgtgggttgtagtgtccccagatgtattattctcagaggtagaagcagaagcagaagcagacacacaagataagcactaatcggccgggcatggtggcttcggcctgtaatcccagcactttgggcagttgaggtgggcagatcacctcaggtcagcctggccaacacggtgaactcctatctctgctaaaaatacaaaatgaggcctggtgcagtggctcacgcctgtaatcccaacactttgggaggccgaggtgggtggatcacctgaggtcaggagttcgagaccagcttgaccaacatggtgaaaccctgtctctactaaaaatacaaaaattagccaggcatggtggtgtgtgcctgtaatcccagttactcgggaggctgaggaaggagaatcacctgaagctgggaggtggaggttgtggtgagctaagatcgcgccattgcactccagcctgagcaacaagtgagaaactccatctcaccaaaaaaaaaaaaaaaaaattagccaggcatggtggtatgtgcctgtaatcccagctactcagtcgggaggctgaggtaggagaatcgcttgaacccaggaggcggaggttgcagtgagctgagatcgtgccactgcattccagcctgggcgacagagcaagactccatctcaaaaaaataaaaataagataagccataatcatagctaattgtggctagcttgtgtttccacaaacacaagtagtttaacaaacccctggactgttcatttcaatgtaatttaattcagcatattatgtactctacagtttatgcttaaagttttaatactatatatatttttaaacaagtactcactttttttttttttttgagaccgagtcttgctctgtcgcccaggccagagtgcaatggcatgacctcggctcactgcaacctccgcctcccaggttcaagcaattctgctgcctcagcctcccaagtagctgggattacaggcacgtgccaccacacccagctaatttttgtatttttagtagagacgaggtttcaccatgttgatcaggctggtctcctgacctcaggtgatccgcctgcctcagcctcccaaagtgctgagattataggcgtgagccaccatgcccggccaacgagtactaacgcttaaaaatcaaaaagagccagtattgtctgggcatgtacactcacgcctataatcctagcactttgggaggctgaggcatgcggatcacatgaggtcaggagttcgagaccagcctggccaacatggtgaaaccccatctctactaaaaatagaaaaattagtcaggtgtggtgacgggctcctgtaatcccagctactcaggaggctgaggcaggagaattgcttgaacccaggaggcgaaggttgcagtgagccgagatggtgccactgcactctggcctgagtgacagagggagactctgtctcaaaaaaataataataataaaaattaaaaaaataaaaagagctaatatttaaaaagaaggcaggaaggaaggaatgaagaaagaaaaccaagatattaccagctatgtagtattgttgttcttattctgaagcaggtgaattacactgagtggaagttctcagagactaacagcttcataggtgatggctttaaaaatcagcacgaggaagaggaaatgacattatcccattcagcactgaaacagaaggaacctctacatcctgtaaatggtattgtcttttaaaatctattttttttcctagcactttgggaggccgaggtgggcagatcacgagatcaggctttcaagagcagcctggccaacatgatgaaacccgtctctactaaaaatacaaaaattagccgggtatggtggcaggcgcctgtaatcccagctacgtgggcggcggaggcaggagaattgcttgaacccaggaggaggaggttgcagtgagccgagattgcaccactgcactcctccagcctgggcgacagagcgagactccatctcaaaaaaaagaaaaaaatatatattttttctgtttaatcatttaattgttttgccaagctagttatttacttttctccttcaccttagaatgctaaagttttcatggaaaattagtatgtaagacctgaggcccagttttgtgttacaagtgtgatggttgggttaaccaaggctggaattcttaaataagtaactttctcagtgtttataaaatgttattttgccccaggatttttttgttttgttttgttttgtttttgagatggagtctcattctgtctcccaggctggagtgcaatggcaggatctcagctcactgcaagctctgcctcctgggttcaagcaattctcctgcctcagcctcccgagtagctgggattacaggtatgtgccaccatccccggctaattttgtatttttagtagagacaggttttctccatgttggtcaggctggtctcaaacttctgaccttaggtgatccgcccacctcagcctcccaaagtgctgggattacaggcgtgagccactgcacccgacctagttttgattttctcattaaaactgtttgttggctggttgtggtggctcatacctgtaatcccagcactttgggaggcatgggcgggtagatcacctgaggtcgggagtttgagaccagcctgaccaacatgatgaaaccccatctactaaaaatacaaaaaattagctgggcatggtggcatctgcctgtagtcccagctactggggaggctgaggcaggagaattgcttaaacccaggaggcagaggttgcagtgagctgagattataccactgcactccagcctgggcaacagagcaagactccgtctcagtacaaaaaacaaaaaacaggacagtgtttgtcttgattattgagtttttggcaccccttcaaattttatgcctaaggtcagtgcctcacatgccttcctctacttctgacagtggtcagaatagtggttactgctaggagaaggggaagagggttatcaggaaaggacaccctttgggcatctggagtgctaccagtgttctatttcttggctgaacggtgatagagatgttcattttacaacaatttaataagttgaacatttatatttcatgggcttttctatgtgcttgaaaaatttaataatgagaggaaaaatataaaggtagatatggaaatattatgaaaagagagtctttactacttaaaaaagctttttttctaaatctctagaagcattttatatatatataattttttttttttttttttttgagatgaagtctctctctgtcacccaggctggagtgcagtggcacaatctcggctcactgcaatctctgcctcccaggttcaagcgattctcctgcctcagcctccagagtagctgggactacaggtgtgccccactatgcccggctaatatttgtatttttagtagagactggatttcatcatgttgtccaggctggtctcgaactcttgacctcaagtgatccacctgcctcagcctcccaaagtgctgggattacaggtgtgagccaccacgcttggcctaaaagtataatttttaagcttttgaatgtatttggcataacttcttaaatgggaagagcataaatgatttttctcatgagaaggataatttttctattgattatgtaatctgatttctccgtcaaagtttactcaatgtaaggaaggttaacaagaataaccaagcccaaaatttcccagagccaaatttacatgactggcaagaaatcctggttataagagaacaattccattcttatgatttgcagacaatggaatattatttagtcataaaatagtagaataaatagtaacagtgtatctagatagcttcagtgtatccagacctgaatgcggggttccagttatctccatactcccaatttacatttcttcaggtatttgattgagtataatctatatccactagctttttctccttgtagaatgtgaaatatgggaccagaaggtaatctaaacctcatgtactatatggtcatctatttatagtcataaataataaaagaagactatttctgtggaagcctaattgttagttattgttttaatatcgctgttctccatgaatttcaaaagatcaagactggccaggcgcagtggcttacacctgtactcccagcagtttgggaggcagaggcaggcagatcacctgtcaggagcttgagactagcctggccaacatggtaaaaccccgcctctactaaaaatgcaaaaattagccaggtgtggtggtgggtgctggtaaccccatctgagaagctgaggcaggagaatcgcttgaacctgggaggcagaagttgcagtgagctgagaccatgccattgcactccagcctgggcaacaagagcaatgcttcatttcaaaacaaaaacaaaacaaaaacctcaaaagcaccagttagtactcgcaagaagctaaaatctgcctggtttcagatgtctgagtggagctatcaagcaggatgctgtagttgttgaaaaagaagcttattaatcttttagacaaagatctaagggtattaggtaaaggccatcaagaaatgaaaagggcctgattttaaggccatttccacatatgtagacaaagccttgtgtcttttagcagcctttgcttttgctgcccgctcagaccttttccctttgagacctcagtgaaacagacaacccaagactttgaaattttacagaagaggcacagcttgccatccagttatctaatgctatgtaacaatctactccaaaacttaatgacttaaaacaattgtcatttctttggctcactactcggcatgttaggcaggtctcatgaagaaggctcatttctcctctctcaatgtggcattagatggggtagctcagctagggggctgatgggttcatcttgcaagatagctcaccctactagctgatcaggtggtcctggctgtcagtggttgcttgggcttcctcacaggttggtagctgagttccaagacagcaaggtacaagtccatggcatttttgtgttctggccttagaagtcacatagcatcactcctaccgtactctttcagttgagacagtccaaaagatccaccttaattgaaggggaggggacaaagaccccaccactcaataggagcagcgtcaaggtcagtcgcattgtaaggagagcagctgagataggagagaccatttgaggccacctttttttttttttttttttgagacagagtctcttgtcgcccaggctggagtgcagtggctcgatcttggctcactgaaacctctgcctcccggattcaagcaactctcctgcctcagcctcccgagtggctgggaccacaggagtgtgccaccaagccaggctaattttgcatttttagtagagacggggcttcaccatgttggccaggctggtctaaaactcctgacctcaggtgatccacctgcctcgaactccaaaagtgctgggattacaggtgtgagccaccacgcccagccagagaggccatctttggaaaatacaatctgccccacccaattgcacagctttacctcaagcttggccattttcttcagcccccacaaaaggacttcctttcttccttccttactctcacccttccttcctgtcttccttcctttcttcctttctgtttttccttctttccctttctttttttgagaagtgaatcctgtatgtttggcaagcttctgaataagtgtacctttgaaaaagagggtttgattcttagtaagtgaaggcaaaatctagacactcggaactagtgaccagacagtggattggagatgtgtgtgctgggtcttttcttgggctaaagtgctttgaaacagttctataactgcaacctcttctctagcagacaaagaatcctctgaacaaggttctgaagtcagtgaagcacaaactaccgacagtgatgatgtcatagtgccacccatgtctcagaaatatcctaaggcagtaagtacactggagtaatcattgcatacgagataagacgataaataatgacagtggccagtcatgggggctcacgcctgtaatcccagcaccttgggaggccgaggcaggcagatcacctaaggtcgggagttcgagaccagcctgaccaacatggagaaaccccatctctactaaaaatacaaaaaaaattagccaggcatggtggagcgtccttgtaatcccagctactcaggaggctgaggcaggagaattgcttgaacccgggaggcagaggttgcagtgagccaagatcacgccattgcactccggcctgggcaacaagagcaaaactctgtctcaaaaaaaaaaaaaaaaaaaaaaaaagcaataatgacagtgtgcttagtggccacacaagtgaagggcaatccagttttaatgaagctgatggaaaatgcaaattgtttagttaaatttatgtttcgtgtgaatgaaggtcggctggtacagtcagataaaaggatcattttcttgagatagtgtaaatgatgacttgcttcaatacttctgtcctatctggatcctttgcctcttactcccatatcctccattgtgtcctgtaattcatgcccagcctgaatggtacccctgcctttaagtccatctaaggagaacgggtttgctttgggagatggagtctggaagagaggacaggattcttcatgggagggctcatggagatcattccatttctgctgttttttactcaacctgtaattatctattaaacagttcagcctcaaagctctttcagaactgatttaagagacacgcatcaaaaaaatataaaaaagaaaaaaaagccggttgcggtggctcacgcctgtaatcccagcgctttgggaggccgagacgggtggatcacgaggtcaggagatcgagaccatcctggctaacacggtgaaaccccgtctctactaaaaatacaaaaaaattagccgggcgtggtggctggcacctgtagtcccagctactcgggaggctgaggcaggagaatggcgtgaacccaggaggcagagcttgcactccagcctgggcgacagagcgagactacgtctcaaaaaaaagagacacacatatattaataaatatccacacatatattcagtaatcattgtgttctaaccttgtgggttacacatgaggtagaaaacaattactcttaagtcgctgctgcctgacacatttgtaggtcctcaatatttgttgagtgagtgactgaataatagattcagagtgaattgatgattatgaacttcattagaaacattaaataagaatgtaggatgacctaaaaccaaggaggtagattgtgtaatataaagtctgttgtaagaaatcagaaaagggaatttatggtttcttttgtagaggttggaaaactcttccttgaaagctggaacatgtgcttgagaactgcaggaaaatgaaggatattggagtgaggagaaaaaactcaaagtcagtagacttaaacactgaatataacacatagttcaatttcagctgaggtgtggtggctcacacttgtaatcccagcactttgggaaactgaggcaggcagattgcttgaggccaggaatcaagaccagcctgagcaacacagcaagacaactgtctctacataaaatttaaaaactagctaggcgtgttggctcacatctgaagtcctaagtatttgggaggctgaggtgagaggattgcttgagcctgagagtttgaggctgcagtgagccatgatcttgccactgcactctagcttaggtgacagagagagaccctgtctcaaaaacaacagcaacgacaaaaccagttaagtttctctttgtctgaacttttatctatcatatctttttttagatattatgtagttatctgacaagtgtttgtaagacagactggagccacagaatgttggaattagataacacttctatattaccaaggtaaagaagattaaatgatgtgtacaggattattgagttagtgaaagagctgaaactccagttgaggtttttaaactgcgcaacctctcaagtaaccaaaaaaagcagccagctgatcagcaaactcatcttgaactgtaacaagccagccagatttcattaaaaacattacctaaattaaaggctcctaagtaagatatccttttagaaaacttccttgtgtgccccaaagtgttacttgagaaattaaatatgagaaaggagcctatctaagcaaaaaattagtgttattatcaagttaaacgtacaacacaggcacatatatattaaattattgttatattccaaaatgtccaggcatgaaaggtagagggggttgaaagctcagagtcaaaacttgagttctgtcactcttctgcctggggtcagctgggataaatggaaatgcagtagagtgtaatgtttaagagcatggagatttggttgagacagtgatttagatcccagctctgctacttaactagatatacagctttgagagagttttttaacctctattaggccttgtctccttatctgtaaaatggtagtattaagtatacccatctgatactgatgtggcaagattaaaataagggtttaatacagtgcccgagacaaattaagccctaaatgatagtgaggatgagtgtgatgataatagtagtctcatttctctgacctactggagttctcaatgttaagctttttttttttttttttgagaaagagtcttgttctgttgcccaggctggagtgcgtgcagtggcgcaatctcggcttactgcaacctctgcctcccaggttcaagagattctcctgccacaggctcccgagtagctgggaccacaggtgtgtgtcaccacgaccagctaatttttgtatttttagtagagacggagtttcactatgttggccaggctggtctcaaactcctgacctcaggtgatccacccacctcggcctcccaaagtgctggaatttacaggtatgagccactgcgcccggcctaggttaagcatttttttttttttttttttttttttagagtctcgctctgtcacccaggctggagtgcagtggcaccatcttggctaactgcaacctccgcctcccgggttcaagcgactctcctgcctcagcttcccaagtagctgggactacagacacacgctgtcacgtccagctaatttttttgttttgagacctagtcttgctctgtcacccaggctagagtgcagtggtgcgatatcggctcactgcaacctccgccccccaggttcaagcaattctcctgtctcaccctcccgagtagctgggactacaggcgcacgccaccatgcctggctaattttttgtatttttagtagagatggggtttcaccgtgttagccaggatggtctcaatctcctgacctcgtgatctgcccgcctcggcctcccaaagtgccgggattacaggcgtgagccaccgctcctggcctccctcttcttaacagttactaatgaggagggagcaatcattttcatttgctctatggtcccagattactgtttctttagcaatagtgaatatcgagaacctcaaaattttttctcttatcgtgtcaatttcaggtgtcaggaatttcctgacccttatgtatgccaggtagtaagttttggcagccctgccccccagccaaattaggtggcacatctgagctaataagccaaagggtgttatctggcactaatccttgcagggtttctgccagcaagttcaaatgagttgatatatatttcaatggttaatattactaattgcatactttctttgctgttcagccccaataaaattacataatggaattagctcatgtaaagaaagtattctgaatccaacaaaaaatattagattgaaccatatattgtcatactcatagataaaaaatggttgacaattgtcagttctgtatagtccaacctaatatgaatgaataaaacatctgtgtgtacttggatcaaattttaatcttattcatcctcccatttcaccattgttaccagaataaacttgatgtagtctgcatgaatatggacttctgattattgtcccaggattattagcaagtttaaaaaatttgctgggtgtggtggctcacgcctgtaatcccagcactttgggaggtcgaggcgggcggatcacctgaggtcaggagttcgagacaagcctggccaacatggtgaaaccctgtctacaaaaatacaaaaattagccgggcgtgatgacgggtgcctgtaatcccagctactcaggaggttgaggcaggagaatcgcttgagcccaggaggtggaggttgcagtgagccaagattgcaccactgcactccagcctgggcgacagagcaagactctatctcaaaaaattgttttgttttgtttttttaactaggcaggtgtggtggctcacgcctgtaattctagcactttgggaggccgaggtgggctgatcatgaggtcaggagatcgagtccatcctggccaacatggtgaaaccccgtctctactaaaaatacaaaaattagctgggcgtggtggcgcgtgcttgtaatcctggctactcgaaaggcggagaaaggagaatggtttgaaccaaggagtcggaggttgcagtgagccgagatggttcccctgcactccagcctggtgacagagcgaaactcggtctcaaaaagaaaaaaaagaaaaataattttagatgtacaggaaggtgctatgtaatgtttatttagttttactcttttttcttcttttttggtaatgttatgaaacatgtatttttcaatcaataatgttttggggttctatccatgtcgatatatttagctttttatagttccttcgtcttaactgctgatcgatattgcattaaaataatacatgacctttcgtttagacagaactctaatgggtaatgattgagatttcatactgtgtgccaagtgcttgatattcatgactctctcgggcttcacagcagccttatgagttattctttccttcaagtaattatgaagtgcctgttttagtaactgccgggctctgtgggcacaaaatggtggataagacagacttggtctcttctctcttgaatcttacatactactgagggaaaatatgtacatcagtgagcaaataagtaaagcagatagctctgagattctaagtactatgaaggaaataaatagggcgatataatagcaatgcgaggagttgaactaggataggtgttgaggaaagatttctctgaggaggggacgtttgaactgaaatctgaagaacgagaagggaagagctacccatgtactgggtagactgtactcatctcaggcaaaggaattggtaagtgtaaaggccctgaggtaggaaagagtttgatttacctgaggagtgggaaatcaaaagaaaattaaagtttctcttgcacacatgtatattattattcccccaccccctttcaaaggaggacagtgaagtctagggagaagagcttgctcaagggaatatttaatacagttttactgagtgtatactgtgtgccagacattatgccaggcattgtgccaggcactagatactcggtagagactttaatggggccgggcgcaatggctcacgcctgtagtcccaacactttgggaggccgaggtgggtggatcacttgaggccaggagttcgagaccagcctgggcaacatggtgaaaccccgtctctactgaaaatataaaaattagtcgggcatggtggcacatgcctgtagtcccagctactcaggaggctggggcaggagaatcgcttgaacctgggagtcagaggttgcagtgagccgacgtcgcaccgttgcactccagcctgggcaacagtgctagactccatctctaaataaataaatacagattcccaggagccactctagacagtctgatataacacagaggcttttatacattttttatagcaatcactatgagaaatacatttctgcagtatccaatactcttataaaagaacaagtttcaagaaaccaggcttactattaacatttgccatgcattctcctattccactagatagtgtcttatcctgtctatcctatcctattgtttcttttttaaaaagctagtgaaacccgctaatctgacccatcaaagtgtcaaaaaaaaaccagatttttcaaaacactgtatagtcaatagttttcttgatgtttgggagagttggatgttatgggagggttattaagagaaaaacatcaaatatcgtttttttgtttgtttgtttgttttttgagacccagtctcactctgttgcccaggctggagtgcagtggcactgcaacctccacctcctaggttcaagtgattctcatgtcagcctcccgagtagctgggattacaggcatgagccaccatgcctggctaatttttgtatttttaatagagatgcggtttcaccatgttggccaggctggttttgaactcctgacctcaggtcaactgcccgcctcggcctcccaaaatgctggtattacaggtgtgagcctctgcaccccgccaaatatcttcatttttaagaagcaccccagatgattctgatgcagaatcattgagagatcttgcctgctgaatttcttaggggcaggcacaggagctccacttgctttctaagagaagaaaagatggggtaagagccggtctttggagaagtaagggcattggcctggccagctagtgaaaagaagcatacaggagggcactcacagatagaggggagagcgctatggctggtagggaaccatcctggattgactcattactggtgtcacgatactgacttgcctgccacactgtggaaggaggagacttctgttggccttggtgtacttctggaaacttcctcctggtatccctgatgccaacatggacacagggacaattaaaagaaaggacagggtgatggcagcgactgtgaagtgggattgaaaatattggagttcctggccaggcgcggcggctcacgactgtaatcccagcactttgggaggccgaggcgggtggatcacgaggtcaggagatcgagaccatcctggctaactaaaccccgtctctactaaaaatacaaaaaattagccgggtgtggtggcgggtgcctgtagtcccagctactcgggaggctgaggcaggagaatggcgggaacccgggaagaagagcttgctgtgagccgagatcgtgccactgcactccagcctgggcgacagagggagacactgtctcaaaaaaaaaaaaaaagactggagttcctgtgggagggcagggtggtctggtggcctcctcagtggcatgcacttgagtgggcatgggaagccctgggcagctctttgctatagtggctgaagcagctactgaatctccagtatcagtcaggaggtcttttaggtcctaacctcaggaaaatactagcttggttttcatgaagaacactgtggccagttgcagtggttcatgcctctcatctcagccactttgggaggctgaggtggacagattgcttgagtccaggagttctagaccatcgtgggcaacatagcaagaccatatctctattaaaaaaataaaaataattgtccctatgtggtggtgtacctgtggtcctagctacttgggtgactaaggtgggaagactgcttgagatcaggatgtcaaagctgcagtgaaccatgatcacacaactgccctccagcctgggcaacaaagcaagactctgtctcaaaaaaaaaaaaaaaagttgagaaatagctgtttagaaatttatttatttgtatataatcatcgggtacaagcacagttttgctgcatttatatattccactgtggtgaagcctggagcgacgcacattgttcccaccaagcaacctcccatcatccaccctccccgccgctccgaatcagacatttttttttattctttctatatgtggagatgactgagaaaggctgtcctggagaaatgatccactggactgtgagagagaagagctgggttctctttataaatttcctatcaattaactatggcaattaagtcaagttgtcttttgatgccagttttacctataaaaggattctcagggaataatatagtagatagattatacctatggttgatttctagagagtaccgtaatgggttaattggatggcgtataagcacttggagcctcactaacctttaggaactaaataaacattttccttatcaggattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaagggtgaggcatcctgtgtggttactggggtgaggaagtctgatgaacattgagactgagggtcagaattactctggatttttgtggggtgaatccagccatttcactttattattttattgttcaaagtgttgtgtgcatgtggtttaaaaacatcgaatggggctaaacattttacatgaagcaggcctttgtcccagctcttcacagatcacttcgcctgttcccacccttcctcaatccacggcttcccacatttcagctatatttatttttactttttgaggtggagtctcgctctgttgcccaggctagaatgcagtggtgtgatcttggctcactgccacctctgactccgagattcaagcgattcacgtgactcagcctcccaagtagctgggattgcaggtgtgcgccaccgtgcctggctagttttttgtgtttttagtagaggcggggtttcaccattttggccaggctggtctcaaactcctgacctcaagtgatctgcctgccttggcctcccaaagtgctgggattataggcgtgagccaccaagcccatcctatctcagccatttcttctgttatttacttccatcatatttctgagtattgatttttgttcttcctcttttcctgtttttttttttttttttttttttttttttttttttttttttgagatggagtctgaacatgttgctcaggctggtttcaaactcctggactcaaatgattctcctgcctcagcctcctgagtagctggaattacaggcgtgagccaccatacctggcttctgagtaacatttctattgcaatctcctgattcaccggctttagacttcctatctcggaccttaaaagttagctcttttgcactacactcatgtccctttccttcccatcgtaattgtatcataatttttatttaaatccatttaaattggttctgttattatggatatgtaaatattaattcttgcagaaccaagtagtatgcaatgattatatttctttacacgtattttttgcagcaatttttcattcgccttattttcattatacatattgtaattattttcgtgtccttcaacagtcttcccaaattttgaaataatcaaacctgtcaaattatctactcatctatttttttcctgaagacctctctccatcctcttgttctgctctagcccactgtttcattattactgctgctcatggagaatacgatcaaattctctcctataccagatttcttatctcctggttatcctctaatttattttcttattttaatggatcatattttcagtagtttttaaagaaagggcatatcacaagtgaaaatttgagaaagtcgtgcatgaaatctttttttcctaccctcatatttgattcaagtgtggaaatctttttcattcagaatttcgaaggagcctgggtgcagtggctcatgcctgtaatcccagcactttgggaagccaaggcgggcagattacttgaggtcagaagttggagaccagcctggccaacgtggcaaaaccctgtctctactaaaaatacaaaaattagccgggcatggtggggtgcacctgtaatcccaactactcgggaggctgaggcaggagaatcgcttgaacttgggagatggagactgcggtgaaccaagatcacgccactgcactctagcctgacacagtaagaatctgtcacacacacacacacacaaatgattttcaaagcagttggtccatgttattctagatccaggcaaggagtctaatctttttatgaaaactaccatgaataccactaatgaaagtcttggggctcacactgcaacagtatatgattctttgcttttttctcttacccttaatacagtaatagacctggacccacaggagcagcaaggccgaaggcggtttctgttcgacatgctgaatggacaagatcctgatcaaggacagtaagcatctgctttccactttgaaacaaaggagatattgagacagaaattcaaaagtttgagtttggttttgtgctgatgctgaatattttaataacttttttgagttaatttactcttaatgaatttcctatgtacttgagtataatttatatttgtgactacctaatccattacctaatcttataggttatttatttatttatttatttatttattttcgagacagggtctcactctgtcgtccaggctagagtgcagtggtgcgatcttggctcactgcaacctccacctccccaggctcaagggattcttgtgcctctgcctcccaagtagctagggttataggcatgtgccaccatgcctggctaattttttgtgtttgtagtagagatagggttttgccgtgttgctcatgtctggtcttgaactcctgcgctcaagcgatctgccctcctcggcctcccagagtgctgggattacaggcgtgagccaccgtgtccagcccatagtcttataggtttagttcatttctcacccatgccagcctgatgggccctttttttgtagcagcagtttacttgaatattgacaatgcccaaatggaataacaaaaagtgttgacattcttcttttttttgagacagtgtctcactctgttgtccaggctggagtgcagtggtacaatcttggctcactgcaacctccacctcctgggttcaagcgattcttctgcctgagcctcccaagtagctgggatgacaggtgcacgccacttgcctggctaatttttgtatttttagtagagacagggttttgccatgttggccaggctgatcccaaccccaggtgatccttctgcctcagactcccaaagtgttgggattacaggcgtgagtgaccacacctggtcaacaggaattttttgatgttgacataactaagtgaattttagatctcctttaaagttttaggaaagctggttgtccttattattccaataatctgaagaaggcctcctttcagagtttccagataaaatgtgggacatacccaaaaaaaaattatttggtcgggtgcagtggctcacatctgtaatcccagcactttgggaggctgaggcgggcagatcacttgaggccaggagtttgagaccagcctggccgacatggtgaaaccccatctctactaaaaacacaaaaaaatcagctaggcatggtggcacatgctggtaattctagctactcaggaggctgaggcatgagaatcatttgaatttgggaggcggaggttgcagtgagctaagattgtgccactgcactccaacctgggtgacaaagcagactctgcctctaaggaaaaaaaaaagttatttgttgtttagctgaaattcaaatttaaataggcatatggtttttgtttttgaaatctgttatccataccgcctgtgcatgtgtgtgcataagaaataatatggggctggtgttttatcttatttttaatttttttgtttgtttgttttagagacaggatctcactatgttgcccagctggtctttcagctcctgggctgaagcagtcctcctgccctgcctcccaaagtgctgggattataggcatgagccactgtgcccgacctggtgttttaattactttttgaaaggcccaatacttttgtttcatctgcttttactttgtctttggttagtcatagaaagaactgaaaaaggagccagatgaaataaacagtgactctgacttcagcatcactgtgggcttaaacagatgtaagcttacagagaacttttggacatggaaagtgatttggttctttcctttctgtgctaatgttaaatttagctttcacttttttttccccagcatttccagaactctctcttcctttattcccttacagtgataatcattttctactcaattttagattcgattggtattacctttggctttctttttgccagtatggtctagcagacagagcaggctttgtaatcagaccaaccttgtttttattccagactctttgacttactagctctttgatctttttgatattacttaatttgaaggctcttgtgagaataaaattgagctaatatagtttacataaagcacttggtattgtgcccggcacattgtaatgctagttatcatccctttcctatgcaaattgggatgagggagtcagcattatcacttcgcattgttgaagttctcaataatgacatagaaacatagttacaaatgaatattgcctaatgggctgagaatggatccctttaaagtaattcctttgtttcagtttaatcatatttagctgtgcttttaaaagcttgaatttttagtcctattcctggcactctgtattagctaccaatatttgcttttaaaaattaataaaaatatgaaaaatcaagaataggcaaatccagagagatagaaagtagattagtggttcaggagctagggaaggagaatggggagtgactgcttaatcagtacagggtttctttttcttttttcttttagagactgggtctcgttctgtcacccaggttgaagtgcagtggcatgaacacagcccactgcatcctcgacctcctgggctcaagtgatctcacctcagccttccaagtagctgggactataggtgtgtgccaccatgcccggctaattttttattttttttgtagagacggggtgttcctatgttacccaggctggtcttgaactcatgggcacatcccatgatgttccctcttctaaaaggactgttactgcttaaattataccaattcctgacttttttgcttattgtcattttgtaaaatggaggcaagggaaaagtgattcagagaagacgttgtattgtttatgattacttttatccttattttatttttgaagcattaagagtatcaacagtgctgaattaaatgcaatttctttttagtttaaagtttacagtggtaagtgatcctctggatgaagaaaagaaagaatgtgaagaagtgggatatgcatatcttcaactgtggcagatcctggagtcaggaagagatattctagagcaagagctagacagtgagtcatttttttttcagttctaattatttccaaggaaatcatcctaatagtgaatatattttatcttcaatacataattattactatgaagttgataagacacaaagtggattgaaatcttatccctacaactgtatttatttctggatccaacattaaagtagtcagttgtgtatttttacccccatatacctgattacaactagaattgattttgaatctacaatgtttgaaaaggagatttttaaaaagacaagttattttcatttcaaatttatacatcagaattttggacctctcttgagcattttcgtataggcagctgatgcccattctttatgttatcatgcatccagtctttttttttttttttttttgagatggagcctcactctgtcgcccaggctggagtgcagtggtgtgatctcagctcactgcaacctctgcctcccaggttccagctgttctcctgcctcagcttcctgcctcagcttccatggtgtgccaccatgcctggctaatttttgtatttttagtagagaccgtgttttaccatgttggccagactggtctcgaactcctgacctcaagtgatctgcttgccttggcctcccaaagtgctgggattgcaggtgtgagccactgcacctggcccatcttgtctcttaaaaagacattaactgtctcctctttcctcacattcactggtcattaagtcttatccattctacttgtgaattgactatgctctccttactacaattttttttttttttttttttgagacagagtctctctctgttgcccaggctggagtgcagtggtgtgatctcggctcactgcaacctccacctcccaggttaaagcgattctcctgcctcaacctcctgggtagctgggactacaggcacctgccaccacgccagctaatttttgtatttttagtagagacgggctttcaccatgttgcccaggctggtctcgaactcttggactcaagcaatccaccctcttttgcctcccaaagtgttggcattacaggcataaaccactgcgcccggcctccttaaatataattactataatttctttcttttttttttttttttttgagatggagtcttgctcttgttgcccaggctggagtgcaatggaccgatctcagctcaccacaacctctgcctctttcttaatcaagcgattttcctgcctcagcctccctagtagctgggattacaggcatgaaccaccacgcccagctaattttgtatttttagtagagatggggtttcttcatgttggtcaggctggtctcgaactcccaacctcatgtgattcgccctccactcagcctcccaaagtgctgggattacaggcgtgagccaccgcgcccggccatataatttctaaactggtcttcctgccaccggtttcttctaccccatttccatctactatagtaaatacataatacatttgatcactgccttcttcttaaatccttttacagtttgctatagatcagcatgttttaaaaacatttgtatttgagtacctttagttgggactgcgctgtccagtcttcactgttcccattaccttacatagctgggatgtcacctatcttatctgctaggaccttcagacacttaagattatccactagatcaatgtttttcaaacttccagacacacaccccattagtggatgtgaaactgaattagtaaatcacaaggaaatttgaaaaatgcaaaccaaaactgtgggaaagaaaacaggaattaaaggccaggcgaggtggctcatgcctgtaatcccagcactttgggatgccgagatgggcggatcacctgaggtcaggagttcgagaccagcctggccaatatggtgaaaccccatctctactaaaaatacaaaaaaaattagccaggcatggcggcggacacctgtaatcccagctactcggaaggatgaggcagaattgcttgaacccgggaggcggaggttgcagtgagctgagatcaagtcaccgcactccagcctgggtgacagaacaagactctgtctccaaaaaaaaaaaaaaacaaacaaaaagaaaacaggaattaagagtacatagcacatattgtcttgtgaaacttgttttatgtattgtttaatgaatcatggtataaaattattcttactgatcattataaacattttttgaggaatactcctcagaccctaaggtttacaaagttcaaatgttagataagattctaattatattcctctagtatctttccaactgtgatccttagtctttttcctcatctataaaacgggaataacagcagtctctatcttactgagttgtgaagattaaggaagcacttaaataagggattaaggggcttagggtagtgcctggcataaggcaagtgacgttatctttgtgggctattttccaactcactcctatccccattcctaaacatgctatgttcttcctgacctccatgccatttgtatgtgcacagggaaaatccacttaagacttttctggtgatttctccagaaatcctttccaatttgtccattctggtgcagatgcctctttatgtccccaaagcaacttgtgcttccatttattatatagcacctatacactataccattttcctttctccttcactagattgagtcctcttatgaaatgggtaatttcattcatttagcatccccagtacctaacctgacaaataccaagtatcaaagtgttcaactgagtgatgctgtttttttccctttcccaacagttgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaatttggtttactgtgatgtctagtgtctctcaatctaatgatgaaagtttagaatgatgaaagtttcatttgtaaaactagctagctaaaggcatttttctccagtaccttagcactttaccaggcaggaagcaggcttgctttcaagaactgaaaatgaacggtcacaggtgaatttacaaaaacaaacaacaaaaaaaacccagtttattcatcttttagttcttccaaaattgaaaatatcaagtcctactgctaaggagaaaaaacaaacaaacataaaatccgggacccctccccccttcttctcttaaagtcacagagcacggaaggaactgcagtgggacaggtgggtgcagagaaccagaaggggaggatggcaagataaactccccaaatacttgaaaagctgttcaacagaaactgtgataaatacaggacaatgcaagacaaagttaaaataaggagcagcagtgccgagaggctgtgttgtagatatggcctcccttcctcttctcttttctcatcagggtattctaggcccaaggcatgacttgtcccttccagatctaaatgttgactcctttgagccttcctctacatttcactagaagcggtacatgaggcacaacctgatatatcttccttagatatatgagaaaaaaaagaagacagtggcaattttgccttctatcattgtaccatgtgtgcattgtatggagaaaataaccgagccagggagtatcactgcttcttatgtcttccaaggcagcagatatacctcagaatctgcacgaggcaggaaagcaggaaaactcagacgaaggcaccagcccaatctgcctcactggctcaagctgtatggtttatcacaaccattagcaaatttccgagaaccttgagtattgcaaagataaaacttagagatgtgcggaaggtcatggcagtagggtaggttggaggattgaatgtgctggtcaagaaccatgatacgggtaattaagggtcaccttgtaccactgtcttggaaatacagctttgagacaccaaataagatgtcagaagccatcaatgtcttggcagaaggtgacaggaagagagaagaatgaaacaatatttattaacagcgggagcctcctcctgtcttcaagaacacctcctcccttgccatctgaatggggccattggcacgtgtcctggtgggcctggaattccccgagtagattggtccacacaaatggccccctaaacccataaacacaaatggcaaaacttcaaatgaaaacgaaaggaaaaatacagtttctatgtcatgtaaaattttcaggggttggctggaggaagaatggagctcagggccaaagttcagaagttacttcctctttttcttggggggtgcagagctgtgtctggaaccacggttagagccacggcccgaactgtgcacagatgccttcctcttccggctcatacttcgactttgttcttcttcttcctcgtaacgactttctcggtccgctaaatagaagaggcattattagttagcaataggtaagctttaggtacctaatattactggatagcatgagatagtacagagaatacactttggaatcagacccaagttttaatattgggcaagtactttctgaaccttggtttatttacaaaagggagaattatttaagggttaaataaggtaacctatgaaaactacctattcccaatgcttggaacacagcagttaatatttatttccttttaagctttaaaacgtttgtttggggtttggcttcagagtaactagattagcattataaagacatgcctaacctggaagaagcctagaaaattaaagtattataggatttaggtttggaaactgagtaggctaattcttgagtattacatgaatatgtggctatcatggctataggaaagatgggggcttgcgcagatgaaaacagcatccagtttggcagagcactgcccactgga

SEQ ID NO: 16705 - DNA, 16965 bp, Human
gaccagattataaactctttgaaaacaggagccatgccaatcaaactattttttgtattttttggacaacagcgtatggcatcatgtagacattggataagtcagtgattcccgaaatgtttccattcagggagctccattaaaaaaaacaaaacaaacaaacaaacaaaaggccaagccggtggctcatgcctgtaaccccagcacgttggaaagccaaggcaggctgatgagctaaggtcaggagttcaagaccagcctggccaacatggtgaaaccccatctctattaaaaatacaaaattaactgggcatggtggcaggtccctgtaatacctgctactaggtaggctgaggcagctagaatccgggaggtggaggttgcagtgagctgagatcacaccactgcacaccagcctgggcagtaagaatgaaactctgtgtcaggccaggctcggtggctcacgcctgtaatcccagcactttgggaggctgaggcaggggggcagatcgtaggggcagatcacgaggtcaggagttcgagaccagcctggccaacatagtgaaaccctgtctctactaaaaataaaaaaaattagccaggtgtggtggcacgcgcctgtaatcccagctattcgggaggctgaggcaggagaatcgcttgaacccaggaggcggaggttgcagtgagctgagaccacgccattgcactccagcctgggtgacagagtgagtgagactccatctcaaaaaaaaaaaaaaaagaaaatgtgtcaaaaaaagaaagaaagaaaggattgtaggaaaaaccaccaccaccaaccttgtatttaagtttactacacatacagaaaagtgcacaccaaaatgttcagctcaattacatttcacaaactgaacacactcatgcaggtagctctcataacaaaaaacacaacgcaaccaggacctcaaagccctcttagtgtcggaacccgattttaatagattacacgtactttgtaaatttagcctaagagagagatcacgtatttgaagacctctcggatttttccttcatcagccctccccacttccccacgcctcgtcaacacaaagaagcatgcccgcacccaccaccgccccctcctcacctcagattggggaccaccgttgtgttttttatttttttatttttttgtaaatgaacgcatggaaacaaaccaacaccaccttcagtggaaaaggtatgttagtaccaaactgtcaaaaggaactagtgatccttcatcttaaaaatctgtactatggccgggtgtggtggctcacgcctgtaatcctagcactttgggaggccaaggagggcggatcacgaggtgaggagttcgagactggcctggccaacacagtgaaaccccgtctctactaaaaatacaaaaaatctgccgggcgtggtggcgggcgcctgtaataccagctactcgggaggctgcggcaggataatcacttgaacccgggaggtggaggttgctgtgagccgagatcgcgccattgcactccagccagggcgacagagtgaaactccgtctcaaaaaaaaaaaaaagaaaaaaacccccaaaactgtactatatggtgttgctctctacgagtgctactttaacacaagtcaactctcaggactcctctccgaatattcaacatggccgcatgcgcgtctataagcaacatggccgctctgccagtcaccaacatggcaaccacagcctcactgtgtccggaagcatgagagagcgggtatgaggactataccggccgctctgccaacacctaacgtggctctttatagcttccaagaaagcgcgacaccggaaatgacttttctgtcttgctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttgggtgaggcactgggctgttggggccgaggctcaaccggggaggacgggcgggatccctagagaaaaagctccagagtcactgccctttaccaaacggccatttctataaagcctcgtacattggtactccctctccaccttcagcagcagacgttcgcccttctgcaagtagttcgcggttcctcctcacgctgggcctcggttcttccagctcacttttaccggacggacgcttgagccccaccctcgtccgccttgcccactcctcttcagactgcgaggacgtcgcctttgtgaggctgctcagccccctatcccgcgaagcagcaagaacccctttttgttgctgctttggcgctttgttccctcagttataacgactcttttgtagtggtcatttcttggcagctgtgggtacagtaagcgaggaatgaacctttatatccgcagtgcccaatttagtggcccgtacagagtggcactgggtgtttctgaatgagtacccctaccggcattgacttagccatttacatacctagcaggaatctgaaaacatttgtgtttggtttccaaactttttctcttctcctgttgcccccgtgtcacgatcataaaacttgaaggaaatttaaaagattaaattcactgttatccactccctaccctcaggacaaactctgaattatttaaggcaaactagtaacaaagctctgcaaaaatagtgactcagtatcacctttgtggtagattgttccaatatttgtcagtatcttcaactgcatctctaaatcttgtctagatcatgttaggttcatgtgctcgtattctggcccctagaaatagaagatgcactggcaggatcctcccacctaattaattacctttcttgagtatctacagtgttcatgggtctaattagacaaaaataaggaagaaattgcccctgtcctcaagaagtttaaaaagcataggattcaaggggagacgcttacaaaaagtgaggaatatgataagatatatgtacgaaaccaaatgaatgaatctacagtctgtacaatgaagagaagtaacaagagctggtgtaggtagtgaagccatcaaaaccatcatagtggaattggcacttgaatttggcctttatggctatataggacctagataattaaagaggtaagaggggaggatagtggagtaagaagtgcaagtcatatggtcaggcaataattagtagtcaagtctcagagtagttcctgaattacctaagagggagaattttttttcccttgctctagaaacttcattgatttatttatagatacaattttttgttttgttatgttttttcccctattctttggtttcctgttttgaaactttttaaaaatgtgcataaatgatgccaacgactttttttgcttttgtttttgagatagcgtctctcaccgttgcccaggctggagtgtagcagtcctcccggctcatcctcctgagtagctaggactacaggtgcatgccaccatgcctggctaatttttaactttttaatagagatatggtctcattatgttgcccaaatttgtcttgaacacctgggctcaagctgtcctcttgcctaagcctcccaaagtgtttgaattacaggtgagagccaccatatccagcctatttaattttcctgtggagtcttttcccattcagcaatggcagttgcaaaaggggacctgaggatcaggtagttgtttgtttcaacaaagtgatctgcaaaattatttagttagttagttagagacagggtctccctctgtcacccaggctggagtgctgtggcatgatcatggctcactgctgccttgacttcccgggctccagcgatcctcccacttcagcctctcaagtagctggggccacaggcgtgtgctaccatgcccagctattttttgtatttttggtagagaaggggtttcaccatgttgcccaggctgatctctaactcctgagctcaagcaatccactcacgttggcctcccaaagtgctgggattacaggcgtgagccaccatgcctggcctacaaaattaacttttaaaaagccgctatattggtgtactacatcattgactactttgtgttcacctttctgtcgtttttgtgacaggccatcctctatctgtggtgttgtttgttgtttcttggttttaattgttcctcatcatacttatttatttatttttgagatggagtttcgctcttgttgcccaggctagagtgcaatggcgcgatcttggctcaccgcaacctccgcctcccaggttcaagtgattctcctgcctcagcttcctgagtagctgggattacaggcatgtgccaccactcctggctaattttgtatttttagtagagacggggtttctccatgttggtcaggctggtctcaaactcccaacctctgctgatctgcccgcctcagtttcccaaagtgctgggattacaggtgtgagccactgtgcccggcatcatacttctttatacttttccatttctaaattcatactctttcaatgaatgattctaattgctcttggtcattttaagtttcatttcatttttctatgacattaactacattttggtattaaccaaactttctgctgtatgcagacctaactactagagccttgatactttgatccaggtccttgctaaacatgtttaatatttttgacaataagactgtattctccctgcatgtacatatccttttttatttttatttattttttcttttttagatatgaatatctcttgatttgtatatttagctagtaatatagctaagacccttttctgtgtgtgtgtgtgtgtaagacaagaatctcgttctgttacccaggctggaattcagtggcgtgaacacagcttactgcagtctcgacctcagggctcaagtgatcctcctgcctcagcctcctcctgagtggctagcaccacaggtgtaccctaccatgcctgcctactttttaatttttatttctttgtagaaacagggccttgccatgttgcccaggctggtcttggactcttgggctcaagctatcctcccaccctggcctcccaaagtgctgggattacagatgtaatcccagtctagttaagactcttataaaagtatttttggggttgtaattaaatgtatcttgtcttctgaccgagagcttgatctgacccatcatttggtactgtggtaataggtaaagatgaaacatacaaattaaaccagaatgtcactgttctttctgtgttattttgattatttcaaagaatgtattttgttgagctttaggattcttaggaaacccttgtgaaacactgtattgtaagtttatgaatcatgttgtcatgtaagatataactcaagacttgataaaagttcagattattccattcgtttctcaccggaaataaaaatttgcctaccacatctgttgcccaggctggaatgcagtggcgcgatctcggctcactgcaagctccgactgccaggttcacgccattctcctgcctcagcctcccaagtagctgggactaaaggtgcccaccaccatgcctggctgatttttttgtatcgtttttagtagagacggggtttcacagtgttagccaggatggtctcgatctcctgacctcgtgatccgcccatctcggcctctcaaattgctgggattacaggtgtgagccaccgcgcccggccacaccttgttttttacagcattactgaaatctgataattaccgactactgaactgagtgtcaaaagacaaggatataaaatgaactaaaatgtacccaccacatcgttaatagtggaaaataatatgggcaaaatattgggagacctttgttagattggcatttttattatttatttatttatttatttattttttgagacagagtttcgctcttgttgcccaggctggagtgcagtggtgccatctcacctcactgcaacctctgcctcctgggttcaagcaattctcctgcctcagcctcccgagtagttgtgactacaggtgtccacagcctttggaaggctaaggcgggtggatcacctgaggtcaggagttcaagaccagcctggccaacatggtgaaactctgtctctactaaaaatataaaaattagccaggtgtggtggcaggtgcttgttgtatgtactacaggcacatacaaccttgcctggctaatttttagtattttttgggcaaaacgcccaacagggttttgccatgttgcttaggttggtcttggactcctgagctcaagtgatcctccatcctcagcctcccaaagtgctgggattacaggcataagcctccatgcctggcctccttccttttgaaggataaataatattccactgtatgtatataacacattttgttcattcatccatgggtgggcgtttgggttacttctaccttttggctattgtaaataatgctgctatgaacctgggtgtatgaatatctctttgagaccctgctttaattcttttttgttttgttttttcttgagacggagtctcgctctgtcacccaggctggagtgcagtagcgcgatctcggctcactgcaagctccacctcctgggttcaccccattctcctgccttagcctcctgagtagctgggactacaggtgcctgccaccacgtccggctaatttttttgtatttttagtagagacggggtttcaccgtgttagccaggatggtctcgatctcctgacctcgtgatctgcccgcctctgcctcccaaagtgctaggattacaggtgtgagccaaccacgcccggccgagaccccgctttaatgcttttgggcatatacccaaaagtggaattgctagatcatatggtaattctatttttgatttttgaggaagcgccatcctaatgggtgttatatatctcatgttggtaaagtatatttttttaaaaagaaaaatattacttaaaaaaatctttattttggccttggcaacagagcaagactccgtctcaaaaaaaaaaactttattttaatggaaacaaactatatttggccaggtttagcacatagtaaatatgtgaagtgctccagtatatttcttgagattgaagatgtgcatatagatgttgacacgtttaaggattcagcaaatttgtaatcagaccatattaatttcagtggttctcttaattaaagggtgaatcaagtgttatgtattattttgctaaaccgaacacattattttcgttagattagaagcagaatgtcagtgtagttgcagcagagcggaggcattgagtaaatgtgttgaataaataaatgaataaataccttatgaaggatttggaacccagggattcttatcattttctggacagtaaccggttttagggatgataaaacttttccccaaatgtctgtatacatacaaaactttgcacgtgaaaagtttagggaatttcacctgaataacaattgtattaaccagcagttaagttttatccaccacattaaacataagctccctcctcctgataaccttaaaaaaggtattttcagctctaatattctgaatgtaatgttggggaaaaaaaacctcccaggaggtgttattaatacaaggattcataaccagaattacatcaccagatattggaatgagcagtattaaatcagtcagattaccaatgagaaaagtcaataccaacttgtaaggactgaaatatttatgttaacatggttctttttatagatttctcacttaaaaattttctcactcacttaattactcaaagaacatcttcagttactaactggagaaactgaaaatgaaagaagaaatgggtgagagtggaatcctcccacctcagcctccccagcagctgggactacaggcacaggccaccttgtgtggctaatttttaaaaaaattttctttagagacactgggtttcaccatgttcccctggctggtctggaactcctgggctcaagtgatcctcccaccttggcctctcacagtgctgggattacagagataaggcaccacaccaagccctgagtcagattttaataaattcagtttccattagagtggaaaattttcaaattaatgaattatttatttatatattttttgagacagagtcttgctctgtcgcccagtctggagtgcagtggcatgatgttggctcactgcagcctctgcctcgtgggttcaagcaattctcctccttcagcctccccagtagctgggattataaccttgcatcaccacccccagctaaattttttttttttttgtattttagtagagatggggtttcaccatgttggccaggctggtctcgaactcctcacctcaagtgatccacccaccttggcctcccagagtgctgggattacaggcgtgagccccagtgccttaccagaatggaaatatttaagtaaacaaaatatttctaaatgtaaactaatggcctacttatttagcaatttcagttcagttcttaggagtttaatatttcatctatattttaattaaccacagatattaggctttctcaaagataacattttgtcctaattttagtttctcaaatcgttattaaggttatgatggcaacccagcttgtgaagtaatagatgataataatatagtcaggaaatatcatttggtaaccaaggcttcagcaaagtattaagatttttgtgtttgtgagtgttataggtaacactgttggcccccaacattgtcattttgtacactttgttgatcagtggcctgaattcattaaaattcacactacatgcctcaaaaagaatattggatcccagcctaggttgttgagtatattcctgtcctttattaaaatgtaggttgatagaaaggtggtagggatatttaaatctatcatgctaatttactttctttgtatcacagcaaggatagggaattaggaaaagattactcactcaatagagaaaaggtagatagaaaatccagtattatcttgacaaagcagtgaatgttttagtatgattgaggataggtaatctagtgctaaagttggtcacagaatttcctgcacaaaatgaaagatctgtgtatgggaatgctagagaatttgacttctcagaaatatatagaccaacagtggttgccttttttcattttcacttctcttcattcttagatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacggtaatgacctgacagagttaggatttaccacttattttcagttcacggtcagtgtcttattgcccatacctcccctcgttctctagccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtaggggtcatgtgaaaatactctcacaatatgctcttaattatagctttgtttgacagggatttacccctagggcaaggaactgtttacagcagtggttctcaactggggatgattccctactgcccaactcccaggggatctggtaatgtccggagacatttttattgtcacacacatgggggagtgctattggcatctagtgggggtagaggccagggatgttgtcaaacatcctacagtgcatagtgggacaaacccccacaacaaacagttgtctgtcccaaagtgtcaacaatgccaatgtcgacaaattcttatttagataatctgtcactgaatctgaaagaattggatcaagagaagaggaatccaaatatatagaaatatagggagatgaatggagaggaatactagaccaattatggaaattgactaaataatgtgaattggttctgagtataagtattggcctgacatgagttcttatctgtttggtacttctagtgcgtgagtttgaacaagttaattaacttctcttgagccttagtcttctcatctgtaacatgaagataataccagcgtatcctgccttatagaattgaatagactctgagctaaaaagtaaagtgtttagcactatactttttagttcagcacccagtaaatatgttttttgtagaaggaatgccttcctggggaggggatgttaacataatgcttagcggtaggaaccaggcctcttccattttaatttcatcccaaatgcatatttgtgaggaaggactgaacccctaacaaatctcttatctgaaggctccaattttccaatattaagttagctaatttaggtctaggcacaatggctcattcctgtaatctcaacactttgggaggccaaggcgtgaggatcacctgaggcgaggagttcaagactggcctgggcaacatagaccctatccctatagaaagtaaagtaattaaaacattagctggcatggtgtcacgcacctatattcccagctacaattgaaggctgagctgggaggatcacttgagcctgggagttcagtgggagaaacagtgagttatgattacacaactacactctggcctgggtgacagcaagatcccatctcttaaaaaaaaaaaaaaaaaaaagttgatttatctcttagaagacattaatgtcaaaaagaatttgcggagttggtctaagagccagtttgatctataagacattttaagtccaaggctacttctgtcacaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcaggtctcttggaagggaatgaggtgggatgggtttgtcagaagcagccattccttttcagcatattccttccagtcattggggttctgtctgtaatcttatttagtttatggtttgtgtaagtcctccagaccctgaaggtgtactttcagaagtgcattgtgtgggaagaatacaggctgtactcccaaataactgagtttttttttttaaaagctccctccctcttagaatagcaaagtatgtctgtctctgagccacagtgaaagttaaagtactctgaaaggaggataatcttaggagaaaaggaacctaaactcttaggtcagtgttttattctgttctacccaagtctcctgcactgcttgccttccagtggtaaaacaggaaaccaagtctttactcagagaggaattacaattgttctgtagtatgaattatggatttccatgctacctgcctcccttaaaactcttgaaggaagctctaatgatagaattaggggagggtaataaaatagacattttgaaatcatttggaatttgaactgttggatctacatctggagcaccatcttgattctccctttttattttcccagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcaggtacctgtctgctcagaaaactcgtctcaacttacggacttatgtttgatagggcagccatacacgttaagaaagcagagcataattcagcaatcttgtcttgcttattgggaatggagggggatagataagcttttaagggaataggaaaaatcaaatggaaaagagggactcgggccatgaatctcagagttaaagtagggaagatgaccaaataccactttatgcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcaggtaatgcaattcagttatgtaggtatggacagatacagtacaagagtgaatactgaatgggagataaaatcctgggttttcctagccccactattaaatgtatgactgatttagtctttttttctttttttgagagagtctcactgtgttgcttaggctggagtgcagtagtgtgatctcagctcactgcaacctccacctcccaggttcaagcaattctcctgcctcagcctcctgagtagctgggattacaggcacgtgccaccagcccagctaattttttctttttgtatttttagtagagactggatttcaccatgttagccaggatggtctctatctcctgaccttgtgatccactcacctcgagctcctaaagtgctgggattacaggcgtgagctaccatgcccagccagtctttttttctactgagtcctaatgcctgtttacaatgcaaattttaccccgaatatatatttaactctacatttgttctttgagaaaggtaaggttgttgagcatagttttatcttttcgttcttagatccaccatgcttttggtggtgtgcatgtaaatgttcactgagcgtctactgaaaaagtgtttatagtgtttttaacacatcacatattttgaagggaaaaaaaatatgggcatacaaatagttgtttaactcatttctttctagggccatggagttggggagagaatgtctaaatctctgggggtaagtagtggttgtgttgctttcttttgagggtaatactgttacagtgagatacatgttctcttctcccagactattctgtgattccttgcttctataaatggtactacccctaaactgtaaaagtttggctaaaattctagttcttttttatgccccacaggtatgaacgggtagatgaaattatttgggtgaagacaaatcaactgcaacgcatcattcggacaggccgtacaggtcactggttgaaccatgggaaggaacactgcttggtgagcagcagtggggcccaattcaataggtggagcacaaagaagaatcatttgatttcttactgagaaaaagttcaaaggtgtggtttcataaggtaatctgttatctgtggtgagcaggttggtgtcaaaggaaatccccaaggcttcaaccagggtctggattgtgatgtgatcgtagctgaggtatgtgcttcccaggcctccaaagcttccacatttttgttggtatcagttattcatgttgggtgtattctcatcccagatttttctcatttagatcataaacataatagaaagggctagaattgcaatcttgtgtaacttaaaaagcagctagtttttatttcctaggttcgttccaccagtcataaaccagatgaaatctatggcatgattgaaagactatctcctggcactcgcaagattgagttatttggacgaccacacaatgtgcaacccaactggtaaggtgaccagagaacaggctagtcctcaaggggctattatttatgattaaggacagaacttagtagagcttcacattgttttacactagtccataaatgagcttcacaggattcataagccacttaagcttgtatttaaactgttttatgagattctacaaatattcattagaaactcaacaggttctaggacccaaaagcactgctccctagggtttctactctcttcacaacccaaggatcttcctcagccattctgtgatgtattgaatctgccccctggtggttacgaagttatctatttaatctgtcaataattacatctttcaccccttaacagagcttaaaacacatgctgctagcattttgcttatccaaagaatactccctggtagcaactctgtgaagcaggcctggctaagcattagttactaaccctcagataatacagatccagtctattttaacaccagaatctatgccaattctgaactagtaattctaccatatactattctaatgttaagctctttttagaattggcatatttgatatgatgataggcagtcttcatttggtatgcattttttaacaatattaaaccctctaattccaggatttctggtttgcccctccttttacactgtttcaggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttgggattctgaagtccattctggctctgctacttaacagtgtataatcttgtgcaactcatctctcagtattatatgtgaaatgggagtattacctcattgggttgctgtgaaggttcaaactaaatgagtgcatgggaaacattaaaatgatcattataggctaggcacagtggctcacacctgtaatccgagcactttgggaagccgaggtaggagggtaactgtagcccaggagttcaagactagactgggcaacatagtgagaccccatctctactgctaccctccaaaaccattaaaaaaacaggaatgcaggctgggtgcggtggctcatgcctgtaatcccagcactttgggaggtcaaggcgggcggatcatgaggtcaggagttcgagaccagcctggccaacatggtgaaaccctgtctctactaaaaataccacaaattagctgggcgtagtggcgggcgcctgtaatcctagctactcgggaggctgatgcaggagaatcgcttgaacccgggaggcagaggtttcagtgagctgaggtcgcaccactgcactccagcctgggtgacagagcgagactctgtctcaaaaaaaaaaaacaaaaaacacagaaaacaggaatgcataggataaaactatgtacgtagctggttgaggaggaggttctctaggacagcattcctgtctacaaacagtaaaaatttgagttttatttaaagttatcaccacttggactatcatgctgtaaacttctgcttattctgttacaaccaggtggcttctctagtctgtttttctttagattatgtctaagaaataatgatagacctatggtcttttaaagatagttcatcaaacacaagtgaatacaactttagactttggtggaacctcttactaatgatgtagagttccgcctcttagattcatgaactgtgataactcagataaggatggtaactgcagaaataatatatataaagagaaatcactcctgggtgatgtcattttccatgtagcccagtatgcccatgttgaaaagttttgttttcaaagcagtgtactgatgtgataatggggaataacatttttttatgagggaaccctttaaaatggatgcacacagtggcattttctcctaggctcaaagctgagtacactcccgtaattttaataatattttaggcaagtcctatgacaattataccaacaagtttcttcaaccccaccaccaccccaccatctctatgctttgcttgcccagactcccttcaccctttcctctgctattaccgcttatggttgaaagtaaaaagcatctccagattacagcaaattcagtggccctgctccatagcctggcctctgctgaaggaagaaaaggggtgaaacatgaacagccatcatgggttgtgatgaggcactaccagaagcccagcttgtgtttcaaaaacaggctcttggacactttcccagcagataactcttcactggcttggagaacaggaaggactatttcacaaacaccactgtgtttgaatttctagaggctacccaggccaagaatacatccctaagagagaaaaagacatacacaaacagaattatacacaaactgaaatagaattacagcctagatacatttttttttttgagacggacctcatgggttcacgccattctcctgccttagcctcccgagtagctgggactacaggtgcccaccaccatgcccggccaattttttgtatttttagtggggacagggtttcactgtgttagccaggatggtcttgatctcctgaccccgtgaatcgcccgctttggcctcccaaagtgctgggattacaagcgtgagccaccgcgcccggccgc

SEQ ID NO: 16706 - DNA, 9608 bp, Human
ctcccaggacccgggagcggagagctcaaaatcggctcctccctccccctctttcccggatcaggaccgggacccgggcgccccgcgcccagtaggttgccgctcacttgctcacgccctactccgcctcctccttgggcgggcgtctccctccagatcctaaggctcagcgccgccccaagggggccggggtgggagggaggggggcgcctcgagcagaggctgcgtgggcggaggatgtgcgtcacggggagcgtgggctgggggagggagggggcacgtggaaacccggggccagcggctggcagcccgggatccaaaataacctgaggtggggggggaggggtcgcccacaccccgtacggggtcgggagcgtccccaggggagcccgtctagccgcaccctccagttgcggggcgggggactgggagacgggactctgctcgttcccaccacccccactgtgtttggcgcttaataggttggagaagaggacctgagcaactgaaatcctcccaccaacaacgcgctccttctccccggaccccacaaggcggaaaggtctcctcgctaggccacattgtaaaaccagccccggtccacggcctccacgccccgccatgccccaccccagcccctcagaagtgcggacagagaggcggggcggggctgagattccggactaggggaaacctcacctgtggccagtccgctcgctttccccggcccccaccccccctcctttccctggggcttagagtctatgggccgggcccttagagcccccgcctcccccaacagccctcccagccgtgggcgggagtgcaatgcgaaccagatggggctaggagaaaccaaagggggagacggtggtgggttgcagaggcgggggctaagctccttcaaggcgctcctccttccagctccgccgcaggaagtcacgtcgtaggctcccgacctcttactcatcttccactagactctcgggcgaggtccctaatagacggccccaggaagggtatcgtctttgtcacacaaaattcccaggcagggcctcatcctcagcaaacagaggacaagtggaggaatccctgcctgacctacgcgctgacaaaagccgacgcgtctaatcaacacgcgcacctaagtggtggcgtgcagcataaccctcccattcctgtttcccaaactttccaggctagcatggaggcctgggtttctgagagcgaccccctcagattattccattggggctgaggaggggcgcggggatatctaggagatccctgcagagccccacgctctcaggcccgccttaagtgcacactatacgggagtcagatgcacgcacaggagaagccgcacagcccagccttcgctaacttttcccggctcactgctaacattcacacgtccagcaccacaaggcctgagtatgggcaacgggcgtccccgtagttgtttaggcgcgtgtgcacgtccgtgcgcttctgtgtctttgtgtacttgtgcgtggttgtgaaactcctctctcagctcggaggggtgggggagagaaggaatgtcgccggcggggcgctcacgtgggtacgtgggcgccaagagggccggctgtgcatccggcgtgggcggcacagaacgacctcgccccgcccgctgggtccccaagcccgccctgcacagccgggcctcggtcacctcggtccccaattcggcgccccggctctgaatccccgcccccgcctcctgctccacaccccctccccccccgtctccgcctctcccagtctctaagccgcggcgtctccgcggccgagaggccccagcgcccgcctccccggcccccgcccccacccccgcccccggctctgcccacgccctccgcccgccagcccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagttagtgggcaaagggaggcagcggggagtggagatgggtggagctggacttgggaatggggtccagagggcggaggtcgaggggaggacgtggggaagcaggacgggggtggggggtggagactgatggaaaagggggtgcgtcttcgaattagggggccctgggagcaggcaagcatctgatgaagctggatatgaaagagtagtacccaaatctccattcctggtttactctgtgggctccatctggcctaagagccccctgcaaagaatgtgggagcctccaagcaccaggggatgccctggagctcgagctggcatcagtgcggaaggtggggggacgctcagttgcctcagtccctcgttggcacggagcgcgcgggcccccggtgcctttgagttaaaggagcatcagcgggggaaagggggggtgacgagggaggcagggaggccttaggcgttccttcccatatctgtccctttattcacagagcggggaggggagtttcagtgtgcagccccttcatcaagaggccttgagccgctcccccactccacttgaagatgcgggtggaaaatatgggagaggagagtaggcgggagcccctgggcggttttcgcctacagacgctaccactgtgggagtgtgtgtgggcggaacggccccggagcagaacaattgcgcccctccccctgccacggcccctgagctgaaggaaaaggctgaccgaggaagtggggagtgtcactgctaggagaggggccactgaggagcactgggcagcctggaagggtggagaggttctgaggggagagaggaagcgtgcgttaagaatgcttaaccaggccgggcgggcccggtggctcaggcctgtaatcccagcactttgggaggctgaggcgggtggatcacgaggtcaggaattcgagcccagcctgaccaacatggtgaaaccccgtttctactaaaaatacaaaaattagccgggcatggtggcgggcgcctgtaatctcagctactcaggaggctgaggcaggagaatcgcttgaacccgggaggcggaggttgcagtgacagcgccactgcactccagcctgggtgacagagcgagactccgtctcaaataaataaataaataaataaataaataaatgcttaacccctgggaaaagctgagcggagaagagtaaggcaccacctggctcactgagtgggaaagccagggaaggtgccacaccctcccttttagccacctggggctgtggccccttcacagggaatgaagctggccagcagcgtccactgtgggggagactgggctcctacattcactttagtatgggtgacttcacttcagtgttgagactgctgagtgtttagaggggaaggtgaggattgtgttttgggggagagggaggtccagccatcccaggtcggtgctggtcagcctcagcgctcaagttcttcttgccccagaccaaaaagataaaagctgaagataaggttgtaagacgcttcgactcctacagacacaggccactgacttttggggcttcgggccagtctaggacggcactggcttgtccatgcctctgagcagtgcctgattctgagagtctgtactcagacctgggcactgggcaggatagcatccaaatgagggaggggaagaaaagcaggcaggaaagagggaacaattgttagtgtgggttggtacccagtagggggacttgcaccgactgcctctctcttgtgcccctccttctcaggcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgaggtgagaacccccaggcctcctaggattgcccttgacttccaggtctccagccgcttacctctgcgagtttctacagtctccgactatctttcattatctcttgaccaggaccccaggccctgatcccctccccaacaggcccctaccccagcggccgcagtgcttccatcctcagctgagggggaagcagagatacaggcagcaccgagctgttcagctccttgtcactcaggaccccacaggagaggaggaggccccgggcattcctaggaagctgtgggtgctgacctctgtcttcccacctcagaaagctcccatgtagtgtcaaaaccaaagcaagcgtctgatggatgggcctcatttgtccaatggtgaaggggtgtgaggaggtctggtgaggcagcggggaagttcgaattctgactctcctggctgccctccctccacagctcaccatcaacgaggctgctgcccagttctgcatgagggacaacacgctcttattacggagagtggagctcttctctttgtcccgccaagtagcccgagagagcacctacttgtcctccttgaagggctccaggtgagaccccttccccaggtccttcctggactggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactctttctcggccagcttcttggcaaaggttttaaataacacatgcctctggctgggttctgtgctctgccagtcgagtggccctcgtcagcctcatccactttattcttacccatcttttcaggcttcaccctgaagaactgggaggccctccactgaagaagctgaaacaagaggtatgttttccggggtgcatataggggcactgggcagccttccccaatcccctcccttggcaggtcttcatttccccatgttgggcatccacaggttggagaacagagtcaccctgaaatccagcagcctcccccaggccctgagtcctatgtacccccataccgccccagcctggaggaggacagcgccagcctgtctggggagagtctggatggacatttgcagggtgagtgtgcctcagaacacttttctcttcattgagggtgggggagtaggggagggggttgggggaggagtgagccaggaggcagtgcctgaaacagggttgggagacctggctggagggggggcagaagggcctgtgggctggctatgtggttgagggtgggggttccattggctgcagccccttacctgaccagtgcccatgcccacagctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcaggtgaggcagccagcagtgctgtccccaagcaccccggccactcaggccccacacagcaattctggtgtcctggggccaggtgggaggaagagggatatagtcgtcagagagggcagtaggatggctgggctccagccagccaggccttggggtgcagagaggcagaccctgccgagctgctcccaccatggaaagtctggtcctagtgtagatctgtgaaaggggaactggggaatggggggacagagaaaagaggatgaaggagcaggaaggaggagcatcaataagggaagctcagatggcacttccaccaacccaggagtggggagcaggctaggagttgtgggtatggggatggggatgcccagcttggaagcagaggagcccaaagcagtgatgctttgtgtgtggaagggggaagagggagtgggcaggcggagggccgggcagccgctgggctgagagtgacgcagcagacaaagccaccaaccctggcttggtatttttaaactgtgcgtgggtgggaagtgggggcggggactggaaggggggctcttcttgagggaggagctcggaggctggcttcctgttctccctctgatttggctaccaaaaaacttggggggccatggtagagtggcctgggaggggcctgggagggggccagggatgagtgggggtggcagagcttgggaaggggggaggggagaggtcagagccaaaccacccccgcagctcctgacagaaccagaaattccagcgcaaccgaggaggcgggagagaaagagagagagacagacagagacagagctacgcacagccagggaggggagggggctcacacacatgggaatggaaccccccatacacatgcagtgggcaggaggcagtaattcaataaacctaaactgagcccatcttcacagctttctttgcccctgcttctgttcccaaccacctctgtctgcagccagtcaccctgcagtctcctaactgcccccttttccctgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttaggatctatgacccctgccttgagagggagaatgggataggggagtgaagggaagctggcggtggatggggcaacagaaaagatgcagcaggcagggccctctcatacactggagggccacatggccaggcctggacccagactctcaccctggctcccaggcagcattggaggtgtggagccatacgtagatgtcacagccacttggacccacttgggcacagtcagactccaaattcagagtatttgggggttagcatatgtcagagaggccagcacacttgctgctgtcttctgtgcagtgtctcaccctcccaaatttgtgttgtcacgtaggcaaaagcagatagacacatgttctatgtggtcatgcaactaaggtgccagctatacatttaacatatcctaggtacatacacgttcacacagctatacacgaagaatctcagcccttgtacttttgcatagtctcatacacgtatcagaagcctccacctggctaacaggaatttggggctttgggagattttttaatcagggcaaaacctgtactagtaaccacatgtccagacccctcctatgctcccacccagggtcccttgagctgcttcccattcccctagggctgagacccaatatcctctatccctggcctctagtgtaaatgtgtctgtatgttcctgcctatccgtcctaggccctgggtcagaatgggcggagaagccttccatgccctaacctgtgctcttacccagcccccctcctgctcagccccatcaccctcagagagctctgtatgtgtgtgtgcgtgcgtgtgcgcgctgcaggtgcaggcatgttggggtgtgtctcagagcctgaacttcccttccagtcagtgctggaaggaggtgggcaggggaatgatagaaaggaaggagtggattggctccacccactgtgcattctcctgttagtcttttcctcctgacccaggagtaggtggggataggagggcaccctccccatctgctgcttggcagggcatgagcaagtgtccagagcaggtctgtgggggtagtagaagagctgtctctttgggttctccctccagctgggatcaccaactggggttggcccttaggtccatgtgggacattgagatcccagattgcccatagtgggagggctgcaggaggggctgtgcccccaaggaccctccccccgactccccttgcccctccaggagaagcttagtgaggtcctgttca

SEQ ID NO: 16707 - DNA, 25559 bp, Human
tataatttgccagttttaagtgtacaaatttgctgagttttgacaaatggagacagttgtataaccactaccacaatcaggatatagaccatttctgtaaccccaaaaagttccctcttgccccttccatggtctagaaatgttaatgggggaaaaaggaaggtgatttaggagtcaaagtagaggaagactaatacgctctggttgcttcagttttgcctagaaagcaggagattagaaaatcccagctgacttggatgtgtatttcatatcttgttaatttaggctgacccactggctccagtttgcctgggactttcctagttttaacactcaaattcccatgtccagagaaccccactgtgtcccacaggcggatcagtacagttggttgccctagctgtgatgttcatgtcattgttcttacacctgagagtgccatctcattttagagtcacttttctcgtgagtaagcacatagtaggcactcagttgactgaatgggtggacatgcaggtaaaccccagatggctgcagattcctggcctagagaacatgagacttgggttttggtgccagctctgccaggtttgcagtggtgtgaccctggaaaagtggttttctcactctagatctgtttcctccactggtaaataggtgatatttgtcacttctgcctctaggacatggatactgctccacctacacatagcattatgttttgatgtcacttccactcagctttctctcttttccttgcccccctccaccttcaaatatatgtagtagatcaataaattatgtaaaggcaggttgataatagaactgctgatgtgccaggcttacgcagagtgcttctgtgagagccatagagtttggaccttgcaccaagcagccatagctgagagttggagaatcaagtctctcttcagttaagtgtctataattacctaatttgttctttctgcatgcctgggagagaggatggtaggcagagggggcttgctgtttttaggaattttcctggctggatgaaggggtacttcttatctatcagagggagctattacattagctcagggtcttactcagtatcctagtgctgacgaattaaaattagaaacttcagaacttgggctgcaacttttggcaaacttagggagctgcattctgttcctggttctgccatgcactagcatggaactgtgggcacattgtgtaacctctctgagtctggtgtttgttcctagttttccattttaatggagtatctgtattgccttcctcggggtggtgctattcagtgaggcaatgcaagggggagttcaatgaaactgggacatctatacacatgtgaggtattattactaatcactttaatctttgggtctctatgatagggtctgattcatgggggaagggaagtggagaagaatttggggattttgtctgcttagctctccaagtaatctcattaacatcccctgactcccgataagataggaagagtaggtatgagggaggtactgtttttttgctaggaagacactctttgtaaagacgtgtctcgccatgttgcctaggctggtctcgaactcctgggctcaagtgatcctcccgccttggcctcccaaagtgctgggagtataggcatgagcaaccgcacttggccctacctgtccttgacaaaattcctgacttctctttgggaaatattttccttggctataaattccattcttccagctttcatttccaaatttgggagacaatggagcaagaaccctcctttagttaagcctctcagctaacgccagccagataccctttcctacctagagggagcttgagtgtctccctctggggcttcaggcctgtgaagggttaagtgagccacaccctcagcaggaacagtctggactttgtgctgatcagccatctccggcctctcctggtttgactggcacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggtgagtcctgccttgacctgtcactgcttctctttaacaccttggggcgccccatctggggcctcttgcctttttcccttccccaccctcaaccagtcacattcccactcccttcaaatccaaatccaaagaagatgactgctcccaacccaccttctgcttctcacccttccctgccaagttagttaaaagacttagctttttgtaaaatctagaaaatacaaaaatagtatctacttcatggggatattgtaagcactaaatgaattagtgtatgtacagtgcttagagccctgcccagttcgtggtaaacgctgcatgattcctagagactgctattattgatattcttattgcttcctcagttgtgtccttctggtaagtgacaagtgctctcttttcctagagcttggggaaagccaagtgaagggagaaggaagcctgtgccccttcttgccccacttccgttcctccttcctccgctcctccacccgggttcagagatgcaatagcataggaggatgtgtctctttcattcctgttcaggagtggccttgaccattgtactaataatcctgtcctgtgcctggccactctgcctactcagtctcacaggaaagactgaggagggccaggtttcctccttagggaacacctgccatgtgcctactgcatgggggccaagccccaccaccctccctgtagttccaactgtgctcctccttgcccactcccgcaagaagctaggtgtgtccctctggggcaaagtccatgccagaagtttacaggagtgggtgtaaaagctagagatggaaaaatagagacagacatgtagcacatccagaggtcctgacaactgcctgtttgttggggaagcaaaccccactttcattttctttgggaaattccaatctcttatggaggaatcctgcctctatcctctataattctgccttgtcaagttcccattttaaaaatgaagctcactgtagcaatgacagggaaggagagacctttggaagaacttctgaaatggttatgggtaggttgggtgtctttaataggggctgtgagaggtaaggtgttgagaagaagcactgggggtagatggggagtctggaccctggccagggcccattgtaggagagagagggctttctgtacctggcggcagcacaagtctttgcttacactttcctcctcagccctctctccttcagtcacaactctgctcccccagttgtagcccactgggtgcctgccttcccctggtggtcagaggaaggtgttcctgttccacccctgccccacccccaccaactgtaacccaggcagcagaggatctcccccacctcctgctgagagtttcagcctccctattagcttgggctggtccagaggcctctcctaggttgggggctctctttagggccagggtaggaagagaggaaggctcttttggtccttctgccatcctcccctcaaacagttactggcccctaaagctgagtggacatcagcaaactgtgcctcttattcccaggatcagtggcccctctggacatgcctctcctggaaggttctgtgggggtggaggatcttgtcctcctggaacccttggtggaggagtcactgctcaagaatcttcagcttcgctatgaaaacaaggagatttatgtgagtgtcatatgggtgcctctggctgtggatatgtggctggagaggtcacaggctcccacctcaccctcaagctcattcccttcaccttcttcctggctccagacctacattgggaatgtggtgatctcagtgaatccctatcaacagcttcccatctatgggccagagttcattgccaaatatcaagactatactttctatgagctgaagccccatatgtgagtagggggaccaagggaaggctgacagggccccagcttcttgacactgagtcatcctaatttcctttgtcccttcccctgaaggggcttctccagctgccccttccttccctggccttctggaggccccttccaaggcctgtcacatcttgcccagtctgctccaagtagagagagtggatgaacctgcgtgctggagattgagtgaaagatggtgtcttgaactggtttcacaatagtcattgcccacttcctccccacaagctacgcattggcaaatgtggcgtaccagtcactgagggacagggaccgagaccagtgtatcctcatcacaggcgagagtggatcagggaagactggtgaggcccctggctgggggaacacatggagtcacctctggaactgcttccttgtctctttgcaagccagacctagacctgaccctccaccccacagaacttcctttccactttttctgactccaaggggtggtgaggcactggggtgaagcaagttaaggaggtggggggatgggctagtcctgggtggggacccatgagagcgttttgcctgcacagaggccagcaagctggtgatgtcttatgtggctgccgtctgtgggaaaggagagcaggtgaactctgtgaaggagcagctgctacagtctaacccagtgctggagggtgagaattctgctctctgccctctccaccctccatctaacccccagaatcactgagccctagaccctcttccccagtgctgcaaaatcacctctcttgttcgacccagaaaaatctgagattgtcatgaggactggaagcccttcctcctttcccttctctagagtttcacttctcccctcctcatctctgtagcttttggcaatgccaagaccattcgcaacaacaattcctcccgatttgtgagtaaatgtctccccacctgggaagagaggatgtgggggcttaagagggaggaatgtggcacagaccccttccaggcagggtggtgagaagaggaagaagctaagtctctctctctggtctctctctgaagggaaaatacatggatattgaatttgacttcaagggatcccccctcggtggtgtcatcacaaactgtacgtgtctccccaattccactcacctgtcttccacctgcctcccatggccctttctgctaatctgttcctgtagaaaggcagaatgttagacgtcaaggagacttcccaaccactaggaatgccggcgatgggggcattctccagtagggctggagaagctacggcatctcccaggccctcaggatattatttttctaattctctgccagatctgcttgagaaatcccgattagtgaagcagctcaaaggagaaaggaacttccacatcttctatcagctgctggctggagcagatgaacagctgctgagtatgtgcctgcatggggaaagtgtcctcatgagtgacacatggcaaagtccccaacctccattcagtcccagaacccctgttccctctgggcccctacagccctcttcccttgagcctcccagattttccttgctgcatttcccattctcagcctcacccactcattgttgggaacaaattcctttacccctgtgttctcttccttttctggggttttattgccagggatatgccttcttgcctcttcactgttctcgttcctctttcctgcctgggttctgctttccctgagctggcttcaaatataaaacacttatatccatctactttccttcctaccttcaacttaaggggatttaattaaagcagggaagcaggcagaatgttgtaagtgttcaggaactttcagtgaactctagttgaagctgtcctgggtctacatctgccttacctaggaccctgttcctgattttcttttcattcattcattcactcattcatttattcattcattcaacatctcttgaacacctatgatcaaatattatgctagcctctagggatacagagttgagtaagacatgaccctgtcctcgaagaacttatagtcttctagggataagaggtgtgtgagcagatccattgtaatattgtgtgatcggggccatcaggcctgtgcagctggctataagagcagaagacctagagccccttggcttggcctggggaagggtccatcacagcctggatgctggactggcctgaagtggctctgggtgggcatcactggagtgtctggtggactttaagccctactggagtttgcctcccaatctcctctctggctgtgagcaccgtgggtgtctggcccctaagaatgtctctttggtttctggtgattctatgatagacctgtgctatctccttttccactcttggagatctctgtgatcttcaggaacccctgcagatctcatgctctttcctggcttaatagttttggttatgttcaacttgtctgcatcatgggcattagtgtcttgttctggttggtctgtcatctattggtttaaatcaactctagatgaggtctcccaggtatcatcatccccagacattctgactcattctccctccagataccctccttagcaggcccttgtttcaaactttgtgtgctgggggagctgccattagactatagtttgagggatactccctgattctcagatcatttgcataccagataattgacatccctcaaactccatgattaaccgaatccctcccatcctagggaaacagctttgatcattcacttgattcatttattaaaaagagaaaatttcctgcatgccagaaaggcacacagaatatggagatgagaaacacagtcccaacccacaagttgctcatttatgggagagacagaaaaaaacaaaacctagcccatatgatatgggctgggatatagattcaccagtggggaatgcaagacagccatttggctcaggccctcagcatcagagaaaacttttcagaagaggtgtcagggtcagggaacatgctacctgccactttattggtgtttggtgttcaaacaatgaatgagcaacccacgccaagagttgaggctgggggcaggcaggagatatgcgcttacccttctccccttaccttcaccgtccagaggcacctgcgtaggatggaagggttgcttgtttatttttattgtttagaaccctgagggtagggagaagagtaaaatgagggttttgtttcataaaagttgggggaaaacccaatcaatatgagcatcaaaaccctaaacactacttaaaagtatacttaaaaatttagtctgttaggccgagtgactcatgcctgtaatcccagcactttgagaggccgaggcgggtggattgcttgagtgcaggagtcaagaccagcctggccaacatagagaaaccccatctctactaaaaataccaaaattagccaggcgtggtggcatgcacccatagtcccagctacacaggaggctgaggcatgagaatcacttgaacctgggaggtggtgcttgcagtgagctgagatcgcaccactgccctccagcctgtgtgacagagtgagaccctgtctcaacaacaacaaaaattagtctatcatcacaggaattaatgatcccaaaacaaaggaggcaggggaagaacccaaaacaaaaatgactcctttggataagtgaatgaatccattagggcaagggctgtgaggtgtcaaggctggagggctccagagagcctgggtactaaccatcttccccaacactggccctcccagaggccctgaagcttgagcgggatacaactggctatgcctatctgaatcatgaagtatccagagtggatggcatggacgacgcctccagcttcagggctgtacaggtgggtgcccagggtgaggcaggcttgggcccttaggtcatcctctattcgcattggactggcaccaacagttcagcttttgatttctgctttctgcctaagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtctgcatcccagcctgctggagctcctacccagaccctgaatttcctactacaagtcgtgtccttctaccatctctagcataattgatctcaccctgatgcagtcccactcagcccactcctgagttctcccctaaacagactcactgagaactcccgatgaagcatattggaatgagcttttgaaatttgatatatctaggtctggaaattctctgagtctgagttgattcttctgcagaatggggataatcacacctaattcaggagattctcatattaaagtagatgatacatgcaaaatgcccagatcccctttcttctgtcccccaactccctgagattcctccagggccatgttctgggttggctgcaatgacttctccagtgagaccccaggacaccagtgtctcaggcagtttcacttatcagattgcactccctcccctgagagaaagctgcctctaaggacatgctgtactttctcattatcccaggtgttcgggagattggggagatggtgggcttgaattcagaagaagtagagagagctttgtgctcgaggaccatggaaacagccaaggaaaaggtggtcactgcactgaatgttatgcaggtaaggagctcactggagtggagggggctgtttcgaccctgttctgtgatgccaccctaatcagctgtgcctcacccacaggctcagtatgctcgggacgccctggctaagaacatctacagccgcctctttgactggatagtgaatcgaatcaatgagagcatcaaggcaagtggccgctctgctttctccatgctctcctgtctgcctcaccttcctgccctgtcaccagccctatatcttggtttctgagatgagcagagtagggaggatgatggggagggtacagttccttctaacagtgtgttgtcatggaaacatcactggcttttgagttagacaatctggatatatcatctacttacttaattcaaagtcatgtggactttcaattaagtaaaaagtcatgtggactttcaatttcacaaaggttctgggcctcagtgtcctgatttggaaatgcccactaagaaacactaatatgctgggtgtggtggtccatgcctgtaatcccaggactttgggaggctgaggtgggaggatcacttgagctcagtagttcaagaccagtctgggcaatatagtgagaccccaactctatattttatgaaaaaaaataagttaaataaaaaactatttaagaaacactaatgcattcctacctgcttcacagggtttaataaggatcagataaattatgtaaatagttaccatatgataccacaattcccactcctaggtatatacccaagagaactgaaattagatgtcctcactaaaatttgtgcacaaatgttcacagaagccttatttgtaatagccaaaaagtagaaacagcccaaatgtccatcaactgatgaagagataaacaaaatgtggtatatctgtacaaaagaatgttatttgtccataaaaagaatgaagtactgatacatgcttcaagattgatgagcctggaaaacattatgctgagtgaaagaaggtagtcacaaaagaccacattttgtttgattccattcatatgaaatgtccacaataggcaaattcatagagatgggaagtagatcaatgaatgccaagggctggggggagaggggtatggggagtgactaataatgggtataggatttcttttgtggggtggtgaaaatgttctgaaattagatagtggtgatggttgtacaaccttttgaatatactaaaaagccactgaattgtacatggtatgtgaattatattcagtaaagctgttattaacaaattatccacatggaagtgccatctatttagaagctattactgaaaggtagtagaataagaaggaatttgagtctaggcttggtaagtacctatccttctgaaatttgactttgttatctgtaaaatgggaacaataataccttataaggttatgataaataaagacatggaatcttttgtaaaatgctctacaaatataagagatggttattgtcctgagaggttttattgtctttctacctggtaccatcggagcaccatcctggaatctatctgtatcttccttttcctcctttcctccctctttgcttgttctctagtgtgtggaggagggagagtaaaatcacaacaattcctttccagtttggcaaagctcttgctagttctgtttgccccctactccaaccccatccgctccagaaggacctggcctggtgtgcagagggggcctgtcctcagatttatctttctctcctcttcaggtgggcatcggggaaaagaagaaggtaatgggagtccttgatatctacggttttgagatattagaggtgagagtgcctcacctcagcaccctgctcccctaggattagaggtggacaggctcacaggggggatgtgagggaggggaggtaggactgagacggagaaacagtcttggagtgagctctctaacctgtgctccctctctcaggataatagctttgagcaatttgtgatcaactactgcaatgagaagctgcagcaggtgttcatagagatgaccctgaaagaagagcaagaggaatataagagagaagtaaaccaagtcttttctacttccccctcttaaacaacttctaggcatatgccagagcttcctttctccttgatcacaatttcctctacatcgtccccagatgtgaacacagaggacaaaatgtttcccttgcatagtagatcattccagcattaccaagtagccctaatcctctgctctccattcttcatttccctggcctcccagggtacatgtgtggaaagtcctgacaagagggaagtgacagctgtgcttggcctatggcagactgtgagccaaatataaaaaggacatttcttctgggtttggcccaaccacatctctttctatgcccttctctaacatctcagagtccttggtctcccccgggccctagctagagttgctgtcctttcttgtaacaccatgatcccagacttcctcaccagaagtaccccatggctccaatttctatggctaagtgttagaaaagctctctgattgagctcattaccttcaaagtgtgaatggctgagagtctcactcatcaaaaccctcccagggatgttcccttgtgagctctcaggaataggttataacagaatttcaggcaatgtggtcacaatgtgtgaaaaagtttttttagttgttttgtatgttttaattttaacgatttaaatgatcagatacataatacattcccatgcttcaaaattcaaaaagcttagaaagtatataaggaaagtttccctcctacttctgcccctagcctcctagttctcctccccacccagaggcaaccaacatgggcttccttccagaagtccttacgcatatgcaagcaaatttgtaaatatatttccccacaaaatctatacaaatggcagtaaatacactctgttctgtaccttattgtcatcacgtaacgagatctttccatgtcagtatgtaaggatgcttttttacagcaacacagtattttaagaatatcataattcctttaactggttggggaaggtatttgggggatgaagtgggaggcaacttaatttaattttgttttctttaaagacctgtgatagagggaggaaagaaagacctatgcttcccagccatacctgagaatgtcccagcctggagcgtctgacccttgggtgggatcaggagctatcctgtctgtaggcctgatgcccagcaagtccccaaagtagagaacgattatctttgggtcttctgcttttgtaccattcttgcttttcaaaacattatatagtctcaaagtctcatgtagataaagtggttcctaaagggtagtcctggaccagcagtatcaaaatcacctggaaacatgttggaaatgcagattccaggcccacatcccagacctgttgaatcagaaacttggggagtgggacccagaaatctgtattttaacagccctccaggtggttgtgctgcacactcaaatttgagaatcactgatgtagatctttgaagatgtatcaaattagccttgttgtttgatgataaactctcacgtgctgtggttttatagagcacagagtagtgtggccgctgttgcacatacgcatggatccttccccactcccacacaggaaatctctatcctaatcttcactcaacatgttacacttccctctccaccctacaccacctacagggatctctgcattgtctcaccctctctcacagctgctccaattccttccgtgtgtctgtctacccaccccacaaattctccaccaaccttggagggatggggacataaatagaaatcataccaaggacccctgtgaactatggggctttctgatgtcctttgttgggtgggtgaaaggctagatctggtgaggtctctggaggcttgtcttggacgtgttccctgtaatttgttgtctcccctgaccagggcataccgtggacaaaggtggactactttgataatggcatcatttgtaagctcattgagcatgtgagttgtcattctcttatctgtgggacttccccttccagactgcctgaacatccttcccctgtctctctccctgattccccacttggtagggacagtaaagagggcagaagataagagtggagaaagggggcagcaatgagaacgtggacatctcggaggaccagatttaggttgggcttcttttgttcccccggcccagaatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgaaatggcagggctggagggcagagattagggctcaggcccagactgaagtcaatgggggaggaacccggggaaggtgagagtctggaatacttcacaatgagactgggagggccaagtgctgggacaaggttgtggggtctccaaaccaatagctgctcctttacaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgacatgctggcatgcaggggaacatgctacatatgtgatggcacgtgcagggtccatgcgctgtagaacacgtccatgtgggggtgcttctggaataaggatgtcagaggtcctttcctcacagaaaacagtcagataaggagctgagagtcccacagggggagagcatcagattcgatagggaatacatagaagtgagtgaaactggggaggccagtgtgtctactttctttgaaacttttcagtgaagtgcaccgtgtgcagcataggggaatatgatgggttacactggcaatgatgtcagctcctgaaggctgtgccttaccccacctcccaccaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccggtaagaccccatggggagactgggcatcaggaaagggcagtgcaggaaacatctctgggggaagagacctggaggtgcagtgcacatctgctgaagctgggtgaatggatactttgagaaatgaattgaatgatcacttcttggaggctgaaaggattaggggaaaggtggaagaggactttctcctgagatacccctctgcagctttctgtcatttgcttccatagggaaggtgttgagaaggtcctgggggagctgagcatgtcctcgggggagctggcctttggcaagacaaagatcttcattagaagccccaagactgtgagttagagagtgcattagcatttggtgagggtagaaggtggaagagcccacctgagaaaggctggagggggagggagcgtgtataacctggaatggatcactgtccagtggatgggaagcttcctgtctgcaggaaccgtatccctgggaattgaactcttgggttcctacactgccctgagcctggggagcttggtgctgcatggctctaagtgcctttgcctgaggcagagcccttgagggttggggtgatcaacttctagcttactgcctgctacaaagttagagttaagtagatacttgtttactgaatgaataaatgagcaaactaagaagacaaaggaatgatcaaataaggcctggctgggaagcctcagtactgtggggtataggagaggacagcactgttcccctgagccagtctctctgtcacccccttccacctctccacagcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatggtacggtcatccccaaagtcccactctgttcactctaatagggaagatggaaggtggctcaggaggtgccatttttctaacaactcctatgttttctacagcaaaagaaatgctatgggaagataaaggcatccgtgttattgatccaggcttttgtgagagggtggaaggtaatggagagtggaagagaggtttcctcacattgtttctcctggattgtgtcacctgctggctagagcagcagagagctagtcctgcctgcacccaggccgcacctctgtgtatcagccggtccatgtgtgggtgggtgtctgggagtgagaggcctgtaggggagacctgtagaggtgtctgggtgggtagatgcctaacttggcagcagaactttgccttctgctctaagtgtcctcactgccaacttgtctgattttacttccaacttccagctacagtctcagctctttatcttactcaggtctttgcgtggttgaaaaatagtacaacctcttctagaatctgcctatcttcactttggctcctttcttgtacttttctgccaggcccgaaagaattatcgcaaatatttccggtcagaggctgccctcaccttggcagatttcatctacaagagcatggtaagtggtaggggttagggtggatgttagggatggagcagggaggcacaggtttgggagaggggtttgagaagaggcaacccaaagctttcccccaagagtttcctcagtctgcatgtacttaagtcctaggagaagagggcagctacctgcagggaccaggccccagtgccttggactcgggggcagaatcagatagcattttggcatgagtggacaatccaggcaaccttgtggcaggaaggggtctcagcacacccaccatctggtctatggtcaaatagccttgtgaagatcctggggctggatgtttaacaactgttgaagaggctaagcctcattgaagagtagagtgatccacacattaactagctcaacctcccaagatccattttagggttggggtgagagtaggcgaattgtatcttccttctacttcctctgaaactattgtcagcaagtcagaaagtaaatctcaggaaggacctatcctaattctggaggacgtgggtcaggctggatgggaagacccacctggaaggcctacatattcaaacttacagacagctcccagggggagaaaaacagggacagagaagagtaacttctggagacttcagtcagatagcaatagtgcttctgagaagtgtcagggaggaaaccagggagggagaagcacttccaatgaaaccttgggaaaggccagagagaaggaggaagagcatgggatcttggacagaggctggagcaaattggtaattgacctccgctgattgggtttttgaccatagttaggaccctgactgtgctcattcagacataagacatgtttgcttgcagcccctctttgttgtttgagagtctggatccctcagctcaagagaggaatgggggctctgaagctctggacctcttttttgccttcctgagccttcatttgctcgtcctcttccccttcccagggaagttccatcttccaggtctcttcagttgcctgatcacctcttgtgctggtgccagagtgtctgccttcccaccatacatgcttcttgctacacacctgagacctgtaatctgattttgctgttatctcctgactgcccttcttcttccttttctttcatctgtgtattgtcaggcagctactaattgtcaacccagaagctgctgggtttagaccagggtctcaataaatcacacccccacagaagcctgcgggcactgggcactgattcccccagtgtttctgagtattccagtttgccactgccttgactgtaactaatgctagtatccattctcatttttttaatttttatttatttatttatttattttttgagacagagtttcactcttgtcacccaggctggagtacaatggcgcgatctcagctcactgcaacctccgcctcccaggttcaagtgattatcctgcctcagcctcctgagctgggattacaggcatgcgccaccatgcccagctaatttttgtatttttagtagagacagagtttcaccatgttggccaggctggtcttgaactcctgacctcaagtgacccgcccatctcggcctcccaaagtgctaggattacaggtgtgagccactgcgcccagcctatttcttttttgagatggaatcttgctctctcgcccaggctggaatgcagcaagcatgatctcggctcactgcaacctccatctcccgggctcaagccatccttcagcctcggccttcccagtagctgagaccacaggcacatgccaccacgcctggctaattttttatatttttggtaaagatgtggtttcaccatgttgcccaggctggtctcaaactcctgagctcaagtgattcactcgccttggcctcccaaagtgctaggattacaggtgtgagccactgcacccggccttacccattatcttttgaacatctactatgcattaagctctttacatgcattaactctaatactttcaataaccctgtgaggtaggctcttttctttctcccattttgtagttaaaaagccaaggctcagagaggttaaataacttgccgggggttccacagctgtaagtggtaaagctgggttacaaactatttgactctagagcttttaaccactgcctaagactgcccctcatcaatagaggcttgggcaacccatggccctaggcagacctgggggcaggagggctgcataggaaagggcagaactttctagttctagaacaaacaataaaaagaagaaagccttcagaggctccacattaattggaacaaaggggattatgacagatgcttaggcatgtttgttgaattattaataaataaaatcagactagggactggggactccagtcttggaggccttcacaggcccagatcccaaacccaccaaacccactagacctgcagtggaagctacaatgagcttggatagttcctgcagttaacagcaatatactatgtattctgcctctttctatttaaattttttaacctgatatcttagtaaaactttttcataaaaattccagacatttggaagtgccaaaaatcaagtcattttttatatcttcagtaattctgtgccataaacaaacaggttgctaggtgctctatgggatgtaaaaccttggccaggcaaggtgactcactcctgtaatcctagcactttgggaggctgaggcgggaatattgcttgagcccaggaatttgtgaccagtctgggcaacatagtgagacctagactctacaaaaaaaatttaaaaattaggtgggtgtggtggctcatacctgtagtcccagctacttggaaggctgaggtgggaggatcgcttgagcccaggaggcgggcaaggctgcagtgagctgtgatggtggcactgcactccagcctgggcgacagagcaaaaccctgtctcaaaaaaagaggcaaaaacaaaaacttaagaatccttgttctagattggggcagactaaagagtcagttgccatggatgaagcttgattggatcctggaaaaggaaaaataaagcttcaaaggacatgtttagaagtttataaaggacatgtagagaaatctgagagtggatcgctgttggatgagtgatgttgattttcttaggtgtggtgatggagttatgattgtgtaagagaatgttccagttcttgggagaggcatgctgacattttagggtaaaatgtcatgatatctataacctactttaggatggtagggtagcaaggatttgtgtaaatgtgtatatgcatgtatttatatgcacacatatgtgtgtgtgtcagagcacacagatagtgcaaggtgttaacattatcagttggtgcatttagatgaggaacatacagtatacagatgttaattgtatcttttttcaacttttctgtaagttaaaaaaactttcaaaataataagctatattgaatttttaaaacatcatattatgctattcttctgtataaattctccaatggtgttccatttcactccttaccacagcctacaaggcccatcatgatctgccccgacctactctctgatcctctctcttcctgctcaagtgattctggccaccctttttttttcttcttttttagacagtcttgctctgtcacccaagctggagtgcagtggtgcgatcttggctcactgcaacctccacctcccgggttcaagcgattctcctgtctcaacctctagagtagctgggattacaggcatgcgccaccatgcccagctaatttttgctcaccctggctttttaatgtctctggaatatgctgccactcattcctgcctcagggtctacttctttgcatcacagcagatgccattatctgacatcacactatatatttatttgcttgtgtagttggtccccttctccaccctacagtagaatgtaagtccagtgaaaatgaagactttgttcactgttatgtcccagtacctagaacagttccaggcactaagtagacactcaataaatgttgactagtgaaaaaaaatgtgagacctgggatcctgccttataaggactcagtgtctagaaaagggagctgttttccatgcaaataactgtagtacaaagacgagtgtaggcaaattgctatggggcttcaaagaaaggagaggcaatccggggcttggggaatcagggagggctttgagctgatctcccaggttggcagagttgagtcaagagagcatcgagagctaaggcacacagtgatcatgcatgggctgggtaggggcatgggaaagagtcctgtccgggtggtgtgcccagggaatgcaggggtcctgcgacatgaggctgggctcttaagtgtcagggaggaaacccaggagagaaaagcacttccagtgaaaccctgggaaaggccagagagaaggaggaagagcatgggatcttggacagaggctggagcaaattgtaactgacctccgctgattggatttttgaccgtggttaggaccctgactattgctcattcagacatgagacacatttgcttacagcctctctttgttgttcgagggtctggatccctcagcttaagagaggaatgggggctctgaagctctgggcctcttcattgtctccctgaattcatttgctctttctcctttgctcctttatttgctccttcttcctttgaatggaggctgacatgtttggacttgactgatttgagaggaggggaaatttggtacctagccaacagctgacacagacagtggctgccacctgtaggcaattgtgaacagaaggaatagaaagctacaggagcaaaactttgagaccagctttcatattggttcctcttacctcactgccctgggtagcaggtctttggttggaactaatcgttctctccctccagtctcctattcatgctcttacctcccggcctcaagcctgcacctcttgctgaaaaagatccaagaggtgactcccttccatctcttcagctccaccccttgcttctcactgtgggttaacttcctcctttgaagtggcaggatctgggtgccagtttgcctgtcaggaagtgtttcttatcactccactcccaatccccctggtcccaaactaggtacagaaattcctactggggctgaagaacaatttgccatccacaaacgtcttagacaagacatggccagccgccccctacaagtgcctcagcacagcaaatcaggagctgcagcagctcttctaccagtggaaggcaagtggagcccaggcacccctcctctcatttcgtcttttttttccctccccctgattttcctcttttgcctccctcttctatttttttcccattaaaaaaattgtggtaaaatatacataacatacaatctaccattttaacggtgtttaagtgtatagttcagtggcatgagcgacattcatgttgttctgcagccatcactgccatccatctccatatgcgtttttcatcaccccaaactgaaactctgtacccattaagcaataaccccctattctcccattcccctagcccctgatatcttataatctactttctgtttctatgaatttcacttttccaagtgcctcatataagtgggaatcatatttgtccttttgtgtctggcttatttcacttagcataaagtaatttgttcttttattcaggaaatgcttattgagcacctgtctgggactaagccttgccctgagagctgagcatagagccctcctggtgcttttatttgatggtgtccattccctcccctagcctccctcagttctcgcactcctcctcaatggtcctccagccccggcctctccctgaggtgtctagtgcctgtcctttttcctcagtctctctcctctcctagtgtcttctagtcaatatttctcacctccctccccagccctgccctcccactctatgattttagctcctgtccctccttcctcacagtgcaagaggttccgggatcagctgtccccgaagcaggtagagatcctgagggaaaagctctgtgccagtgaactgttcaagggcaagaaggcttcatatccccagaggtgagggcctcccagaccctgcacagccagttccatcacgcagcagttctcaaacttgagcgtgccttagaatcacctggcaggattgtcacccccaggtgctgtgtccctcctcagagtctctgatccagcaggtcttggggtgaggaccaaaatttgcctttctaacaactccccaggtggtgctgatgtcttggtcctggactgtgctctgtggacactgacagaggatacgtggatgtgggggaagggcccgggaggactaggatgggaactctgggggtggggaagaggcctctgggccttgtcgcgctgcacacctcccatgtgttctcagtgtccccattccattctgtggtgactacattgggctgcaagggaaccccaagctgcagaagctgaaaggcggggaggaggggcctgttctgatggcagaggccgtgaagaaggtcaatcgtggcaatggcaaggtaagggcctgcaggctgaactcctcccgcagctagtgcagagctgtgggctggcatctggagagcagatggcaggctgtgtttgcgccctgccaggtggagtgggggcaattaatcctgcctttcctcacccttgcctgttccgtccctagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgaggtatcagagctgggtggggcaagccttggactggagaaggtggtatgcatcccagggctggggcaggctggaggtgatggggaccagacctttcgctctgggcctttgatgtccctcaggtgctcctgaagagaaaaaatgaatccctttcctgctatttttccctcttcctaagatgtcatcggtgggctccaagggggacttcctgctggtcagcgagcatgtgattgaactgctgaccaaaatgtaccgggctgtgctggatgccacgcagaggcagcttacagtcaccgtgactgagaagtgaggccatgaactgggggtgaggggcggcttacggtagatggccaggctgatggtcatcgtgaccaggatcagaaagcgaagcatgtagggcagtgcaggccggggcttggaggtgtttctcaggcccccacccaggttctctggggcctcaagtcctctgactcgcatgatgggggggccatcatggaaatgcgggagtcggggtgaggggatgggcactagacttggttttctgttccctctccaggttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaggacccttgtcccaaacccttcttgttctctcctccaaaagtagcttcctccaacccgcagcctctctgcacactaataaaacatgtggcttggaaaggttcagtcagggtgggtgggtccttgttccccctatcttttcacccaggtgtacttagacccctgcccccatgccctttttcctcctcaagctccttggagccagctagtgaggtaataagaaaggaaaagaaggaaaattgtctccgggctccttgaccggctgagctctgggggggtgtttagagagactgcggtgggtggaggggctgcggggggagttaaggatggggctcaggtcgcaggtggccagtggactgattcattaagtgtgtccctggaggaaagaagtgagcatccctgtcttggcagaaactggggtcctttggcgatttagcctgaaaagcagcccaaggctggagggcttatgtatgctggggtgctggggaatgcagggtctcctgtacttgggaacgccatcaccccttctactcccacacacagcacagggctccatcacaccagcctccccgacacccccttccttctcacacacccgagatgccaaactgctgccaacagttatcttgctcgtctctgtcccacagctggggcctgcagcaggtggcacttcacatcactcacttgatgaggctccctcatcaagaccctcccatccctgtaacctggccctttcctctcctcttcctttatttttcctgcgtcattgtcattatctttttctcaccctcccaactatctcacaccatctcattgtccctgtttctgtgagctctgactaatatcaatatgtaatattttgtaaaatgctttaaatattttcctactccccctcatatctattttctcatagattctgtcttgtctgtcttgtctctaccttctgtctggcctctacctttggggaacaagctgctcatgtagtcacagtaaaatttagatctgtggtctgtgagagcttagcagggtctgcctttgtttttgtctctggctgtctcttcctcttctcaagatctctaccttgcctacctcttcccgcttccttcccttaactcactatgccttggggctggggtctccctccacctgacttccatctgcaggcagctcacggccggctatcatgctggccagggagaactgattaacttctcttcctgcctgcagattaatctgctgtctgagcacaagccacgtgcttctggcacaccctgctttgagctgagatagaacctggggaatcatctgttttcaggcgggtgaggggctagagcctgccttgtttgggaggagggtggctctgttcagaataggggtagctcaggctctggccagccttctcccgcccccaacagctccccccatccttgacttctcagaatcaggccgagaagagcctatctggccgagagtggggtggtgacctgcgcctcatcgcccccgctctccatctcatctcctgctcccagggcccaaattgtcgtcactttcccagtgaagtgtctggtcattttcagaagcaatttcaggagaacatgcagctgccgctccctatcctgcatttcccttcacagggctgaaggcactgtcagctccctgggctgggggtgatgggagaggggaagggctagggccctcacccctgtcctcactgtgcccatcatgtagatggactggagttcaaggaagggcaggcactcccctcctcctttactcttctgtcactctcttcctcctcttctttcctgtctctgcctctcttttctggagcctaggagtgtgtgttttcatcccctgaaacaaatagggactcagtttccccacctgtgttacagggttggaattggctccatcactgtgggagaagctggagttctgctaccagtcctcccctccccagccctgcctcttctctcccagccctctcccttcagccagttcagcgctctgagagtctgggttgtttcagcctctgaggggcacaagccatcctggattcccctaaccccatgaggagccattctagcatctcacagcttaaacca

SEQ ID NO: 16708 - DNA, 10502 bp, Human
tggctcactgaaacctccgccccctgggttcaagccattctcctgccttagcctcctgagtagctgggattacaggggtgtgccaccacgcccagctaatttttgtatttttagtacagacagggtttcaccttgttggtcaggctggtctcaaattcctgaccttgtgatccacctgcctcggcctcccaaagtgctaggattacaggcgtgagccactgtgcccggccttttttttttttttttttttttaggaagttgtattttgggctttttaactagcttgttttttaattagattattgcctttagggtggagccctttaataaaaagggggaagaaaacataggttttagggcctcatatttaaatgggtaaagcaggcatagctggaaggcagaatacagaacccccctaatcaaggatctcatttttatattgaatcctaggccccccaaaagagggaaatgtcatgggacgagatgtgtggcatttttatcgagtgccccactgtaaagatgctcccccaaggctggcaggcagcccagtgccgattagcccactctgtgcttagtcttttttttttttttttttttgaggtggagtcttgctctgttgcccaggctggagtgcaatggcgtgatctcggctcaatgcaatctctgtctcgtgggttcaagcgattctcctgcctcagcctcccaagtagctgagattacaggcaccagccactatgctcagctaattttttgtatttttagtagagatggggtttcaacatgttggccaggctggtctcgaacttctgaccccaagtgatccgcccgcctcggcctcccaaagtgctgggattacaggcgtgagccaccatgcctggcgtgcttagcctatttttaatgggagtttcatcctcaatggtgagtgctttcattgtctttaggtgccccagaccatgtttttaaaaatttaaatgcacgaagaaataagtagccctgtatagtagtaatactttgttgtgaataactgtcataagtcatctctaaaactgtattttttatctagttattatatatgactagctatatgtctagttttttaaataatacaaagtaatttatttttggcatcctcaaaaaccaaagagattaggtaatgtagtgtagaagagagcagagctttagacctgagaagaatctgcccatgactcgtgaaactccacaacgaaagtaggagaccccaaaaaaggggtgagtgtcatcttttctgaatttttttttttttttagatggagtcttgctctgccaccaggctggagtgcagtggtgcaatctcggctcagcctcccgagtagctaggattacaggcacgcgccaccatgaccagctaatttttgtatttttagtagagacagcgtttcaccatgttggccaggatggtctcgatctcttgacctcgtgatccgcccgcctcggcctcccaaagtgctgggattacaagcgtgagccactgcactcggccggtcagataatttttttggccagtttttacatagagtaattttaggttttatggctggctttggggcaaaggggttctggtttttatagctggtcttgggggagaatggaaccgagtgacaagaggacaagagagggtcagagaaaaacttctgcttctgaggcggctattgaggccttcattttggagtattgtcctctaagccccagcagtgtcaaactgtacacaaaccatacacagcagccagctcgggtgctgttaggaaatggtctcactgctgggtctgtggggtatgtgtgtgtctgggtgtgtggctactgtctgcatcctcctcccccctacagcctccccgcctcccctccagccaccctgggattggtgactctcagcccctcccctcagctcccctagaccctcccagagcctttatcagggagctgggactgagtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggtaggcaagtgggagaatgctggatggaccagagctggcaccaggggacaggagccagcgtcaggagggaataaagcagatggcagcctctgataggggagcaggggactgggaaggtgagcacaaagcacctgtagggccgagagctggttggtgtttggagcctgtggctacagactcattctttcataccagaaagtttttgcctaagtcttgggattatctagtactggaaaatagcatccaggatccctcctccagctgactgaggaaacagaccagtccatgtcctacaaatctatcatctttcttgggagctagagtcctcctggcaccactatagcattgcacatctcctggggagatatctgatggggtagcagggaaactaagcccaagggctgtacccccttctcagaaatactttccaccctctctccagaccagggcttggacagtggagttgggggctggggaagcagggtcaagccaagctgctggtaatgaatgtctcttgtgtcttcacccatgctgtatcttcctcttctctcctttacctgagtcctgtccctttgctctcccaggcaccatgaggatcatgctgctattcacagccatcctggccttcagcctagctcagagctttggggctgtctgtaaggagccacaggaggaggtggttcctggcgggggccgcagcaaggtaagtctcccctggcagagtactggggacatcacgggaacttgggactctgcctgtctggacagctgtagtgaggaaactggggtgggggggttgtccgtcagagggcattttgcctccctttggatttctttgtttctctggtcctttcatgttcccactgtctccaggtgtgtttgtgtctctgtatctctgcatgtctttgacaccttgtacataaaaggtgccctacaaatatgttgtttggtgggttgattgatgggagacttggtgattggatggtactgtgaggggtgagctagggtggtctaaggctctctatagtctacctcaggtccctttgcaagggacagatctcttctatttcctggatggtatgaaacagtcagaatttctttcccaaatggttatttgtgtgctattttacctatcagttatgtgtattgttttattttcaaaatgcaaataaattcccttatcttttgctcatccacccccagtaacctcaggtgcttctaagatcccaaccccttccttcttctcttttctcccttgcccgcctctatcctctgcttagtcaggataggaaaacaacaacagcaaaaaaaccagattgagcctcgatttccacagttcctttacgaaaaagaataggaattgtcagggtaggggtacagggggaggatagggaggaagtcttttcaaggttttgaaatgacagcaattacatcggtacaaatgcttttaagatgattgcgggtgggacttattacaaattcaatgtgtgaagtttaactgcctcttcagctcaaatctgttcagcatctcattataggaggtgggcagagtattcaacaatttgggaaaagtggctgcctgaacaccacatgctgggccaagggagttatcaccagggcagccttgcaggtggcagcagttgtgccatatccaaaaggccagaaccgttaaaaaaaaaaacacccaggggagtgccaagtatgggctggacaccgtttggagccacaaagttccagcccaggatagttagagtatctgagttcttctgagacaaacttgtttcaagaccttggccaatgagatgtcccctctgcccctcttggtcaatgaatgagagggattgccatcctaccccttctccttgagagtctgtgaggatgagggaaattggggcaggaagagggtagtacataggtgtgcctaggcaactgggttggtatgtgtgggggtgtgttctgtgtaaatgcacttctgtgtgtgcacaacagccgaaggatgcctgggttctggaaagagaggcgctgctgagacttgagatttgagatgaaaatctccagccatgatcattgttattgtctctctgcagctgcaattaactggctgtgtggtgtgtgcccaccaccctgctgtacgcaagttgctaaaaaaaaaaaaaaaatcacagggacaatcaagagcccgtgctgggcaacagctctagaacttgggattcagttgtggagagaagaagacgtgccttctgagcatgttgccttcctggaattctagacctagggccaaaagggagagggagagaaaactagaggcggaaagccatggagaatagagaaagaggtggtggaaaacagggagagaaacatccatggacatcgtgcagagtgggggaatcacaggtgcagatgtgtgcctccaatctcaccatgcatgtgaatcacctggggggctgcttaaaatgcagattctgtctcaggaggtctggggtaggaacaagagtctgcatttctaacaggctctgtgtagtgctggtgttgctgttggtccacaggtcactcctggagcacctacttctcgtccagtgtgaaccagaggaaactctgaaagaaatagggtgtcggattcaggatgggctcaggaagaggctgtttcttgtgggaaaaggatgagtggatccgggtgggagcctcctgcctcacccctctttgtttcttccctagagggatccagatctctaccagctgctccagagactcttcaaaagccactcatctctggagggattgctcaaagccctgagccaggctagcacaggtaggaggcggccctaggggagaggggaatgaggggcaggattctgaagataagaggcctgggagatcctttcagatgggagagagatgggggatagcttagtgaatcggtgagggttgtgatctgaaccccgctctcatcactttccaacttcactccccatttagacatctgttcttggtttcacagatcctaaggaatcaacatctcccgagaaacgtaagtaccctcttctccctccctatctcttgccacttgcccagagctctgtggggcattgggcccaggggccattttgtccagccccttctcacctggtacaaacaatatgccagctcccactgctcagccaacctttcctgaaagggagaggccatccagaactaggaggaagctggtgtgaggggcatggtgggctctccctctgctggctggtccttggaaaacaaggggatctcttcgtggccctgaaaattccaaatcaggcacctgctagagcagaaaattcttgaaatgtggaggaaggaaaggtgagcagagagagtgggtttaggggaggcacttgctaactgtgaggagtcatgctttgacaagaaaaaggaacagagaccagaaacccagtctcagaagtgttgacccatgtctggggagatgcttcactttctcatcatcactgctgacaatgttggcccttttctgcaggtgacatgcatgacttctttgtgggacttatgggcaagaggagcgtccagccaggtaggagtgtgtggaggtacagtggaagggcttagggtactggcagagtatgacagaagtcacgtgcctcatatttgtcaccagagggaaagacaggacctttcttaccttcagtgagggttcctcggccccttcatcccaatcagcttggatccacaggaaagtcttccctgggaacagaggagcagagacctttataaggtagtcctgttgcagctgggaggaaggatagggagactctgcttccaccccagtctcccaactctgtctttgaacactgcccgtcatagccagccctttgctgttggatcagggtgtagttcacattcagaaagatccctcttacttacactgttcgctttaccctagactctcctacggatgtgaatcaagagaacgtccccagctttggcatcctcaagtatcccccgagagcagaatagggtaaggattgttcattagagaggggagaggggactggggagggggctgtgggggttgccagctgtgcatttcctcccatgctacaggtattaaagctcatagatttgccctgaaatacactgccaatgcccagcacactgtcggccaaacacaaagacacttagaggcacgtgtgtttgtacacatcccccgtctttcatctctttcctctggatcatggacggcagctgactattgagcaggagtgagtgttgggagatgaggagagaggggcttccccgatgggcaatttctgttgtttggacttcattcttttgtaatctatgcaaaaagatggagaaattattatctgataattacaaataccacaaccaattcacaggcaagcatttgcctcccaggcaggctgagcctttcaaatcactcagaatcctgggttacggggcccagaaggtagtcatacacaaggatgattcaggaagaaatgcaaggaactctgaaatctaatggggattagcaggaaaccatatctgaatctctctttagcataatgaataagaacaatggcctgaatgtgaatcctggatctgccactctatctgtatctttttggccaaggtacatatcctcctgtgcttcagtttcctcatctgaaaaatgaaagtgataatagtatctcacagggttgtggttttgaggattgagtataggtaaagtgttcagaacagtgccgggtgcacagtgctgtgtgccaattttatgataattgtcccagtttgggaggtatgggggatgtcctaatgtttcccctgactggctctgtctggaccccaggcctgagtgggctgacaaattcctcacttggtatgcgagtgtaagagtcccccagggaagtgtctagtcaaaacacgaaccttccgccttgacactgtcttcccacacacagcaagagcagctccaccaatggctttcttttcactagcttccaaagaattggggtggagggagtgaaaaggagagggagagagattgggaaggctcgtaatcatggagagcctcctgcttttctctctgtgtccctgttacccatactcactggtctcaaggtggcacgcccaagacccaaggagctggtgcttgatgatgctgcctgtgcatgaattcctgggaccagagactgagtctggccccccatttagtgttgggtgagagggcacaaagagctataataactgtaacttgctgattacatggtagttactgtatcattttgctctcattagatggttatttcagtcctgccgacggccagataattatacgagcagctatatctggatgacatactctgctccagcgttatgcactggccataaagataattacagtgcaattttgctatagtattttatacaaatggcaaaaacaagtgcattgtggaaatctacttttaatgcttgtttgtgcatccaggctctttcagagggacccataattgcagctttcataatcttaccattgagggagcattcccaacctgttaggtgtcaggcagaataggacataaggtttctgggagctggcatttaaagattagatgagatggatcaacacagatcattgtgtcatctgatttcattcatgtgaaactgtaagtaatccctgggcctgtgcttcctctgggaggtttctgggaagaggaggaactggataaggcagggggagcattcatagtagggcaccttgggcagggctgtgtgtgtgtctggctcatggtggtgctaggatggcatgaacttggttcctacatctttggtccacatgggccccactggccatgcacacaggtgtgtagagtaatgtaaatatggcagctgggaaggtgcaagtacctgcggctaggagagttccatcctcaggcccaaagcctggagggcaggctgagggtcaagacttgttctttcctctctcacagacgcctctccccttctctcctgctgccacagcaggttttcagtgggacttttttacaggatataagatgtgatttcagtgtttttttttgttttgttttgttttttgtcctcagtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaatgatgtggtgtgtgtgtttacttgtttggttggtgggtttttctgttccttgactcctccagctacatggtaaatacacacatacttatgatacacacacttcatatttaaatgtaaataactttacatatctttttgtatatatctatttcctgaacagtgccttacacagtgctttgcacgatgagtatcagatttatttagtgattaaaataaatacacgaatttggaagatggtttctaacacacaaagatttttacagaccagttttagataaagaaaaaacaggccgggcccggtggctcacgcctgtaatcccagcactttgggaggccgaggcgggtggatcacgaggtcaggaggtcgagaccagcctgaccaacatggtgaaaccccttctctactaaaaatacaaaaattagccaggcatggtggcgcatgcctgtaattccagctacttgggaggctgaggcaggagaatcgtttgaacccaggaggcaggggttgcagtgagccgagatcacgccactgcactccagcctgggcaacaagagcaaaaaactccgtctcaaaacaaaacaaacaaacaaaaaaaacaataaaaaaagaaaaagaaaaagaaaaaaaatattcagaatgacttgtattactaggatgggtctgggagatattcattcctgaatctgaccctacttaattagagaaggaggtggggatcaaggctgtccggagacccagccacagaggaggacaaatctatgaccctatacaatttttttgtctccaaatgctgagcctgggttctgtgacagatcctggggatgaaatgatgactcatacacagagtttacagtttagcagggctgtggacaagcaaacagaacttgatccagctaggatgggatgtggacagggaagttactaccgaggccaagaaagagaggagcagatatcttcaccgttaactggctgccttagttattataaagggaaaacatttatctcccactcctctctaaagtgcctgttaccagctcctgcagctctgacttaacagtccccagaatgtgtaaggcacttacatgtggtatgcatgggtatggatgtcttttactaatctatgatgtcaactatcacccgccatcctaaggggggttctgtaccctaatggaacagccagtgaaatcctcaggctccttatcttagcgtggtacaggggcctttgttatgcccctgaattgcactgataaaacatcaacacatagatttcccaaggcagtgtaaggacagggccacagagccagaggccacttcctgcagtcctttcattctagtgaaaattctatcttcctacagcctgacttggggccactttggaatgacagctgtatagtggggggcggggaaaggagggaatactcaccctagtattacttatgtcagctttatagccagaggtcaaagaatgcccccaccccagagcctagaccctttttccagtgagtcatctctttgacttttcaaaattatctatctatagggcttaaaactggggacacttttgcagagtctaggggctttctctgggtcatgaaagctacaagagttggttctgctcagacttggtgggagttaggcttataggctgagatgagacaattgctttgcaagtaggaacattaagtgcagaaagattgctctctagtgggactgacaaaaattgcagtactggggactccagaaaaaaatgaagacaaatgttaagttagattcctgtgtttgtacttgaagaatgtgtgaagggatcctgaccctccctttcctgttgtaaaacagttgatgcctaaagagatctggtccacaagaccttgactaaattcctggccctttcttctccatttaactttgtatatgtttgttattgtgactatatggtgatttactttaaaaagacttcagtataagtggtatatactttcacctgcgtcttttggatg

SEQ ID NO: 16709 - DNA, 15722 bp, Human
tggtcaagccaatcgacccagccttgttatgggttggggtggggagaaatgtgtcctcctgatggctggggaagaagaggggttggatatttctagccagggccatgccaggaggctggtcactctgcaaggggatgcagaggaaagcggtgcccactcactccagaggacctttctctcttgggctagagaaaggcctattggaggaacctgagcaggaggggtaaggattctgccttgaggagaaaagagctggggtaagtgggcactggaggaaagaggggcatgaaggtcttggagcagaaacgtccagagaagggacctctccattttccatccctctgagaggcctgggagaggtgagaggctgaacgtgcaacaggaggacttggggttactgggtttggggagacctggggagttgtcatcccatcctctccctcatctctgggagagggatattatgagaaacgtgaactgagaggcccctgggaaaccactggttacccagtcctccctgaacctggaaatggggatgcaaccccctcttctacttccctgtcccctcctctcctttctacctgttttcgtctctcatctttgccttctagccctccagcttcctctctcttctaggctctttcctcctagcttactaaacccgccttttttccagtctcttccatcctcttccttagttctctctactttccttttccacctctcctccttcaagtctcctcccaccttcccccacttcttaggatgatcagatttgcccctggaagggatcctaacaacacagtgcgatggttaatccccactcagattcaaagcctgctttccaaactcacttactgagtggccttgggcagagtagagaaactccttaagcctcagtttcttcatctataaaatgggatattatatattttaaaaagtgtcgtgaggcctgaaggagataatacactgagtgtaatgcctcatacacagtaagtgcttaacaaatagtagctgttattactctcccatcctcttcatcatctagccttgtggttttcatttttattttatttcatttatttatttatttattttgaggcagagtctctctctgtcgcccaggctggagtgcagtggctcgatctctgctcactgcaagctccgccccccaggttcacgccattctgtcacctcagcctccccagtagctgggactacaggcgctcgccaccacgccctgctaattttgtttttgtatttttagtagagatggggtttcactgtgttagccaggatggtcttgatctcctgacctcgtgatctgcccgcctcggcctcccaaagcgctgggattacaggcatgagccactgcgcctggccgagccttgtggttttcaaattatctcatggagtcctagaattttgagaggtttgtctagggatgcctttggcgtcaggaggtggggagagggaagtagaagcagtcgagtttcaggctttccatgcttgctttcaacagggcatcttcggtttcgtaccttttatgtaattgagattccacagattaaaagctgacattgcctaccgctttaaaaagtttggaaagttttccactcatctaacactcatattttatagatgagaagatcgaagcccacaaagggaaggctctttgcccacagaaccagagccaggtctagagctgcaactaaatcctctgccactctaagagagctctcgctctactgccctgtctccctttgcctccccatccctctggctacagctcagctcttcccacccctgtgtctatcactgaaggagttacccccatctcaggcattgactcaggatgcccctggtttaaggtggtctggccatgagtggtggtggggacggtccctaggagggctatctatgggaggtccctggctgccccaggagataggccaagtttcttgggcacccctcagagtggccttatttttctcctccaggcaacctccaagtcccagatcatgtctctgtggggtctggtctccaagatgcccccagaaaaagtgcagcggctctatgtcgactttccccaacacctgcggcatcttctgggtgactggctggagagccagccctggtgagtcctggctgctccctgctggtcccccaagtcttccctaactcatcttccttctccttagatttttctcccctcacccatggattcagaacttgagacctgttattccatgtgtagtgacctagatttagcagggagtctgtgccccatcaagaccaggctatgaatgttgacagatggagaccccatctcttaggaggctgagccgaagaggaggggggtttgggctgggacaaaggcacttctcataacagctagaagactgggaaacaaggcgcatgggtgaaagctacagagggcctagatggagaataaggagcgagaaaggaactgctgagcttttggctgtggggtaaagggtcaggagagctgaggaagccctggcctgaggtagcctcatcctgatcttcctgcagggagttcctggtcggctccgacgccttctgctgcaacttggctagtgccctactttcagacactgtccagcaccttcaggcctcggtgggagagcagggggaggggagcaccatcttgcaacacatcagcacccttgaggtggggcaggaggggaggggacaaggctgggtggggctgaggttgaactgggttgagcattgggccctggaagaaaattggttggatgctggaagcaaattggtgttcctgtggttaactgctagctagcaggcaaattagattttaaaagcatgcaaatgcacaaaaacttctggagtctacagttgtgcttccttatagtatatgtgtgaatgcaggcctggggattggagggattgaaggacatgggtaagagcaaagctcactgtttaccaccctcatttctgtagagcatatatcagagggaccccctgaagctggtggccactttcagacaaatacttcaaggagagaaaaaagctgttatggaacaggtattgtgatattccacctcccaccccaactcaatcccctgagactttggcctgagccatgacaaactagaaagaatttgaacctcagtaaaggctcagtgttctaggcccaggaatgaccaaaggaggttcctagggtcagagtgaaccccaagtcaagctcagggaatctttctatgagggactgaaggtaagaggccggggagaacagagcaagggataaggagctgattctgctaggagcaaggtcttatctccacgatattccaaaaggtcaggaagaactgccaaaggggagaggggaacaagaaaacgctatctgcagagcagagagtggaggccaggtatagagggatgagcagagtgtttcacttcttggcatctgtccttcctgtgtagttccgccacttgccaatgcctttccactggaagcaggaagaactcaagtttaagacaggcttgcggaggctgcagcaccgagtaggggagatccaccttctccgagaagccctgcagaagggggctgaggctggccaaggtgggggccagggtggttctggggagtgtgtaggagtggttgcctcttggatctcaaccttatctgaacctctaatctgtctgcacccttgatttctgcccccaaccctcagtgtctctgcacagcttgatagaaactcctgctaatgggactgggccaagtgaggtgagtaatgggctgacaggtggagaccttggtcaaagtgcagctggagggatggaagctagacctcagaaagacacaggctgaagtagggcaagggaatgccagaggagtgagaaaaagagccgtatcccaggagctgggtgtggaggcagcgtgaggccctggctcaggcccctctctgcccataggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggttgggctagggctgatggggaagagggggcaagctgggggtgggcagctgaccctgctgaaggccctacaggtgagagaaagaagccaggcgggagggccttggagtggaccaagatgcataaaagccagttccagcggggctgtgcacactgtcgttcaggtcgcatcctgtacaagtgggcctagtggaggggcacaagcggggactcatccaacccaggcttctctcctcaagccccatgcctagaggaataggagggcttttccatttggtttattgggtgggaacactttccaatttgccacaaagcactgtaagtggtggcagttgtcctgggtgcaagagccgtcgggggagaggcagctgggtttccacagggggtgtaggcactgagaatgaacctcccacccagaccctaggccaacagatcacagaacccccttcagcccaggtgccttgcagccacacccactacccaccccacttctccacacatgatagcctttctccctgggtataggggaagggggtctgggccggagcaagcagccttaatcctgtgccccctgaccactgtcctggccccaggtgtgaaagcctggtggacatttattcccagctacagcaggaggtaggggcggctggtggggagcttgagcccaagacccgggcatcgctgactggccggctggatgaagtcctgagaaccctcgtcaccaggtattccccgggagctcccagtctggcctagaacagacctcgggaagaaaagaagggggctagagctgtggggagggcaccagcagggacctagcccccaactccccttgtgtcctcctcactcccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcgtaagctgggattggacctggggttggagaagggctgttagggtgatggaggcagcctggagggctggcactgaaaagagcaagggatggggagggagggccatgggatgtggagaccctgaatggtcaaggcagaggaaagggagggacccatttagggctggaatggggtgggggcatcatgatttggccaagatggggactcctcccttaagaacccaaacagagacatggagatttagggctggtgacagtgggtagtctacactcacccatgcactcgccacacctgacgacagtgagatgagctcgttcacactctgacctcccctggcagagaaagcactggagaaatcatcaacaacactgtgcccttggagaacagcattcctgggaactgctgctctgccctgttcaagaacctggtgaggggctttggggtgcagtgaggggggcaccactaggagactgtgggactctccttggagaggatgtcaggaagcccaggaggagcggtctctgtcctcatgacctcgcccttgctctccctcaccccacccacagcttctcaagaagatcaagcggtgtgagcggaagggcactgagtctgtcacagaggagaagtgcgctgtgctcttctctgccagcttcacacttggccccggcaaactccccatccagctccaggtgaaccgtggcccagccctgccccaatctgggaccccgagtcctcctccaatgccacacacaagggccctggaccctcacctcttgtgactgccccataccccatgtgtctgggattcatgcacactggggcccgggtgagtgggggtgagcaagagcatggagtgcacagggcagggaatggtagtggatagcagcaaacacttcggaagcacttcctatagaccagggcactctattaaatgatacatacgcacatgcgtgccagcacacacacgtctggttttcacaataacattatgaggtaggcagtattatcagcctcattttatagataaggacattgagacagagagtttaagtagtttgtcccagtcacacagctaagtgttggagctggtatttgaaacctggaggtctggttccatagcgatgactaataaccacttctctacggtgaggccctgattgagcttcagaacgcatttaataacatggcatgagctttttgattatgatgtgtgagtccaataacttctctgagtgctcagagccagtcccctgaggaaacttcttgcttcactaagaaacccctgtccggctgggcatggtggctcaagcctgtaatcccagcactttgggaggccgaggtgggtagatcacaaggtcaggagttcaagaccagcctggccaatatggtgaaaccccgtctccactaaaaatacaaaaattagctgggcgtggtggtgcaggcctgtagtcccagctgctcgggaggctaagcaggagaatcgcttgaacccaggaggcggaggttgcagtgagccaagattgcgccactgcccttcagcctgggcgacagagcaagactatgtctcaaaaacaaaacaaaacaactcagcactttgggaggccaaggtaggaggatcgcttgagcctgcaagtttaagaccagcctgggctacatagggagatccaatctctacaaaaaataaaaaattggccgggcatggtggctcacgcctgtaatcccagcactttgggaggccaaggcgggcggatcatgaggtcaggaaatcgagaccatcctggctaacacggtgaaacctcgtatctactaaaaatacaaaaaattagccaggcatggtggcgggcgcctgagtcccagctactcgggaggctgaagcaggagaatggcgtgaacctgggagggagagcttgcagtgagccaagatcgcgccactgcactccagcctgagtgacagagcgagactctgtctcaaaaataaataaataaataattagctggattaggtggtacatttctgtagttccagctattcaggaggctgaggtggaaggatcacttgagccctgaaggctgaggctgcagtgagctgagattgcactactgcactccagcctgggcaacagagtgagatacttttttaaaaaaaaaaaaaaaaaaaaaaaaaaaaaaaaaaaaaaaaaaaaaaaaggaaagaaagaaagaaaagaaacccctgtcctcaccctcttcaggccctgtctctgcccctggtggtcatcgtccatggcaaccaagacaacaatgccaaagccactatcctgtgggacaatgccttctctgagatggtgaggaaagtcctggagttggagggaacaggggcagggtgggttctaacatgggcagtggtgcaggcctgctgatggggtggtgggcatgtttaaatgggtgtgaccttaacactttctcatgggcctgctttcgtgcttctgacctcttttcaccccagtcttaacaactatcaggccacagcactgtaacctagaaaaaacagcatgtttgtgagcgatatcaggggctgtggaggggtaggccacaggcaggtgggagggatgaaggccggcccgaggaataacaagacggtagcctgcagtgctctcttcttcccccttctccccaggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggtcattctcctgccctttggacctcccacccccaagctcttcatccctggggcactcagggcctgctcagcctccatgcagggaccttccactggattctccacagtgccccctcaggtcctttaggaaggcctgtcatggaccagggaggaaaaaccccaggcctgggggttggctctggagatgcgttctctgacatccctgaggttttggtctgggggccatctgtccttcctctttaccagtgacttgcatgactcacccaggttgtgtgtaaacagagctctgattcaaagtgactttgacctgttggaaaaatagttcctggccgggcacagcggctcatgcctgtaatcccagtctttgacatgccggggtgggtggatcacctgaggtcaggagtttgagaccagcctggccaacatggtgaaactccatctctactaaaaatacaaaaattagccagttgcggtggcacatgcctgtaatcccagctacatgggaggctgacgcaggagaattgcttgaacccaggaggtggaggttgcagtgagctgagatcataccactgcactcaagcctgggtgacagagcaagactctgtctcaaaaaaaaaaaaaaaaaaaggccaggcatggtggttcatgcctgtaatcccagcactttgggaggccgagacggatagatcacctgaggtcaggagttcgagaccagcctggccaacatggcaaaaccccgtctctactaaaaacaaaaaaatagccaggagtggtcgtttgcgtctgtaatcccagctactcggctgaggcaggaggtgaacccaggaggtagaggctgcagggaagatgaaaccattgcactccagcctgggcaagactctgtatcaaaaaaaaaaaaaaaaaaggctaggtgtggtggctcacacctgtaatcccagcactttgggaggctgaggcgggcggatcacaaggtcaagagatcgagaccatcctgaccaacatggtgaaaccccgtctctactaaaaatacaaaaattacctgggcatggtggcgcatgcctgtagtcccaactactcgggaggctgaggcaggagaatcacttgaacctgggaggcagaggttgcagcgagccaagattgtgccactgcactccagcctgccaacagaatgagattctgtctaaaaaaaaaaagaaagaaagaaagaaagaaaaagaattcctgttgcaaaaactgaacaaaatcccacagggacatgtgcagtaataccagctaccacgtgttgacagcttatatgccaggcgctgtgcttaacaccttatgtatgttatctcacttaatcctcccaacatctctttgaggtagatactattattatccccattttacagatgaggaatctgatgctcagagggttatgtagtttgttcaagttcccaaagcaggtgagtgccatggctaggagagaaccacatatttctgactcttgctcttttattttatgttatattatgttattttatgttttggtttttttttcttttctttctttctttctttctttctttctttctttctttctttctttctttctttctttctttctttctttctttctttctttctttctttctttctttctttctctttctctttctctctttttctttcttttgtgtgagacagaatctttaaagagaagaaagaaatgctcatgtgaccagagggtgtgttagctaaagggagcaagacagtcacacccagcaggttaccttcctttgggcgtcacctctgccacacctccttagggagagggtgtagcatagtagttaagaggggctccagggccagaatgcctgggtttaaatcctagctctgcctcttaccagctatgtagacctgggcaagtcattcgacgtttttggacttccatttcttcatctgtaagatggaattattataatccctacttccatagcctggtaaagagcaaataaatatatggaaaggcttgaaatagtggctggcacgtgtaagcattaggattggtcgttgtcattgatggagtctcaggttcggtctgatcctcagccctgtgattctgtcgtgagggcactcacagctcactgcctgccctaaacaggctccagctctggccctccctcggctcacacctttccccctctccccctaggagatcctgctgggccgtggcttcaccttttggcagtggtttgatggtgtcctggacctcaccaaacgctgtctccggagctactggtctgaccggtgagtccccaccctgggtagtctgagcagccatacaccagtcacctccatactcactgcccatgccccatcctctccttcatcccggccaggctgatcattggcttcatcagcaaacagtacgttactagccttcttctcaatgagcccgacggaacctttctcctccgcttcagcgactcagagattgggggcatcaccattgcccatgtcatccggggccaggatggtgaggccaccccagccagtcctctgtctctgtgcctgtgccctctggggtttcttctgggaatgaaatgtcctgaccttcctgatgccgatcctgatcttcaggaagttcttccagcttctcttcttccttctgtggtctaaatgttcaccttctcactgtgagctctgtgggaacggagactagtgggtctctctccctcaggagccccaccctaggtcctctctcccttgccttggtggagtgagaacaggtcttatggtaggggttggggaaggggaagaaagtccggacagagggatctcagggtctccttcctaccataggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctccctgctccccgctgccctcctctccctgcccgcgtgtcatcctgatgtcactccctatttcatagctgtgcttctcttacttccccatgatccatgcccaccttttccacctcccttcctccctaaccccagagcactccatggctgtcttttccttctcacaacagctgaacagatgggtaaggatggcaggggttatgtcccagctaccatcaagatgaccgtggaaaggtgagtgtggtggtatggacagtgggtaggtcaggggcttagtgcttatctgcaggaaggaggggtggcatcaacccttggtcagtcacatgtacctccttccctcctccagggaccaaccacttcctaccccagagctccagatgcctaccatggtgccttcttatgaccttggaatggcccctgattcctccatgagcatgcagcttggcccagatatggtgtaaggagctggaaagacaggaatgggagtggtctgtgcagatgggctaatcttagcatgggcagctgggagagctggcactgggggctgaacagggaatcttcctttccatgagagggacacctgttcaaaagcagggtgtggtggtgtccaggagaagggctggcatcagggggtctgttttctttccccaggccccaggtgtacccaccacactctcactccatccccccgtatcaaggcctctccccagaagaatcagtcaacgtgttgtcagccttccaggagtaagtgaaaaacctcatggggataccatcccactctaagggggtgggcatttgaattgttagaagaggctcttctgtgagaaaggagcagcaaatgctaacagcctgtcttcttctcttctgtccactctaatgagggggtagtagttaagatctggactgcctaggtttgaattctagctccaccacttactggtttggggcaaattacttagcctttggtgccttatctgcacaatgggggataataatgctaataataataacctacctcactgcattattgtggagattaaatgagttcataacacttaaaaagctgagcatagtgcatggctcatagcaaaagctgtgtaagtccagtcgtggatcacttaatgaaggagcattttctgtctttggcagtttcataattatgcgaataccattgagtataattacacaaacctagatggtatagactactatacactgaggctatattgtgtagcctattgatcctagctttaaacccgagcagcatgatactgttctgaatagtataaggaaatagtaacataatggtaaatatttgtgtgataggaattttcagcttgattataattttttttttttgagacagggtctcactcactggagtgcagtggtgcgatcttagctccctgcaacctccgcctcttgggctcgagcaatcctcctgctgtagtgcaccacgacactcggctaattcttttttaagatttttctgcagacaaggtctcacttactgcccaagctggtctcaaactcctgggcttaagtgatcctcccacctcggcctcccaaagcgttaggattacaggcgtgagtcactctgcctggccttgattataatcttatgggaccactgtggtctgtagttgacagaaatgtcgttaatgtggtgcatgactgttattattattttctgtcctgcccctgagagccactgtcacttctctgctgtattggtttttgtttactcatctgttttggccttgaaatggcctagacatttttcttcccgaagtatgacactcgggtgcttattaacttagtcaagacacaacatctcccttcccagaaggtgaggcgggagtgaggacttggggacttaagaactaccaaagttcagagtccaaagaaacattagaaattggctaatccacccccataacacgcacattttacagatgagaagactgagctcagagcatagaaatagcttgcccaggccatgactaagtcaggataaggagctggagcttgtttcctcactcagtggtcctgactttgcaccactctgcatttgcctagcctgccttcctctaactgtgctctccctacttccaggcctcacctgcagatgccccccagcctgggccagatgagcctgccctttgaccagcctcacccccagtgagtgacaaagcccctcctgaccccatgtgcctcttctttcctggccttgccccgctctccttatttccattgctggttcctggcaggggcctgctgccgtgccagcctcaggagcatgctgtgtccagccctgaccccctgctctgctcagatgtgaccatggtggaagacagctgcctgagccagccagtgacagcgtttcctcagggcacttggtgagtggcagcttgggagtggaggctgggtggcatctaggggagtgggcgccatgcctactccactgcttctcccatctccttgcaggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatgtatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcagataggtgctgcggtccagcccccagctggaggagaccctgagtccaacccaggcctcccgagggggccagtgaagggatcccacacccaccgcccctatgtagggcagggaagaaattgcaaaggacttgggggatagatgggaatgggagggcaaactgcagcacttgttaaattaattaaagaaacaaaccagaagcacaaaaacggggaaggagaggggagaaggagcaggtccagtgttcccaggcccccaattctgggggcaaatgttgccacttttagctggaccttcccagggaagtccccctttcccccttgtccaaactgagtccaactgctcacaccactggtgcaaacctaaagagaatgggagtgtgttgtgtgagggaggggaaaaccccagatgccctggaggcagagtccttgccccctcgctctgggcaggggtgagggcaccacgcaccctccttgtgtcctctctccaggcctctgcttgttattgcttgaagccccacagtcttatgcccatggagcaggtggggaggcaggagaagggcagaggaaggatccagggttgtgactagattccggggatggagagcgtgggggtctgtgtgagccagaagtctgaggtcctgggtctgaagacaccagtccaaccctcactgccggctggcctcagcctccactttcacgctgctcctgcgaccctccaccagcgcgggatggggtcctggggcaggacatctgtccagcagcccttcctcgaactctgcagggaaaagggggcagttaggagactgcagggtgac

SEQ ID NO: 16710 - DNA, 7156 bp, Human
gaggaagggccgcaaggccgctgacatgcagctccgtccaaggagaatttgggttgggaggtgaagaggtggggggacgaggtttcctgggccttgaacgccccacatttaagaaaaggcatcctccacagactagactaacaattccagacccccagtagtccctggctcagaaactcgaggcgtgatttcggcgtggcagcccaggcctgttactgacggctggcgcctagaagccggggtcagggcgttgcgcgcctcctgggctgccctgcggggctcacctctctccccagcatggaggccccaggtcctgggagtgtggctttgatgagggacaggaaaagtcccaacatcaggccaatgcttgacttcacttgcgtcggcgtctcagacggcacactgtcgggtttgagcacccaagatgtacgttctggacagacactattttgtccccatacatggagcgtttcctccgcaccttgggcgcgcctgcgggagctgtgtctttaggtagtttttggccctgcgccgcctttattctactccaagcgcctcttgccaacccgcactccgcaaagagccaagccctccacatccccattctcagcaagtccacgcgtcccgcccagcttcccgcccgcggttccctgtaccagctagggccgtgagaagccaacgcttttccactgacaaatcctgtcatccccagctctagaaggcgtccttaacctgggcccgctctgcctgcccggactcctgaattgtaagcaaaataaaactcctctctgcagtgttctggggaatggagaagaccccaagctttcatcagacctcccaaggagtgcggggacccagagaaatgaggccacccgggcaggatctggccatgtagctggcgctcctgaaactctggcagatttgtctgacttctgtgccctactctactgaccctgggctaaaaatgatcatgatcaccccacttgccctgcccttcccccacgcgcctgaccgagccgcaggggtgccccactggaagtccggcccagaggcctcagagaaatcctggcctagctgggctcagaggagccccgcctccctgagagctaaacctgggctaggaccctgaaacctcgaggttggcagaagcctgagggccttgctgccaggcagggagggcacgggaaggagggaggtgggatcgatggcctccaaacaggggaaacaaggtggctggtagctggggcactccacaagacaggtgtctcctgggaagctgagcttaccagctgggattcctgatttatttcattattaaggggagaggcatttccctgggagggtactggcagtgactgatgccccctggagttgtgctgtgcataacactactgtaggaggcagcaactcctaccccacctggccatcactcaccttgcccttactttcgttgactcgcccagaagcacccagagcctgcggcatgactgaccctgtaggccaagccaaaccaaacccccgaattgtccagaatctcgccctgctgctatccccaaagccagccctgtcctccaggcttctcttcctattcagactctccctcatcccaccaccttcagtaataaagccttcctcaaatcactctcctccccaccgcttcccaccccatccttctctctcccatgctggtttgggtgctgaggaatatttcttcaaacccacacccatccagccctgcccagaggcctgactctgcatgcctctggtaggcttttcaggctcacattagggagcaaacgcaggctgcaggagcaaaaggagacccttccaaatgcgtcgtggccccctttaaaaaagctgggcagggctttttttttttttttttttttttttttttttttttttttttgccgtatgactatattaggtgacacgaaactgctcatcgctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaaggtgaggaggaaacacaggcccccttctcccctcctgggtcgctttcgtccccaagaaactcagggccaggaggaggagacacgcgcccttgggccgagggctgggctgcggcggggggttcagaatgtaagatgcctggtgttgtcgccaggctcccgcgccccgcgtccaatcggaggttcagaggaaatgccggattgaaaggatcagaagcaagagaccaaaaaacgtttccccccggcctaacaaagccccgggcggcttcggctctgctcctgggtctggtaggaagttgagaaatcggtttatggtagacagaacagagagacaagcagataatctctgtttttaaatctcctttggatttacgaatctttttaaagatctgatgagaaccgctaaacagaaattgaaatgttgctcaccagacagcttttgcgtacaatcggaggagggtcctggaccttctttctgcagcccacccacgacccgggtttctggtgcctttctttctttgcgccaggaaagtggagtctgggatcgagggccttgattttaaaatgggatactgcggaccctcaggaatctgacttcactttattttttcagcacaacttgccggcgcggccagggcggagaggttccctcgtggaaaagttaggaaatgctgcgctaccgcgggcacaagggagtggacgagatgagtgcgggatcatcccgcaggccatcccaggatcggggagggaggccggccccgctgcagaaaggggccttctgggagaccccccagcccaaggcaggagcccgggcgattcccgggaggccgcaggcgctgggcgaagcgctgggcgaagggccgctgccagccgggagagaattcataggtttgttgaggagcagaggcctgggaacaaattcgggcgggcacggcggctagaactgatcgctaccaattcgaggaagccagcaaggcaggttccgaggccgcctgcccacccgcagcttcttggacactgcgcaaaccctgctgcggccaggctggagcctccgatcaccaaaccaacactccctggccttctgtttcttgattccttaattttgagataagaccgtccctagcagtgaggcctcggcctctgttcatttaacttctcaaaccaaactagccctaattcagttcaccccagagcatcacctggttttatttttatttttttatttttttatttattttttttttttttgcagcctgaaattttaagtcaccgtctgtctccctcaccagggtgtgaactgccccgagggcagagacctcccgttttgttctccagcgccttgagccagcctgactttctacaaatgctgagtgagacgtgtcggtggctcccagtgcacttggcagagtgagccgcagccagctgggcgctccaggcaggacacagtggcctccacgaggatcccttaccattactgtgcggccgcgctccgtaggtcaagccgctcttaccaagcgtctctctgcctctctgttccccctcagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaccccgcacgtgtgcttctttcagcttgcggcgcttcagaagcaggagagaggtggccgcccgggactggtctcagatctcaggcacaggcattccctgagcaaattgataacattgatactaataaaacctaacccttgctggaaccatactggttccgtgtcgggcactttctgagattgtctcatataatcctcaataatccaaaaaaaaaaaaatcctaaagtttagaagctgaggcccggagaggtttaatgacttacctgcgagcaaatagccagtactagtcgaactctggttaaattcaggatgcctcacttcagagaccgccttccctgtgctcccaagctcccctccttgaatcctaatgtgtgccaggcacggttccaggcactgggcattaaatggacagcaaaagaacctgggccctctgtagctggagagcaccgtgatcatcccacttaaaagaactccttagcctgtttccagatggaaaagccaagaacccaagcccttggcaagcgttctcaggctcctcagatgcccccagatgccacgtcggggcctcatcagctgcccgtgggactgagtgccgaggctggaccccagagaggtgtcctgcggatggtgctcacctccagctgtggtgaggccccataaattcacatggtcaagggagcccctaagccctaaccttactgatgtcctttccttagggcatttaatttcaccatagttctgaccaacaaatgttactagtgtcctgattttatagatgagaaaactgaggctcagcgaaatcaagtttaaaccctgcttgttatgggacttgcccactgcatgcctcggtggtggtggtggcggtggtggtggtggcggcggcggcggtggttgctcttgtttgtctgtaaaatgaggataacaaacacaccttgctcgcatccaggatcgccagtcagcaggtgctgggaccggacctccagctcctctatcaccagccccagagcctgaggaactgacccaggatctttttaagatacgtctttaaaagggaccaaagccagagggagttgaggatttgttttctcactggatatgggtttttctgatattttgcccaggaagcactgagttggaggcctggggcattggggcatccggctgagagctccctgacacagccaaagcattgcttgtggcagccaggaaccgagtgcttctcaatgttcccctgactcccagtaagggtcgccaggctggcctggcacaaccaggagctgtcctactgcctcaccaggaaccatgcagccccgccagcgcctgtggtgtctctctgggtaagtgccacacgcccgtggaagaggggaggatgccaggaggttctaagtacaaccactgtctatacccagtgttaccactggacacagtaggatacaagggcagtggagtgcaggcagtctaccatcacagggttctgggctgtgctgtgggaaggaagaggaaagggctgtgctcaaggcttggctgagtagaagaagggacctgaaggtctgggccagctggcagctagagagagccatcaggagtgggagccggatgatcagctcagccctggcattccacctcctgggcctgtgaccctgctgcgagtctttaacatgttcctgtctcagtcttacggagggacacactgaggctcctccaggttgccagaccagctcctaagcaggacggtgctctcctgctaggcagccccagcccacagccccagcaggcctaactcacacaactgggaaattcttctatccgaaatgacccgtatttgctcttaaccagatcgctgtggcctccgtcccgcactcctgtgggcctttttcaccttacaggtgtctgcagtagcattagaaacaatatttatttcacttaacgttataccacgaggatttctccatgatacttccctctttatgtgtcatactctcccttgggggaccagctgagtgacc

SEQ ID NO: 16711 - DNA, 7103 bp, Human
cgggttcagcctcagcctctcgagtaactgggattacaggcgcccaccaccacacccaactaatttttgtatttttagtagagacagggtttcaccatgttggccaggatggtctcgatctcctgacctcatgatccgcccccccacggcctcccgaagtgctgggattacaggtgtgagccacagcgcccagctcttaaaaagttttctttttgaaaaatttcggtaggggaaggtataataaatgctcttggtgagaaaaaaaatgggacaaatcaagtcggtatgcagtgaaaagtcagcagctgtaacattctatgattcaacgcaaaaactatgttgagttcctcagctgaataagtagtataaacaatttctttttcttctatctctccatacagggagggcgttgcccttatctgaggacctctttgctgtcctcgaccaatgttcaaatgaaggtagaagacgcccttttaaaaaaaaaagcactccatgccctgaacttttctagaagaatccaggcagaacatttgcgcaggcgaaaacacacaagctaagcgaggcaaatgcagaagttgccactggtgatacagctcgcacagcgacgacgcagggtggccagcgaaatcccctcccccaggaggggaggaaaccgcagaatgttcctgactcggcacccgggcgggtggcgcaatgtttatgtttgtgtacctagcgcgtcgcgtcgctgcagcaggctccgctgtccagggggccgtcactgggactcagggcacggagatcgctgggcggggcgggggtcttcccaagtgttgcgatccaggtcctggcaatccgcccacaatggcccgggattggattttgctttcggcctataacggccgcgacgacagggagcgagggttgtggccggcttctgttccgggttggaggcccccagcccagcgcttagtgggcgctcactgtgtatactgcctatttgtataataaagaaagggatggagaagctcagtctggagccaaggtgacagaaacgtgtcgggcggcccctggggggcgccgtcgagtcgcgctgcgggtcgcccctcacccctccaaacgccaaaccctggaatccactgcggggccttgcgacccctcaccgggatttcagccccctgacctgcctcccttggctccaagtcttccgggggccacaagactaggaatagcattatttcccggtgggagtttgcttgctcacactttcatggcaaatgtagatattttaaagccaccttaaagaaaagtctgggaaacaggaaagcattgccctgaacctctccgccccaactcgctcgagtcggtcttggtagggacgacttttctatcggcagagttgttcatttttctctaaacttcatcttaggcgcctatttgctgcccccaccccagtagtgtggttctgggcaagtcagtcgcttcgcctggggaacctcagtttccccgcctgttagtgatgaggaaatgaggaaaaggggcacaagagtatgcaaaagcacaggaagcccctttcggttcaggtcggcggccgaggggcacggggaaggggactcggggagggagagagggaggagcggcgaggccaaggcaggtggcacgtcgcccgttctcccggccgctcgcatcccggaggtcagcctcagctggcagcgagccctcctcctccccgctgggcctggagcgcggcgcgggtccggtccctggggacgcgccaagagcaggccggacagcagggcgggggctgggtcgcgagccagcgcgcggcgagcggacccagctccgaggctgatgacgtctccccctctggctcggcggcgcctggcctggcagggcgggtgacgtcaccgccccgtcacgtgatcaccattcaacaaacaccccccctccccctgcgcgcgggtctggcccgccccgtcccccagaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggtacgccctcggggaagctcggggcgggccgcacacccctgaggttttgcccggtacccctggctctcggctcccgggggatcgccccacctgcagcgcgtgggcgctggagtacatttatctctggaacttgtcattggctttgtttggctctggaaacaaagacttgcctgggcctttccgatgtaaacttccagcccttggtgggtgggggagttgtatgaaggtgccgtgtcccggtgtcactaatggggaaaaaaaatgtctttgtattcccaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcaggttagtaggtgtccctgccacagggaagaagtaagaactggcaaaggcatggaagagtagtgccagggagaatatagaaagtgacctgcagcattatttataacggaggggacacagggatatgatttattccacagttaagtggtctgacggagccgagtctccaattgtaggctctacggaaatgaacttgctggtcctgcccaggcaaatgggcttagttccctatttatttatcctccagcaacagaactgagttcactcggtatctgaaattgacttttccagcagaaagtttttgtgggtatgggcactggccttggctttgagcaagcttgatgaatgttggatatttctggatttcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcataggtaaatggaatggatgcctggggcttttctgcctttctcttctcattttagccactaagcccaacctctgtggcaagagcttgaagttttctgagccttcttccacacattcagtatcagtctggtgtgggcaacattcctgtaaaatatgaatttgattcgatgtcccactttacagatttgcaaagtggggctcacaaagttgaattgactggtctgagatctatctgctaagtggaaatccccagtctgagtttaaatcctgtgccatcctttgcacagtgcccacgttgcctccatgaacagtatccatgtgatggcatgtggtgatgttgaccatttctagacaagacacacatgacctttctcagatacactgtacctgggcttggggtggttctcctgaactctcaagtaaccagccgctcctttggttttccagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaatttcaacgcttttatttctttggcaaccacacccaatccctctcccactagtgaactagggaagaatttcgacaagggcctgcagaatgtgttgagatctgatcccatgccctgtggtggcccgttggtcccatgaaatggctgggttgcaagggaggaagacaagtgagtatcatgaaacaccggacgctacagctgaactcttagtattggatcagtgtgtctacccatgcccattttagcggctctgtaacctaccatgtcacccaggatgccaaggtgtccccagagccaaagctaggaggaaatagccacttgtctggattgccttcttcatttaataccctcctcaggttaatataaaaagtcgccttcccatctctgagctgtgctggagttatgaggagacaaaagtttttccaaacacatgacataaggcaggtgtgtgctacctgcccctagagaaactcagcaaggccttttgcaaatgagatgctgagacccagcatggctaagtggcagaaataggagaattggaatctacatctgtttcagactttcacttgcccgtctcatggctttttttttttttttttttagacggagtctcactctgtcacccaggctggagtgtactggtgtgagctcggctcactgcaacctccgcctgccaggttcaagccattctcctgcctcagcttcctaagtagctgggattacgggtgcgcgtcaccatgcccggctaatttttgtatttttagtagagatgggggtttcaccatgttggccaggctggtctcgaactcctgacctatctttttgcttttaaaaaggcttttgtttttgtgaaaatttaaatacattggcaaaaaagaaaaaaaaagaaaaaaaatccaagcactataagcaaataccatgtaaagaaatcacccgcaacagcccatccccaacctgaccattgctaacattgtggaggacattcacgctggcatttctgcatatagacatggcatttttggtagttgcctccttcatgtcacctgctgctctgatttcatagttttgttgagataagcaattaaacctgacttgttctaggataatattctgaatttgtactcctttgccaagcaggcaaaaaacagaagagatgtaattgctaccaatccataatccagtctataatgttgcgttaagaaacagcgaagctcttggattactggccccttagcgccccaccccactctttgtttctggacaaagtgctatgggaagcagaaaaggaaatatcccattcgccttatccatgagcaccctgtgctatggttctggtcctgtcctgttgttcaaggtctttacgcagaatcagtgtccttgactttgcccctgtggctcactgtctgccacttgactcccagggtctgaaagatccctgtgttctaagttctaagaacttaccctgggctggcaagctcatttcctcagctgggtttccgattacaagtatgttcatgcctatcaaaacaaatcgtacccagtgtttttatcaaagcctagaaatttactattgtaaatatctctctccgtggaaatgtaccagcgacatcgagtctgtgacagatgccatggctgacttccccgtgggctagggccttcgctttctgcttggcaggcactggctgaaccaaaattaatctccagtgtgatccacgcagtggaaaaatacagcggctgcctaagggagccgccagtgaaaacaagtcactcacttctcccggctcaagccactctgcctcatgccagccctgagagccaggaatgatgacccctgatccccatgtaccggagtcactgtgttcagaccctccagaaaaatctcatatttggcctcagactgctttccttgggaaaaaattaatacctcgtgatgaaagatacttaaagtctattaatgtgtttcccaggaagagattgaaataagacttttaatactgataa

SEQ ID NO: 16712 - DNA, 23826 bp, Human
atgtattttctcatttaattctccaacctgtgaagtaggcgcaattgattatcaccagttagcttccgaggagacagaggcacaggcatgcgaagtgtgtggtggacaggatttgagcccaggcagatgccaagcctgtgatacactgcctctctattaggtgcagtggggtgatgaataccttacgagagggtgtgtagagggctgtagggacacagacaagcacatagccccgcttacaacaggtggggaccatattgattttttggggaaaagatggctttcagtagaggctgtgccactttctttgtttcttttttctttttttttttttttttttgagatggagtcttgctctgtcgcccaggctggagtagtacagtggggcgatctcggctcactgcaagctccacctcctgggttcacatcattctcctgcctcagcctcccaagtagcggggactacaggcgtccgccaccacgcccggctaatttttatatttttagtagagacggggtttcaccgtgttagccaggatgatctcgatctcttgacctcgtgatccacccgcctcggcctcccaaagtgctgggattacaggcatgagccaccgtgcccggcctaggctttgccactttcaagataggtaatcttgcaacagggttgattgttttttgttttaatttactctaagccctactcctgatctgtgataatagtgtagtacaatttcaagggtggttgtgaggattaagagagatgaacatggtcgggcacagtggctcacgcctgtaatcccagcactttgggaggccgaggcgggtggatcacgaggtcagttcgagaccaacctgaccaatatggtgaactccgtgtctatgaaaaatacaaaaattagctgggcatggtggcacgcacctgtaatcccagctactcaggaggctgaggcaggagaattgcttgaacctgggaggtagagtttgcagtgagccaagattgtgccattgcactccagcctgggcaacagagcgagactccgccacaaaaaaaaaaaaaaaaaaagagagagagatgaacattcaagtcctaagcctttaggtcctcacaatctatgcttgctgaagtgacccgaacaaatgcagatggagtggggtcgagtgggggaaacgctttctagggagagggaacaccacattctaaggctacacatccagaaggagcttgagcaatccaggaagggcgcagggtgcggtggctgatggccggggtggctgatggccttgaggaccagctaagaaacttggattatttactaacaaaaataaaagagccaccatttgttgagggtttgctctgacatttccatcaaaactaccttagcaaggtagatttaataaatccagttgtatacaaaagggaaacacgagaagccatagaagggctgcatacaggtaggtgacttgatcaatttcgtgttttacaaagatcccttagatcatgtgttggagtgataggaggtactctaccgacctgccttgaactccatactttaaaaaatatatgacgtttatcatttcctcttttactccacaatttatactcactgtagaaaatattaaaaatataagaaagtttgaagaaacaaaaaattattactggtactttccagagacatctcaattgatacttttcttccagtctttttttttctatgtaaaaaatatatagttattagaatgcctgacagaaggaagatggaaagagaccactgtgaagcgttcttgatattccctcttcccttcctctccatgttattagggccataccaagaggagaggctgatttccctacacgtgtcagggaaagtcccaactctgcgcagggaccctcgcttgccattttcgccggtctctagggggcgctgccccgagactgggtggggagggaaagaaggtggtgcgaaaacgcgtttgaacttgggtcctgccgctgcccgtagccggcgtccccaacatggcggctccccaagacgtccacgtccggatctgtaaccaagagattgtcaaatttgacctggaggtgaaggcgcttattcaggtactgatcccgggacccctgccgggctccagcagccctaacccaagctctgctggtctgtgagcttggcagtgtcactcccgaactttccccacttggtttcccagaccacaggctccgccccatggtcggctacccccccggtccccatttggttgtgtcccggtgactgctggccttgatcctttttccgggtgccgccggatctcccatccccagagcaccccactgttctccgcccctgactcagctactgcttcggggctcggctttgccccttccacctgcagccctggtcgtcgccccgcccctgactacctcacaacctacctgtcaccctgcttggccccgccctctgacgctgcttcagcatcctctggtagcgtccgggaggcagctagccccgccccctgctggccagctctcctggcatccaaggccacctggcacgggaggcaccgggtgaaacgaatgtaacctggaccgtagttgtgattttatgcttgaggaaatcgagtacggcgccaaggcctaggttagaaggcatacctgggtcagtggcaaaactgggacctggactgtgaaagtcaacctaggaataacaccttagagtgttaccccgtttgaacagataggaaatgaagtgtttcgccttaagccatttaagggtagaggtaaaataaacgagtggacttaggcaagaattgggagtgtagacacggttccatgagttcagcaaaaagaaaccgagttttaaaccttgtttttgcttgtttgtttttgtttttttgagacggagtctcgctctgtcgcccaggctggagtgcagtggcgcgatctcgactcgcggcaagctccgcctcccgggttcccgccattctcctgcctcagcctcctgagtagctgggactacaggcacccgccaccacgcccggctaatttttgtgttttgcttagtagagacgggatttcaccgtgttagccaggatggtctcgatctcctgacctcgtgatccgcccgcctcggcctcccaaattgctgggattacaggcgtgagccaccgcgcccggcctaaaccttggtttttaaaaataatcattttcaacaaagtcactaaacattagatgtagactcagagtttgtaacaaggtgtggcaaaaagtgcaggaaaatagggctccccagataaaccagatgcagaataaaccaaattagatgcagaataaacaaatacggtgcaaagaagtgtgattaaatgaataagccagagaaaaagtgaaatttgatgcagatatttaaaacttcttgaacttcacttctctgatgtatacattacaaaacttctgggccaattatagaaaaataaacaggtttcatacaaatgaaattacattttcacataatctaaattgcttaggcattcttctgtactctttctaacatttgggttcttgtcattgctgatgagaaagactgattatagctggatgtattgcgttcttaccgttttccagcagctctgctaagtgctttacatacatacataatctatgatgttctatgaggtaagtagtgttgtgataaggaaactcagacacagagaatttaaataactttccaggtaactttacacagctcataagttgctacagccaggattcgaatccacctggtctgtctccagagcctgccgtgaaagctggcaccagtaattctgaatgtccagcaacagattctaaatctgcccttaaacatgtctatataaacactctaacttatcactaatggtttgtaaaatcacactggagaagttaatctcatcatatgatgccagatatttaaacatcctgatcttccaagttggaaggatctaaggttctaaagtgatagtatcacttttgcatgtccattcttgttgggcatacaagctgttttaagctgtttcctactggccaggtaatgttttgttaaaatttaggcactaaaaattaggtcaaagcagttgtgtttctttctaggcttttatattaattcaacattaatctaaaaaggaatgagaaaaatgtaaatgataatgtttttgcttgtgttgcagaggtaaacagcaaagatcaggatgaattatagttagtacgttaatattagttggtctaaaccaactctatcactgtatggatggtgtcatttcatttcattgccttgagaaaggcctttcatctgttcaatgtctcctaggatatccgtgattgttcaggacccttaagtgctcttactgaactgaatactaaagtaaaagagaaatttcaacagttgcgtcacagaatacaggtgggtattctcaattcagtcaatgaagggggctctgtcctgggtatatcctctgcttgagagccgtctgggttcttcaaacaccagctgatgggagcagtaaacacttagacagggagggtgactctgtactaacctgctctccaggtaaaaacgagaaacttttggccgggcacggtggctcacgcctgtaatcccagcactttgggaggcccaggcggggagatcacgaggtcaggagatcgagatcatcctggctaacacggtgaagcccgtctctactaaaaatacaaaaaattagtcgggcatggtggcaggtgcctgtagtcccagctactcaggaggctgaggcaggagaatggcgtgaacccaggaggcggagcttgcagtgagccgagatcgagccactgcactccagcctgggcgacagagcgagactctgtctcaaaaaaaaaaacaagaaacttttgcatgcagaacactgccagctgtgtgaacgagtgaatggcaggaacaccattatccttggaatttttgaaatcctggggccacttcaaatactttctcttctctgccattctttctaccctattcattcattcactacctcaatccatcacactcctgggttttttttttatgctgttactttgctcagcatcttccttatttcaatagtcaccagtcacatcatatacacatttagtatgcctgaattcaagtatggtatatgtgctgtctcaaaaaacactagagggtgacaagtagcagttatgtttgtttgttttatttatttcacattttattcttattacattgggctgggcaaagagttgtgcaccactgtatagatcatgttattctgttgctttcatttttaaaaatgaaaatgaggccagtagtttgagaacagcctggccaacatggcaaaaccctgtctctgataaatgcaaaaattagctgggcatggtggcacacacctgtaatctcagctacttaggaggctgaggcaggagaatcgcttgaacccaggaggtgcaggttgcagtgagcagagatcgtgccactgcactctagccttggtgacagagcaagactctgtgtcaaaaaaaaaaaaaaaaaaaaaatatatatatatatatatatatatatatatatatatatatatatatatatatattttaatagagatggattttttgctctatgttgcttgagctggtcttaaactcctgggctcaagcaatcctcctgcctcagcctctgaaagtgctgggattacaggcatgagcccagactattgtgttgctttcagacagaattgggattcagcttctaattgtttccaagttcagaatctagatcagaatcagaggatgaagaccacttgtgggtctgggggctgctgagaggaaacacgtatggagctgactatggaggggtcatgtttcaaggctgccatctgggcatccaaggatcctgcatgcagctcatgggtagaggggcccacagcagcccctcaaagtgaatagggatggcacaggcccagggctggaactcaggagttggaaggatgactgcatctgcacacttaaaaagatgctgtccatctgtatcctggaatcctgtgtaggccctctccctgaggacaggaacagggttggctccttggcctctgtttagcctcatgagtagttcagtaaaagtcctgcaaacttgtcattatctggagacattcctgccggctcctcttcatgcccctctacttgaagcactaggcagttgctttatattgttcatgattcttcttcttcagttattcaaatttgagataattgcattcttttagggaactctggatctcctggtcactccaagggttgattactgttctgatggtttttctggtttcttggtttcttcttccttctttatttcctgagggtttctagtaatttcagtctgatgtcttacgttctccatttttattcctgagttttctcctggaattcttctcactgcagccacaggacctaatgttgggttggcagagaactagcacttactctgccctagtgggacctaggagagtcaggaggtacctgagtgtggaaacatgcctgctcctctagacttctggaggtctcttagaagtagcagtttgaatagtggagatgtttcccctgctgtaccttcagtgagggtgaggtgggtgtcatggatctgcccatctgtattagtctgttttcatgcagctgataaagacatacgtgagactaggaagaaaaagaagtttaatggacttctgacatggctggggaggcctcacaatcatggcagaaggcaaagaggagcaagtcacgtcttatatggatggcagcaggcaaagagagagcttgtgcagggaaactcctgtttttaaaaccatcagatctcatgagactcattcactatcatgagaaaagtgcaggaaagacccacctctgtaattcaatcatctcccaccaggtacctcccatgacatattgtgagagttacaattcaagatgagatttgggtggggacacagccaaaccatatcaccatccctggatgggtcttgtggcacctggtcttgtggtattggggttttgtattaggcctttcttgcattgctgtaaagaaatacctgaggctgggtaatttatttaaaaaaatgggtttaattggcttaaggttctgcaggctgtatgggaagcatagcagtatctgcttctggggaggcttcaggaagcttccagtcatggcagaaggcaaagggagcaggcatgtcacatgacaaaagcaggagcaagagagagattgagtgagagctcacttaccactaaggggatgacttatgccattcattagggatccacccccatgatccaaacacctcccaccaggccccacctccaacactggggattaccattcaacatgagatttgggcagggacaaatattcagactatatcaggtctaaagacttgagcttttttggccagcacagtggctcacgcctgtaatcccagcactttgggaggccaaggcgagtggatcgcctgaggccaggagttcaagaccagcctagtcaacatggtcaacctccatctctactaaaagtataaaaattagctgggtatggtgacccgtgcctgtaatcccagctgtttgggtggctgaggcatgagaattgcttgaacctgggagttggaggttgcattgagccaagattgtgccactgcactccagcctgggtgacggagcaagaccctgtctcaaaaaaaaaaaaaaaaaagacttgtgcttttcatataacatggcccccaaagcccaccagcaactctgttgttgcttaacagaggaagacagtctgttctaaagctggtagaaaagctggccagttggacccctgagaaacaatatgtctgtgtcctgtgtttgcctacctcagagattttcaagggcaattttgaaaatgtgtaatttttgctattggagttaactatatgattttcagcagcgtcaccatacctagctgatctcttcctgccttcatctccagtactgatttaatcatcttaattttttatttttgaaaagatgttccttttacatgttttatgtatgtgtctgtctataagtatcaacattcagtgaaaagtctcagttatgccccagttttgttttttgttccactcttccaaacaggtaaccacttttgttactgatatgtcattccagagtttctctactcaaatatttaaaaagacaaatttctttttttttaaaatttcttccttgtttctcatctaaaaagtagcatactaacacacagcttttaaaaactttatacttttgtttttttgtttttttttaagacggagtctggctctgtttcccaggctggagtgcaggtgtgatctctgctcactgcaacctccacctcctgggttcaagcgattctcctgcctcagcctcccaagtagctgggattacaggtgtgtgccaccacacacagctaatttttcgtatttttagtacagacggagtttcaccgtgttagccaggctggtctcgatctcctgactttgtgatcagcctgcctcagcctcccaaagtgctgggattacaggcgtgagccaccgcgcccggtcaaaacttatactgttaagtataattttattatacgtatattggaaatttttccatttcagtaatcagagactgtcctcatttttctttttttttctttttttgagacagggtcttgggctgtcacccaggccagagtgcagtggcacaatctcagctcaccacagccttgatttcccaggctcaagcgattttcctcctgcctcagtcccccaaatagttgggactacaggcgtgcgccaccacacccagcaaatttttgtagtttttatagagacagggttttgccatgttgctcaggctggacttgaactcctggactcaagtgattgcctgcctcagccttccaaagtgttgggattacaggcaggagccaccacacctggtctctcattcttttctaaataactgtcatttttttttttttttttagccagttctctatcaaagggcatttatttggactgcttccacatttttttttaagctaacttattccctgacagacttttcttcaactcagcatgacttcaactctccaactacacctgttaccttcagtgtgagtatttgtatgttctttttaaacatctgggtgcccacccagtgtttatttccttcactcattaaaatgacctcaccaatacgtgtacatttacatatttattatggcacctaggaaggacctaataagcacatggccagtaaatgaataaccccatcccagttttaatctgcgtttcttaagtatttacatactctttttgtatctggaaataaatacaagattcctgtttgtttgccatttttagcttttatttgaatgtcttttttgtgtatttccaacaagatcatgtgatactagagaactggcctcatatcctcaaaactgggtgttctgcacatggtgaatcttgggcactgactgtgtataaatatctgtgtgtttgtctttgtacatatagctctcaaactggaatttgaggactgctctcccccgccattcctttctccagaactatcactggttctctttgaaagaacttccaggcaatctttcatgagtaaattgtacatttctccccctttttaatccctccgcttttcccatgcgttcattcttccattcagtgactcagtgcccagtatgtgccaggcacaaggaatatatgtagtgaataatgtgagatacagctctgcttattcatagaatttacattcttttttttttttttgagacggagtctcactctgttgcccaggctggagtgcagtggcacgatctcggctcactgcaatctccacttcccgggttcacgccattctcctgcctcagcctcccgagtacctgggattacaggcgcccgccaccacgcctggctaattttttgtatttttagtggagacggggtttcaccgtgttagccaggatggtcttgatctcctgacctcgtaatctgcctgccctggcctcccaaggtgctggaattataggcgtgaaccaccaggcccagcccatagaatttacattctaatagggaatacagattttaaacaaataattatgaaaataattgatgacatttgcaaaacttttctaattcacagttgattatttcttttattctctacctcagcaatatttggaggcataaattgaaagtcatctctgtgctattgaaatggtggatacacaaacttgttccaaaccagtatgtgcaaattgatacgtaaatcagtaaattagtatataaatgagcaaatacattgatgtttcagatcaatagcgtgattgaagctagaacctgttttaatttgtaaaccaaaaaatgtgattggtataatgctatctttaattatagtccctcttgatggttcttttatctgaagttcttggggtttaatacttctgggtatgtctgctgaccctaacttatagtgggttatttccttggtgttaggttattttggactgtgagcgctcatcttagcagaccttatctgagggactttgtgcagctgggtcgaggccaagtctctacagaggtttttgcattagcttcccgccaggtctcctgagatgatcacaagtctgacaacattttttttttttttgagacagtctctctctgtcgcccaggctggagtgcagtggtgcagtcttggcttgctgcaagctctgcctcccgggttcacgccattctcctgcctcagcctcctgagtagctgggactacaggtgcccgccaccacgcccggctaattttttgtattttcagttgagatggggtttcaccatgttagccaggatggtctcgatctcctgacctcgtgatctccccgcctcggcctcccaaagtgctgggattacaggcgtgagccactgcgcccggccgagaacactgtttatgttcatttctcttcatggagtttcacgaaccactcagggaagataaattgaaccctagatcagtggaaggagcagctccctggttggttataaattctcaggggagtttttttttaacccctctatttggaactcatagcaaaaaaaggcaagcatctatgttttccctctgtgctggtagatggacatttttttataccattttcctgtgtctgtaacctttcgtgggttttagatttgtggtgatctcagttcagcttctcaacctcagcctcagatggctcagggcttcatttttctgtccctgcacgagctctcaaaacttcaagcgctcaaactgcctattactcgtctttaattaaataggcacagaaattgtgagtatctggaaatgaacagcagtttgatattttaatgatatctaagtgggggatcagtgtgcttgtatttcgtcattgtttttcttttcctttcgggcctgccctaggtgacaggagcagcagctctgacgccaggacagccgtgcatcactcccaggctgactattccagctcttgttcccttcccacttttgggccataggggttttccttacttccttgtggacttagctatagatttaaaaggatgtgtgttatatgttacctagcattcctaggtgttctgttttaaaagggtgcttcaagtgctattgtatgcccttggcagaaatagaaatgctcttctgctttcatgttgacttttgaaatcattttaacatggaattatttttcctcaaaggacctggagcagttggctaaagagcaagacaaagaatcagagaaacaacttctactccaggaagtggagaatcacaaaaagcagatgctcaggtaggcagggcctgcccccgccagcggcttctgctggctcttcttgttgcctgtgagccttgcacgtgtgtttgcctgatggatctgctttaatgctgacttaatggtgtcttttttttttttttgagagacggtgtctcgctctattgcccaggctggagtgcagtggcctgatcttggctcactgtgacctctgcctcccgagttcaagcaattcttctgcctcagcctcctgagtagctgggattacaggcgcccaccatcacgcctggctaatttttgtatttttactagagacagagtttcgctgtgttggccaggctggtctctaacactggcctcatgtgattcacccaccttggcttcccaaagtgctgggattacaggtgtgagcaaccacgcccagccaattgcatcagttacacactggtggaatgttctctctcagtcagcaatagtcaagtgggggcgagtggggaagggataaatagggcctatctgagcaggtggagctgaacatagtttacaaaagcatatttaacattatactgtattgtatatttttaatcaaaaaatatgattgcttttgtaatacagggtcattttttatctaaggataattggtaccagaaaaaatctacagaaagaaaacctgctgaaggtggaccaaaatttagaaggttttgagtgggatgctgtctaaaaataaaataaaataaaatgcaagaaaaaccgtaaattaaacaaaattgaggtcaaaaattaaaaccaaaatcgaggttgtaattgcaggtgtgtgctaatccttgattatatagttacagttatatgccatttcttgttattgaattgggagaggtttaacttttccaatgaaattgtcagacaacatgaaacagtatctttcccttcacatttgacttttgtaccaatcataaagagggtttttccaaacatatttgaggtattcagatcattctctctcttttttaaaaatacatttttggcccagtgcggcggctcacgcctggaatcccagcgctttgggaggccgaggtgggcagatcatgaggtcaggagttcgagaccagcttgaccaacatggtgaaacccctctctactaaaaatacaaaaattagccgggtgtggtggcacacacctgtaatcccagctactcgggaggctgaggcaggagaatcgcttgagcccgggaggcagaggttgcagtgagccgagattgctgcactccagcctgggtgacagagtgagactccaccttaaaaacaaaaaaaaaatatttttacttttaaaaaattaaaaaattttggaaatgaggtccttctctgttgcccagtctggagtacagtcatagcttactgcagcctcaggaactcctgggctcaagcgatcctctcacctcagcttcccaagtagttgggactacagcacactccaccgtgcctggctaaatcattctcttttgaaacccctgctaagttgtcattcccatgggttttctctttgtctcttgttcactggtctgcctctgccagatctgtatttgtggctttgcttctgatttgagcaatttgccagcatcatcttccctgcaagcagctgtgtatgtaacagtcagctgtcaggaagacaccgactggcaaaaacacaggcacagggaggccagtgtaagcagggagggctgtatgagtggtgggcagtgatccagggcttggctatttcacgaatactttatgttatgatggcttttgctttcctgagccaccaagcctactcagattataaacactgagtacagaggagcccttgtataaagtatggtaagttatgccagacacactcagcttagcatgggtttaaagctgggaatggccatccacaatgtagcattacaggccagagcagagaaagctgtcaatttatactttggggctatgtgcagtagctcacacctataatcccagcacttcgggggccgaggcaggaggactgcttgagcccaggagtttaagaccatcctgggcaacaaagcaaaacctcatctattaaaaaaaaaaaaaattagctgggggcatgctgatgtgtgcctgtagtctcaactacttgggaggccaaggcaggagggcagtgggctcgggaggtcaaggctgcagtgagccgtgatcatgtgactgcacctggcctaggagacagaacgagaccctgcctcttttcttttgtttttttttttttttgagacagagtctcactctgtcacccaggctggagtgcagtggcgcaatctcggctcactgcaagctccacctcccgggttcacgccattctcctgcctcagcctctccgagtagctgggactacaggcacccgccaccacgcctggctcattttttatatttttagtagagatggggtttctccgtgttagccaggacggtctcgatcacctgaccctcatgatccgccggtctcagcctcccaaagtgctgggattacaggcgtgaggcaccgtgcccagccgaccctgtctcaaaaaaaaaacaaaaaaaacaaaaaaaaccaactttggcagttgaagcagtagttgtgcttgcttgggtcatcatgcttgtcacaccatacagtgagtatctgtttgcttgtctttttcccaaatgaatgtgaggtggttgaggagaagtactgcccctcattcatctctggatcccagggtcctgcagaacccccttgcaaactgtttcaaaatgtaatggattctttaaagtggcaggtgtgaaatggcggagcaggtgctcattaagaccttcagcataaaggtgctattagaaaaccaccctgtcagttcatgtactctgtgttttgatttttgagtatttccagagattagcacaattggtttgagctggctacataagagttctgaagtatgagtttgattcttagagagactcagttagcttttttatagtctatcaacaactgtcaacatttctttttttttttgagacggagtcttactctcattgcccaggctggagtgcagtggcgtgatcttggctcactgcaacctctgcctcctagattcaagtgattttcctgcctcagactcccgagtagctgggattacaggcactcgccatcatgtccagctaatttttgtatttttagtagagacagggttttaacatgttggccaggctggtctcgaactcctgacctcaagtgacccacccgcctcggcctctcaaagtgttgggattacagatgtgagccaccacgcccggtcaactgtcacatttctaactccaggaagctgttcaccaactttccgttatcacccacaagttagcgcaggtgaagactgtagatccgccgtgtcagtcagggctctgctaatccatcatgtttgtgtcattcatgattggtctgtagtatggaaagaacaacaaaccttgaagaaatattttgaaagattggctttttgtgtgtgtgtgtgtttttttttttttttttcttgagagaaggtcttactctgtcacccaggctggagtatagtggtactatcacggctcactgcaacctccacttcccaggctcaggtgatcttcgctcctccgcctcctgggtagctggaaccacaggcatgcaccaccaccatgcctggctaattttttgtatttttagtagagacggggtttctccatgttgcccaggctggtcttgaactcctgggctcaagtgatccccccacctcggcctcctaaagtgctatgattacaggtgtgaaccactgtgcctggccacgattttttatttcctacaaagtatattaactcagcagctgaagggccagaaatggttgttcaagatactggagatgagtaagtcatggttctccggggatggtaccaattaatacacaggccatagcagtacagccttagaggcaactggactgaagaggggccttgtgtgaccagctgggaagtttggatgcctccctgaagtccagccattgtggagctgtgcacagaggagtgccatgttcacagccccttgggctgacgggggcagagtgacagcaacagagcctccccgtggcgacctccagggtccggtcaaggggtatcaggacctgagcaagaacagttgctggggaaccaggaggcggaagtggcaggaggtgggatgggctctgaaggccgtgcctggtggccttctcccgtgtgcctttgttggggggaagtgctgtgaattgaactgacttatggcttggtggagtggacacactcacacgtgaaccttccaattccagcaatcaggcctcatggaggaaagctaatctcacctgcaaaattgcaatcgacaatctagagaaagcagaacttcttcagggaggagatctcttaaggcaaaggtacctattcttttatttttctgggctccgataataatagataacaattggcaaggtgtaggaaaccccctcttgttttagcttggtgcttaatttaattacataagtaatttttttaagtttgaaaaaaatgcatacttatttgtagtaaattggtaaaataaagtatgaattacaaaattaaaatattgaatttttttttttttctgagatgaagtctcactcttgtagcccaggctggagtgcagtggtgccctcttggctcaccgcaacctccgcctcctgggttcaagtgattctcctgcctcagcctccaaagtatctgggattacagttgcgtgccactgcacccagctaattttttgtatttttagtagagacggggtttaaccacgttggccaggctggtcttgaactcctgatttctggtgatccacccaccccagcctcccaaagtgctaggattataggcgtgagccaccatgcccagccgaaaatatcaaatcttattactcatgaacattttggtatattctctccctcatttttatttctacatttcttacaaagtcaaaattgtaccatacataaaatttcatattctgctgtttcagcacaaaagttgttcattaaaaaaaaaaaaagctttttaagcctaattctaacagtacatagtatgtagattgtatgttaatacaatcccctgtgtgtgtttgcatttctagtgtttaagtagtgtaagtaatacaccagggcatgtcttagaacataaggctttatccacattttggatgtttcctttggagggatttccagggatgagatgattgagtcaaaggaatgaacattaccaaggctcttcaattggcaaattgctttacagaaggcagcactggtttatgttcctactagcagtccacaggggcgtgggtctcagcacaccctttccagcattgaatgtgatcatttaaaatatgtatactaattggataggtaaaacatgagatctcatttggatgtggggccttcttgcagggaggcttttgttgacattcctcccctttctcttcctctgaacttttaggaaaaccaccaaagagagcctggcccagacatccagtaccatcactgagagcctcatggggatcagcaggatgatggcccagcaggtccagcagagcgaggaggccatgcagtctctaggtaaagctgggcctggagtaggaagcttctcccagagacgctgctctagggcccttgccctggcacctccactctgggctcctccaccacagcccacacgatgttcactgacttgggtggcttctccctcatgagatgacttgacaccatggtcttatccagtgtgggatgtgctgctcctatttctctttttttttttttttgagatggagtttcgctctttttgcccaggttggagtgcaatggtgcgatctcagctcaccgcaacctctgcctcctggtttcaagcgattctcctgccttagcctcccaagtagctgggattaccggcctgcaccaccacacccggctaattttgtatttttagtagagacggggtttctccatgttggtcaggctggtcttgaactcccaacctcaggtgatccgcctgcctcagcctcccaaagtgctgggattataggcgtgagatgccacgcccggcccgtatttctgtttactagaagaccccacacccccatcgatgtttcctcagggggagcattcccatgtgttcatgtgaaaggcagaggtcccagcccctctcctagagagggtgtcggcagggctgggtgaggggcctggagtctgattttcagtgagggctctggggacccatatggccaggcaagtttgggaatggttgctccaagagatgtttggcgaatcagctgctggtaggactgctaggacctcagtttacaattatactccccaacgttatttttcctatgagttccttttaaaagatgtgaatcagaggctacaggagagactgcttgagaccatctggtttcctccaatagttttcccagagtgtctcctctgtgatggagaagagtatcagccctctccagggtccttcagtataagacaacagaaaaagggcgtttactccttgaaacgcttttggaaaattgcacacgtggacaaaagtagaaagcatggtatcctgaatcccctgagccctgagtccattaccccagccagtctcgtttcagttctaccctcagcccatcccccatctggattattttgaagcaaatcccagacatcatccataaatatctcagtacatctctctaaaagataagggactctttggggaaaaagcagaagcaaccccataactacaataccatgatcacccctagaaattataattttggaccactgttttttcagtgcaccaaataggcagaagcaaaaggaaagcaagcaggtgaccccaaggtcactccttgagtttgcagcttacctgaacatctgggctcggaaccagccaggggcttcctctcagcgtgtgctgtgggagaggccttggagagagagggagcaaggcgacaacttggcctctgagcccagggcttttatgctctggtgtggcgacagcataccccccgctaacagtgggaaggaaacacaaatgctggtggcttctggggtgttgagagggtcccggtgttcttggggcccattttgtacaagcgataactattgaagaaaagagaagaatacagttcttaaccctttccttatgcctcacaaattcagcttgatttaaaagcctactaggaccataattttaaaacaaaaagcttattaggaatatggtgtctggaatttgctccacaattgcaggagtagttgcagttggggggagggggagcaggatttcagaggttggtggttcttggttatgggtggtggacacatggcatttcatgatattatgctgtctgctctgtgatggttcaaaattctccgtaataataaagtttaaaaagaaaggcctattagatttttacttagcaagatctcagggttttgaaatcgcagcaggcaggcgtggagaaagcaggcggagagggattcctgttctgtgagtgtttgtttttctccttttatctgtcattttcaaaacgctgctgtgtttcctctgataatttatcctatttacttattagcttttaatttttaaaaaggtaacacatacagcatagagaaggataagaaaactctagcccaggactgccatagaaacgcaacagcagccacgtatgtaactttaaattttccagtaggcacatgttaaaaagtaaaaagaaacataagaaattaattttagtaagatgtttatttaacccattatgtaaaatattataatttcaatgtaaaactaatattaaaaactattgagatattttacattcctttttcttagattaagtctttgaaacatcgtgtggattttggccaggcgcggtggctcatgccggtaatcccagcactttgggaggccaaggcgggcagatcacttgaggtcaggagttcgagaccagcctgaccaacatgttgaaaccctgtctctactaaaaatacaaaaagaaaattagctgggcgtggtggtgcatgcctgtagtcccagctactggggaggctgaggcaggagaatcatttgaacccgggaggtggaggttgtgatgagccaagatcacgccactgcactccagcctgggtgacagagtgagactgcatctcaaaaaaaaaaagaaaagaaacattgtgtgggtttgacacttacatctcctgacatctccatttgcattagccacgtttttctatgcacagcagcctcgcatgtctaggggctgccatattggtcagcacagctctggagagtacaaaagggacacaaaaaagatcactctctgttctgacctccagctgacccctacctgccagccctctggtccacttcccagaggcaacctctgtaaccagtgtcttaaaaaatatcttgtgatcctccaagcttttgtaacttaagcaaatgaaataccatttatctccctgtttcttacctaaatggaaacatttcacaggcgttcctttatactttcccttttcacttaatgtgttctattcaatggctgttctgatgatgccttgctatgttttgtgggagaacctcgccaggtacaccttctaccctcagcgtcaggcccagatacccatattcagaaatacatctgactctggggacagtgattccttaagggacgtgggcctcttcttaggtgtcacctccttaaagctacagccagtatccctggcctgagggactggtatgtgtgagggcttacggcagagcccgggacacccttgcccttttgagatcctgcaaagtgccggtctggccagcagatgtcctggaggccgcacctcataggtggaaggttctggtgcatttggctgctgccccaacacagacctcacagtgcctgcccacgatccctgggttgattttgtggctggtggtttccctgagcagcgtccatctgcttcagagagctgaggaggtggctgggtgagcaagcctcttctgcccttctccctggtgacgctcatgttcaaggactcccagacaaaccccccctcactctctggagctgatgggacctggggaggagcctttccttgtcagctccttggctggtctccacatgctttgattccagctcagaggaactcacttgagaatgctggtttttatcagcaccccagccagcagagtgaggtctttggatcttgagctgcagtctctgagttgggcctccttcctcttttgtttcagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagatagccctctgggaatgtgtgttcctcttttcttttttctttttttttgagatggagacttgctctatcatccaggcaggagtgcaatggcgcaatcttggctcactgcagcctctgcctcctgggttcaaaagattctcttgcctcagcctcccaagtagctaggattacaggcacacaccaccatacccagctaatttttgtatttttttagtagagatggggtttctccatgttggccaggctgctgtcgaacacctgacctcaggtgatccacccatcttggcctcccaaagtgctgggattacaggtgtgagccaccatgcccagccctcttttcttgatgtccagatttttaggacatgaacctagattatttatttattcattcattcaacaacgaattagcattgttattttctttctgtccccacccaacaacaaggaactattaaacagctgccacacacagggtgttatagacgctgctgaacatgacaaatacattggtgaaccagacatggttcctccctcaaggaggaacagaaggagacacggaaataaaatctcacagactatcaggaaggagggtccaacagcccctgttcaaccaggtgtggtggctgatacctctaatcccagcattttgggaggctgaggcaggatgatcacttgagcccaggagttcaagaccagctagacaacatagcaagaccctgtctgtatttaaaaaaaaaaaacaaagaaacagaaacagaacagaaaacagcccttgttggaagtggctcacaccaacatctgaaaaggctgcgatgccattctctaccacagcagcctggccaggcctgggggtgtgcagtgattcgggctggcacatgcctttctctctgatgtccagagctaagtataaccaaggagggagaagctagtgagaagctgagactgtgtgagcctgagttctgtccaggccagagggagagggcccaggctaggccagtcctagaggtgctgtgtcttttgtgctgcaggcctggctgacctcaagcttgaaatcccagcctcccccactatttatagccccagaggacctgggaagggcagtgtggaggctgaagggaaagtgggaagaacatggactttgatccttggctcaaacacttggttttgagatttggctccactgctaatggaccacaggaccattggcaagttactttatgttgctaagcctcagttttcctatctgtaaaatggaggtgataatccatatgggtcctcatagagtcaacttgagaatccaatgagaatataaagcagcaagtgtagctagctgtcttcagaccaggcctgccatggcctttccaaatgctgccaccccctgggccctgggcactgaggtttcctgcagctgacagcagcggtgcttcaggaaaagctgggccaggcaccagcattctgttagaggtgtttgagcagaggatgtcaagagttaaggcctcagttataaagtggcagatcatcatgggaccaagttataaaaaactagctgcacatctcagaccagcttaatgagtggattccaagttaaagtgtggatctaagtatagatccacactgtgtacacacacacacacacacacacacacataattttgtaggctgtatatcatccttaaacaattcctggccccaaaagacactcggtgcagattgtgcacacatgtgtcttatttatagtcaaattaaagctgagaataaagcacagatgggaaattcccactcagattccagctgtaagtgcagcagatggatgttatcaagttcagattttcttgtcttaacatttttctttactgcttcccactaattgtcaacatcctcctcacaatatggaattgcgtgggctctgtatgccctaaaattgctccctttgacactttattcctcttttacttgcctcctcctgaaa

SEQ ID NO: 16713 - DNA, 23826 bp, Human; identical to SEQ ID NO: 16712

SEQ ID NO: 16714 - DNA, 23826 bp, Human; identical to SEQ ID NO: 16712

SEQ ID NO: 16715 - DNA, 23826 bp, Human; identical to SEQ ID NO: 16712

SEQ ID NO: 16716 - DNA, 54986 bp, Human
  misc_feature (1)...(54986): n = A,T,C or G
ccttgtctattccaagcttggcgcatactataactaacatatgtgaaaattctcagcaagcgttctaagccctgtttatcagctcagcacggtggcttatgccagtaatcccggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaggagacatcggagaggtaggtggggacatgattctgtggccactccaggagcagtgggcagcagcggggtggcataatccctgatcctggtctcaggcggctgatgtttactgagcacttaacacacctgcatgttctcaacaagcaattcctcaacaactggaaggaactgcaatttctcaacaaggaaaaggaagtttgtctatttgctgtcttgagactgaccgtgtgaaggcttcgtttctaacccatgagaacggtggttacagagacaagaaggctagaatgttctcttccattgtcatgtgacatggctttatctcacatttatttgtaccatttatttttatttttattttttctttttttgggaggagtcttactctttcacccaggctggagtgcagtggcgcaatctcggctcactgcaacctccacctcccgagttcaattgattctcctgcctcagcctcctgagtagctgggaccacaggcgcgcaccaccacacccagctaatttttgtatttttagtagagacagggttacaccatgttggccaggctggtctcgaactcctgacctcaagtgatccgcctgcctcagcctgccaaagtgctgggattacaggcgtgagccaccgcacccggcctggggctcatgaacttaaagatcatggcccagtgccaggcacacgggaattcagaatagtaagggacaactattgttaagttctctatgtctgttgcataagtagatgaggctgtagataactacactctttgtctaaaagggccaagttctcatcagaacactttgctgagccccgggtgaccgaatccctagctctggggtgagcgacatgcctccaaggagctgcagccaggagacagccaggcgaaggcggggctctgcctctgggctccccgaggggcggaggccggcgcgcgggtcacgtgggggcgcgggaggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccgggggtaagtgcgtgaggcccgccttgggaggaacgggcggtgaggagctagcaggccggggcggggaaaggcacgacccccacacgggtcagagaacgttgcatgggcgccccccgcgctgcagagtcaggcccccgacccggcggaactccttgtgttccttttcgcagcagcttcagtgtcctccggcctgagcgagtggagggtgacctttggtggaccccccttggaaacgagtttcaggggaattttttctcatcatagtcctgtgtggggaggtgcagtcggaaatgagcaggccgaatctgggagaaactggggtttgtccctagtcgactgtccccctttagccctgccttccacccacatgaggcctcgtttgcctgaacttaaggatcaaataaataaaacagaaattggcttctctgcctcccatgctgtcgcggttgcgtacagaacaagctccttcgacaacattgagcccaggccttgcatctagtgggcgccaggaggcggttggggcctgatctaaagcgagattaattaccaaagagcaggaggtattgttgagaaacccctgcgtcatgccttttggagggcgctccggctcttgtatgtgagtgtaagaagtgcttagaatgattggctaagaaagattttgtttttccagacttctttgttggttagagctttgtctcttttggaattaaactttttaactgtagtataaaatagaggcttaatcttcaaaggagccttggaacaccctcttcctggttcctcttttgcttctcagtcatttttttctcagttcaagatgatgagaggtgaaacttcgactgaagtcagtttgtcagaaacaccatctcttgctttattcttgaacctaattggtggcttcatagtgcctggttttcatagtaccttgtatgcacaggaggcacccaataaatacctgttgagtgaatagttctattgtctttattaaaagaaaaagatttttggccaggtgccgtggctcacgcctgtaatcccagcactttgggaggccaaggcgggcggatcacgaggtcaggagatcgagaccatcctggctaacacggtgaaacccgtctctactaaaaacacaaaaaattagccgggcgtggtggcgggcgcctgtaatcccagctactcgggaggctgaggcaggagaatggcgtgaacccaggaggcagagcttgcagtgagccgagatcgcgccactgcactccagcctgggcgacagagcgagactccgtctcaaaaaaaaaaaaaaaaaagaaagaaaaagatttttactacttccctaatattttgtgacctgaaccccttttgctccctgggatacatttgctttattagtctaaaattatttttttttaaaagatacatggtagatgaatttttatcatttttaagtatcaagttcctcctccctggtaacaccagttatatggggtcatctctcctacctatagaggttgatggacagagtcagaattctggcattattaaagcaattgtatttaccaaagttaattagacttgtttttcctactggagttagcgaacaacaaagtgcttctttgttgtgtttatatcttcaactgtttcattaccctactgtctgcctttatggcctttgtactcaaagaagcatttattaatgtactaatagcactgacaattcctttcttaaagaccattctctccccttccttgggatgtcattgccattatccagggtaatgaaacccatcctgtttccacttagccctagagagtgtcatgattcaggtatttgaccagctagtgatatatagacatgtgtcacttaacaaaaggactatgtttgagaaatgtgttagttgggcttttgtgtgaacaaagagtttacttaaacagatggtacagcctactacacacctaggctatttggtagaacctgttgcctctaggtaggctacacacctgtacagcatgttactgtccttaaatactgtatagacaaatgtaacacaatggtatttgtgtatctaaacatagaaaaggtacagtaaaaatacatatcaaagatttaaaatggtccacctgtgtagggcacttaccatgaatggagcttgcaggactggaaattgctgtgagtgagtcagtgactggtgagtgaatgtgaagaaccaggacattgctgtataccatggtggactttagaaacactgtatacttaggctacatgaaatttctgaaaaaatatttttctttcttcaaaaataaattaaccttagcttcctgtaacttttttacttaaacttttgaattatttttaactttttgactcttgtactaacacttggcttaaaacacaagcaaggctgggcacggtggctcacacccataatatgcagcactttgggaagccggacaagaggattgcttgagaccagcctgggcaacacagcgagaccttatctctgaaaaaaattttttttaattagttgggtatggtggtgcacacctgtggtcctagctactggggaggctgagtgagggggatgggagtgtttgagaccaggagttccaggatgcagtaagctatgatcacaccactgtactccagcctgggcaacagtgagaccctgtctcttcaaaaatgaaacaagtccagtgtcagagtctggggaagaggctgcaggcaccatgtccattttcacagatggcaggaagaagcccctgaaacagcccaagaagcaggccaaggagatggatggggaagataaggttggttttttgttgtttttgtttgtttgtttgtttgtttgtttttgagacagagtctcactctgtcgccaggctggagtgcagtggcgtgatactggctcactgcaccctccgcctcctgggttcaagcaattctcctgcctcagcctcccgagtagctggggttacaggcgcgcaccaccatgcccagctaatttttgtatttttagtagagacgggatttcaccatgttggccaggatggtctcgatctcttgacctcatgatccgcccatctcagcctcccaaagtgctagaattacaggcatgagccaccacgcccggctggaagatacattttttaaacaaaaagaggagcagaagaaactggaggagctgaaagtgaaggccatggggaaggggcccctggtcataggtggaattaagaaatccggcaaaaaataagctgttccatgtgcctgaggtgatcgatggtgacccttgattccatttgtatttaaacatctggattccctgctataactttttttttttttttctttgagatggactctcactcttttgtccaggctggagtgcagtggtgccatcttggctcactgcaacctccacctgctggattcaagcaattctcctgcctcagccccctgagtagttgggattacaggtgcccaccaccatgcctggctaatttttgtattttcagtagagaaggggtttcaccatgttggacaggctggtcttgaactcctgacctcaggtgatccgtccgcctcggcctcccaaagtgctgagattacaggtgtgagctgccacacccggccccctgctataacatcttttgccacctatacttagaatgaagtgttgtcttggagcctgttgtacattgtacatgtaagagtaaacttttgaaaacaaatcaaaacacacacagacacattgtacagctatataattttttttttttaagagtcagagagtctcactgtcacccaggctggagtgcagtggctccatcatagctcactgcagccttgaactccaaggctcaagggatccgtccacctcagcctctgcactagctaggacataggcgtgcaccactacacccagctaattcgttgttgttgttttgagacagggtctctctttgttgcccaggctggtctccaactcttgacctcaagcagtcctcccaccttggcctcccaaagtgctagaattacaggcataagccacctcggacctaatctattttctttctttatatcctatcctataagtttttttccatttaaattttttttaactttttaaacttttttttgttaaaaactaaaacacaaacatattattctaggcccacacaggttcaggatcatcaagatgtcattaggtgataggaatgtttcagctccattataatcttaggggaccacctgtcatttatgcattcattcattgactgaaaggtcattatgtggcaattgtcaagtgcctgtattatctgggtccagttcacagcctctgctgcagtccttgcttttcctgctcttggttggattgagcagtgtctctcctaggaagagttgctataatacattttgagaaacactgcacctaggcagatgatccctgtgaccttgacgatttagttaacttttccatgttcccatttcctcattttaaaatggaaataggcttttctgtagggatttttttaaaaaggaaatactagtgcacaatttaattaacttttccatgttcccatttcctctttttaaaatggaaataggcttttctgtggggattttaaaaaaaggaaacattaaagccgaattagtactagttcccctttacctcttgaaaatactgcaaatcaaatttttcaggatacgtgaaggagctgaagtgcttcacactatggtgagttggggtttttttttgagacagtcttcctctgttgcccagtctggagtgtggtggcacaatctcggctcactgaaacctccacctcccaggttcaagcgcttctcgtgcctcaacctcccgagtatctcggactacaggcgcacgtcaccatgcttgactaatttttgtatttttagtagaggcagggtttcaccatgttggccaggctgttaccagacttttggcctcaagtgatcctctcgcctcggcctcccaatgtgttgggataacaggctcgagcagtgcccctagcttgtggtgaatttttaatacaggtgagcatttctgatttaaatgatcaaaaatatcttcaaaaaaataaaaatgggcctgacatggtggctcacaccggcactttgggaggctgaggtgggaggatcacttgaagccagaaaatagagaccaagcctgggcaataaagcaagacctggtctctacaaaaacaattttttaaaaattacctaggcatggtggtgtagacctgtggtcctagcttctcaggaggctgggtgggtggattgtttgagcccaggatgttgaggctgcagtgagctatgatcatgccactgcattctagcctaggcaacagagtgagaccccatcccttaaaaaaaaaattctcttttgccctttcttttccctgcctcattaggtcctataacctcctaattacccaactttcagcattctgatgtgcaggggtctcttggggaagataaattaacatcaaatacatctgtgtttctctcccttctttcctcctcacagggttcctttatttatctccttactgaagattttttttttttttgagacctagtcttgctctgtcacccaggctggagtgcaatggcatgatcttggctcactacagcctctgcctcccgggttcaagcaattctcctgcctcagccttccgagtagctgggattacaggcatgggccaccatgcccagctcatttttgtattttttagtagagatggggttttgccatgttggccaggctagtctcaaactcctgacctcaggcgatgcacccaccttggcctcccaaagtgctgggatgacaggagttgggcaccatgcccagccgaagattttttaaaatttatttcttaaaacagggtcttactctgttgcccaggctggagtgcagtggcacggtcagtcatagcccgctgcagcctcaacctgggctcacacaatccttctgcttcagcctccagcatagctgggacaacaggcatgcaccaccatgcccaaccaattaaaaaaaaaatgttgtagatactgggtctcgttttattgcctatgctggtcttgaactcctgacttcaagcagtcctcccacctcagccaaccaaagtgctaggattacagttgtgagcactgtgctcagccaggaaaaacttatgaatcttttcttttattaaaaaaaaaaatagcctacgatcacttggaaaaaactcttcagaatttatggatgacctaaataaagcccctggctctttatttttgcaactgaaaagggccagctaaaatcaggtctgtgcctggaatcagctttcctgattcctgaccattctagtttctcatgatttccctcttttctctaaaggaatccatagattctctaaagcttccattttctcacagtggcttcctaaccagtagatgtgggggaggagaaaaggaaagagcgcagagatgagtttgccagttcagtcaactccatttttctttttttgtggtttgttttaattttatttttattttttgattattttatttataaataatagagatgggctagccgggcatggtggctcatgcctgtaatcccggcactttggaaggctgaggtgggtggatcacttggtcgggagttcaagaccagcctggccaacatggtgaaacctcatctctactaaaaatacaaaaattagccaggtgtggtggtgtgcgcctgtaatcccagctactctggaggctgaggcaggagaattgcttgagcccaggaggcagaggttgcagtgagttgagattgcgccactgcactccagcctggacgacagagcgatactctgtctcaaaaattaaaaaaaaaaaaaaaatacagatgggatctcgctctgttggccaggttggtcttaaacacctggcctcagcctcccaaagtgctaagattacaggcttgagccaccatacctgtttttttgttttgttttgttttgttttaaagagtctccctgcgttgccaaggcctcgagtgcagtagcgtgctcatatctcactacagccttgatatcctgggctctagtgatcctcccgcctcagcctcctgagtagctgggactataggcatgctactgcatccagctaactccccttttttcatgaacaatttcaaacatgtagaaaagtaggaagagtagtacaataagtgccatatattacctcctagactcagtcattgtttaacgtattcatatttgctttgagtgtgtgtatatataattttgctggaccatttgaaagtaaattgcagttattgtggcatttcaccactcagcatgcagctcctaagaccaagcatattaggagctgatacgttaatgagggagcttttatgtgaaactattaatattaagcaggtaatacaaaggagcctcagctctttcagttctatgagatggtcttttggagaagagagaagacagggaagagattccacagtggagcacggactgggggaagatgagtaaaggcttggaattgagaatcctagatataatgtgttttgggggacagtgaaggcacctgccttcaggaatgaaggactgatgtttgcacgtagggggaggtgagaaggatgggtggagggagtcagttacaaatgaagcgggggacttgattctgtaggtcttcaaacatttttattgtgcaactgtcagaatttctttagcacaatcccccatacatatttatttatattttataagtgtaatgtataaattatgtatttcaaggaactgaccaactcttactacctgcactgctgccagcctgatccacttggattatgtaattcctctcaactgctttctctgctttctttttgccccgcttcccccagtctctttcatcccagcagagagatcccttagaattggaatcagattttgtcagtcctctcctcaaatccctccaaataactgcccttttctttccttcttcctttatttttctttctttccttctttcttctttctgtctgtctttctgtctttctttctctctctctcttttctttctttcttttttattttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaatttttttgtattttcagtagagacggggtttcaccgtgttagccaggatggtctcgatctcttgacctcgtgatctgcccgcctcggcctcccaaagtgccgggattgcaggcgtgagccactgcgcccggccataacttcccttttcactcagagtcaaagccttttaagagtgaaagtcctttcagaggccacatggtacctctttgacctcacctttccccaggctccttgctctgtgtcagccacacagaccccttcctctttgaactccaggtaccctctcaccccctgcctttgacattacttctgcctggaacactccgtcaccttgttcaggtctgcactgagacgccacctcctcagcaaggcttttcctgaccatcctctaaaattgcaaccacaatctccaacccctggtagaccccgtctccctttcctgtcttattttcctccatcagcacttactgaccatctggcatatataggtagataattgttgtttgttgtgtgttcatcttgtttgttgtctatctatgccagtagcacgtgagcttcatgaggcagtggttttttttgtttatttatttatttttttgagatggagtcttgctctgtcgcccatgctggagtgcaatagcgcaatctcggctcactgcaacgtctgcctcccaagttcaagtgattcttctgcctcagcctcctgagcagctgggattacaggcgagcaccaccacgcccagctaatttttttgtatttttagtagagatggggtttcatcatattggtcaggctggtctcgaactcctgacctcttgatccgcctgcctcggcctcctaaagtgctgggatcacaggcgtgagccaccacgcccggccacaaggcagtggtttttatctgttttgtttcctgttctctcctcagaccctaatacatatactggacattcagtgagtgaaaatctgttgaacgagtaaatgaatgtgccaatatattaaccaaagaaaatacacacacagtggctcatgcctgtaatcccagcactttgggaagcataggtaggtggattacttgaggccaggagtttgagaacagcctggacaacatggcaaaaccccatctctactaaaaatacaaaaattagccgggcatggtggtgcatgcccataatctcagctacttgggctgaggcaggagaatcgcttgaacctgagaggcggagtttgcaatgagccaagattgtgccactgcactccagcctggatgacagagtgagactctgtctcaaaaaacaaaaaagacacacagaacttctaaaggatgagttaaaaataaagaaaaataagagttctgggccaggtgtggtggctcacaccagtaatcccaacactttgggaggctgaggcaggagtatcacttgaggccaggagttcaagtacaacctggtcaacatattgagaccccccccccccgaccccacctctccaaaaaaaattaaaaatattagccaggcctggttgtgtacaccagtagtcctagctgctcaggaagctgaggcagaaggatcagttgagccgaggagttggaggttacagggagctatgatcatgccactgcactctagcctgggcgacagagaccctgtctcttaaaaaaacaggagttataatatttggttcccaagttctaggaaatgctcttgctcttcttagggcgtggacatgcctcttggaaaccaaatgatggatgatggaggggggacatcaaaaggtcttaagtagagaatcctggtgattgtttatagaatgaaggagaaggagaaaagtttgaatctgccagcagttaagccaggagaactgggtgaattttgttgctgacagtgggaatgggaaggaggaaatacacatggggagagatgctttaaactataaatccacagtatttggtgactgtggaggtgcagagaaggcatggacaaaagatgatggatgtgagggtgggtcggttgggtgaaaatggcagagcttcttctgaggagtaggagattcagaaggggagcttttagaaaagagatgggaagagaacagcatgaactgaggtttagaaatgttgaaattctgctgatgagagatcaaagtgtaactttttcagacatgaatggagattgggagagctcatcgctggagagtcatatttttagaagtacagtgttaatttcattacagagaatactaccaaatagggtaattacttagttgtcaaaactaattgtcactgcggcctttcctgttcagtttcagataaatttggattggacagctacactgtggcatcagcacatatctctttaaatacaaatgtttaattacataaacttttcccaggtgtaccctgggcacaccgcagtttgctggatatttgagcaaatacagatccaatttcttggtgtgcaatccatgccagtttgataatctggaaaggggacttaaaccattctgtgatgtttgcatagtttgctagttatttaatgacatttgcatttttttttttttttagagttatcattaccatgttggtgacctgttcagtttgctgctatctcttgtaagtaattttttcttaagtaattattcttggtatttgtagtgtgtgcgatttacacatttgttttattggagctcatccctcatgtaatatctagaaatagtgtcctaaaattgaaaatatcacacttttcatatgctcagtatatttatgtagagttgtacagatactctatccttctgggaatacaacttctgtttaattggcacaaatgttaaagcttataagtagctggaaattatgattatactactttatattttactatggtgaagtatttacttatttatttatcttttgagacaaggtcccgctctgtcgcccaggctgcagtgcagtggtgtgatctcagctcactgcaacctcggcctcctgggttcaagtgagtctcatgcctcagctacctaaatggctggggttacaggcacacgccgccatgcatggctaatttttgtatttttagtggagacgggtttgccatgttggccaggctggtctcaaactcctgacctcaagtgatccgcctgccttagcctcccaaagtgctgggattacaggcatgagccactgtgcccggtatactattgtgaagtatttagatctacttattttactgaaatatctcactaatggagctaataaagctattctttactgtgacttttgtttatctgatggacagaaattgagctagaattataaccaagtagactaaggataattttttaacaattcattgtaagctgtatcaaaatatatgtattgatcacataccataaaaataatcctaaggatttctttcaatttaggtttttgagacagggtcttgctctgtcacccaggctggaatggctcaatcatagctcactgcagcctcaaactcttaggctcaggcgatcctcctgcctctgcctcccaagtagttgggactatagtcatgcgccaccatgctcagctaacttttttatttttgtagagatggagtcttactgtgttacccaggctggtcttgaactcctggcctcagtgatccttccatcttaagcctcccaaagtgctaggattacaggcatgagtcactacacccagccaggatttctttctagagtttagaaccagtgattctctttttttgaagagaactttctagcttcctgagacttcagagacatggaaagtgttggtgttcacagaagtgctgtttagtgcccatgtaaggtaggaagcaacagttctgacccatcctatagatgaaagaccatgacttttttttccagaaacattttaataaaaattggccatttccaagaaacacccactgcatgcccgttaataaaagaggaccataacaaaatagaaaatttaccatatagctgtgatttaaaatagctgtgatttaaagagaaaatgtggacacaagcacatcagcaaagtccagtattaaagtcacattccggccaggatcggtggctcatgcctgtaatcccagcactttgggaggccgaggcgggtggatcaccaggtcaggatattgagaccagcctggccaacatggtgaaacccattctctattaaaaatacaaaaaaaaattagctgggcttggtggcgcacacctgtagtcccagctgctcgggaggctgaggcaggagaatcacttgaaccctggaggcagaggttgcagtgagccgagattgcaccactgcactccagcctgggcgacagagcgagactccgcctcaaaaaaaaaaaaaatacatacatacatacatacatacataaagtcacattccttcttatgggctatgattaggaatctgatcagatatcagagtaaaaatacaaatgctgaactatttaggtcaaagaacctctatagaagcatctgtcttcaaaggcattccaatttgagatcaattttagaataaggcataacacatatgttaacagaagacatacaaggtgatgaaagagggattctacaattccccacatactctgaacctaataaaacaaatccagatttttaaaaaattacttttctttaaacaattgccaagactgaaatcaaagagaaatagaaggcacaacaattttgctctggttgttatctgggtttggggaattttttcttttttttttttttcaaatacaaattaaacatgaaaaaactctatttcaaataaactaacagttcaagaaaagcctatcagttgcattccagacatttaaaacctatatcgcagtttaaatttcagtggtaaaaacagtaggttttagaattgttttgtgatcctatatcaaaagaaaaattctattcctttaattcagtttttaaacataccagtgagaatcaaaattgtcaaattttccaatgacaaattctccacaccagaaggtagtcatgactctcaaagaagaaacaatttgggtttttcctgccttcaaaatgttatcaagtcctgtatttctcacaggtttttgaaacacgtagaaaacaagaaatattccgatgaatgaaatataccaaatgtcagtaatatgcaagacacattcctttggggaaatggctgttaaaaaaaaaatccagtctgtatatgcaaagtaagcaaggaaattcagtctttttttttcttcttcttctttaaaaatctgttactcctaaaatatcattccacaaaattggaagtgaaagactaaaggtcaggggcaaggcgtggtggctcacgcctgtaatcccagcactttgggaggccgaggcgggcggatcacgaggtcaggagatcgagaccatcctggctaacacagtgaaaccccgtctctactaaaaatacaaaaaaaaatttagccgagcgtggtggtgggtgcctgtagtcccagctacttgggaggttgaggcaggagaatggcgtgaaccccggaggcggagcttgcagtgagccgagattgcaccactgcactccagtctgggcgacagagcgagactccgtctcaaaaaaaaaaaaaaaagttctaggccgggcatggtggctcacgcctgtaatcccaccactttgggaagctgaggcgggcagatcacttgagcccgggagttcaagaccagcctgagcaacatgttgaaaccctttctctacaaaaaattatccgattgtggtggcacatgcctgtcgtcccagctaccgggaaggtggaggtgtgaggatcacctgagcccggggaagtcaaggctacagtgagctgtcattgcggcagtgcattccagcctgggggtccaagtgataccctgtctcaaaaaaaaaaaagttgtgataaatgatgttgtttgactgtttaaacactaaggcccagctgatgaaacttaaaatttagtctttttttttttttttttttttggttagagtgttaaaagaagcttgttcaggtgataacttagcctccagagtggaacacaggttgcatgtggagggaattcttatcactgtgtttggctgtaaagagtatatgaagcctggtgtggtggctcacgcctgtaatcccagcactctgggaggccaaggcgggaagatcacctgaggttacaagttcaaggccaacctagccaacatggtgaaaccccatcaatactaaaaaaaatttttaaaattagctgcgcgtgatggtacgcacctgtagtcccagctacttgggaggctgaggcaggagaattgcttgaacccgggaggtggatgttgcagtgagccaagatcgctccactgcatccagcctaggcatcagagtgagactccatcttaaaaaaaaaaaaaaaaaaaagagtaaatgagggcaaatacatgtatcatcaagaactgattttagtacgatggttgaccatcagcctatcctactgaatcgcctatggaaatcagtaagggagcgccatatcaatccaggtgtcaaggattggtctgtcattgaaaaggcctttgtttttattgctttgaagatctctgcaatgtgagcagtaaggtcagtggtggtaccttataaaagggaaaatgggggccgggcgtgttggcttatgcctgtattcccagcactttgggaggctgaggcaggcggatcacaaggtcaggagttcgaaactcctggccaacacggtgaaaccccatctctactaataatacaaaattagccccatgtggtggcgggcacctataatcccagctactaaggaggctgaggcaggagaatcacttgaaactgggaggcagaggttgcagtgagccgagattgtgccattgcactccagcctggacaacaagtctccatctcaggagggaaaaaaaagggggtcgggggaatgagttcacagaggaatgacttgagatttaaacccaaaaagcaccaaaatattttgtgacttcctggttctccatagtctttgaaatgtgtttaattttcatgatatttaaaacaaaagaaaacaaaaacgtttccagtcagtctcatgtcttgtatttccacttttttttttttctttctggacacacagtcttgctctgtcacccaggctggagtgcattggcactaccatagttcactgcagcctcaaactcctgggctgaagcaatcttcctgcctcagcctcctgagtagctgggactacagacatacaccaccacacctggctaattttttaaatttttagtagatgaggtcctgctatgtttgttgcccaggctagtcttgaactcctgagctcaagcagtcttctcacctcagccttccaaagtgctaggattacaggcgtgagccaccacgcccagtcatatttccactttcaagtataaaatgaataattggatttgagcccttgcctcttgctgtctagacattagtccattttttcctttgttcccaaattctggtgacttctctactgacagtggatcagcactgttagtggtgtattaataaaggtggtacacagtgttccaacattaaatgcttctggaggccattttatggggaaatcagctggatagtattgactttatgaaatcatttttcttttgtttctttgaaatctgatcatacatcctatttagcatgatatctgagtgaaaaatgtggacggaattcaaaccccaaatattttacacaccttattccacaaaagagtgagattctattaaaaaaattgaaattcaaaggaaatttcactgtttggcactggtacattttcttgaaaatgccccttttcaagtaaggcacacccaaagagactttggctttcaaagtcatgttttgaaatgcattcatggacttttaaattgccttctgtttgttgcagttttttctggtgccagtttgttctagtttaaagtttgattccgtgaggctcaacttgtttgagctctgtataaattaggttctctgccagtagaatccagtttctgttaatagttcagcagaggaaaatctgaatgttatatctggttccctctttaaggcacaagatcacttttgtctcttaaacatacaatcttgttaagttactatactatatttctggtcttaggttaatttttaatgttgaattatattgttgtttactcagagtcaccaagctcacatgaaattagaaatgtaatgtattgtgaagacacagttgtttcttggaaaacatgctgtgtcttagcacctgactaactgtaaatcttactggcatcatgatataggaaaataaatactatctaagaatcacgagacctaggttcttttaggcaaaaggatacttggcacgattatgttgtagggtggttttgtgagttttaagtaagatgctgtgtgtgaaaacttagagtaaagcacaataaaaatcaaagtaatattatcagtgatttttttttttttttttgagatagagtctcactctgtcgaccaggctggagtgcagtggcgagatctcagctcactgcaacctccacctcccaggttcaagtgattctcctacctcagcctcctgagtaggtgggactacagatgtgcgccaccatgcctggctattttttgtattgttagtaaagacagggtgtcaccttgttggccaggctggtctcgaactcctgacctcaagtgatccacccaccttggcctcccaaagtgctgggattacaggtgtgagccaccgcccctggccaatcagtgatctttaaaataagttattttaattcaaaggactgtgttatttgtaagcacagtttccttacagggctggtatagtgaatattttacttagccttattagaattcattcattcaacatatatttatttagcattagtaggcactggatctggacactactaaaaatacagaattagccgggcgtaatggcacagtgtagcagtgaataaacaaagtagacaaccccctgtcctctttaataaggagaagcagataaaacaaatcaagagccagagaggcccgatcactcccctcattgcccttcattcacttcccaaacaggttcccccatccactcatttccacaaatacctactcagttatgacctcagaagattcccctttactcattctttagcccccgttgctgtccatcacacagggacctgcacagcccacagaaactccacctcacatgtctcggaatttgcaaatccagagctgagcctcacctccctcactggcctttctgggtcctggctctagagctagtttgagcacaggacataatcacttcccaggggcctgggtgcaccgctttggtttccaaccaagtaaccacacgtggtggctcacgcctgtaatcgcagcactttggctgattggtttcagggctgctatttactttaacatgtatttcctttttaaactttctggttttgagctttttttttttttcttttcccccgagacggagtttcactcttgttgtccaggctagagtgcaatggctggatctcagctcactgcaacctctgccacccagtttcaagtgattctcttgcctcagcctcccgagtaactgggattacaggcatgtgccaccacgcctggcttattttgtgtttttagtagggatgaggtttctccatgttggtcaggctagtctcgaactcctgccctcaggtgatccacctgccttggcctcccaaaggttttcagctttttaaacatactattttctctctataaaagtagaaaggttaggataatgaaccttcatttgcttaccacccaccttcaaaaatgatcaactcatggccaatcgtgttttatccccacacttttcctctccaccccagattattctgaaacaaatcccagacatatcagttcatctgtaaacatttcaatatgtgtctctaaattttaaaagtacaaccacaataccattatgcacaaaaaacttaattcctttatatcatcaaatatcctatcatatttaaatttccgtaattgtctcattattttacagcttgctggaatcaaggtccacataaagaccacacgtagcaattggtgaatgtctctcaaatttctctttataggcttcttctccatatctttctcttttttcttggaaattttaatagaaaaactgggttgtttgccctttaatgttgcagtctggtctttgttaattgcatactcatggtggtaacacgttcttctgtattttctatgaattggtagccatatctagaggctgatcagatttagcttcaattttttgaccagtctccttcataagtggtgttgagtacttccaagaggggtacataatgtctgatttttctttgtattattggccatcatttatgatattctgtttctgtaatttcttattcactaattagctagactatatccaaaatagaagccaagtctggtggctcatgcctgtaatctcagcactttgggaagctgaggcaggagaattgcttgaggccaggagtatgagaccagcctgggcaacatggtgaaaccctgtgtctgaggaggaatcagccatagggaaattggagggagggctttctgcaaatgtaaaggcactgaggggtaaagagcttgggatagccggggacaggggtatcccacctgtagtcccagctacttgggaggctaaagcagaaggatcgcttgggctcaggagttttgagaccagcctgggcaacacagcaaggccctgtcccttttttctttcttttttttaagtagcttggaatgttctggcagggtaatgttgggcttaatagtgaggtggggagtggtaggttcagagtttatgtaaggcccaggccaggtgggattttatgctgtgcaggtccttgtgtgattgacagcagcagggggctgaaggataagtgagggggaatcttccgaggtcataactgaataggtatttgtggcaacaagtggatgggggaaactgggaagtgaatgaaggggctgtgaggggagtgattgggcctctctggctcttgatttgtttactatctgcttctcctcattaaagaggacatggaggttgtctgatttgttaattcattgctacacatctagtgcccagatccagtgtctgctgacactaaataaggagtttgggtttcatgttaagtgaataggagatgctttaagatttttaatgaaggagtggtgtgaatgggatgatcactctggctgctctgtggagaacagactgtttggcggggagaatggaagcaggaacacccgtcaggaagtgactgcatgcatgccagtgagagatcaccatggtttggtctgaggtgaagagaggcacacagatttgagagcaaatttggcaggtagaatttattggtcgtactgatggattagatgtaggaagaatcagagatggctcccagttctaggttgggccatttactaagatgatcctgacttgggacaggatgaatttgaagagagattcaactggtacatgctaattaggactgagatggccataagatgcccaagagttgtcaaacaggaacttagctaaagcagagagatttgaggccatgagaacacatagaattacctaaggcagtggttctttgctggggttgctgctggcatccagggatagaggccagggatgctgctgaacatcctgtactgcacaggacagcctcactttcccctagtgaagaattatgcagcccaaaatttcaatagtgctgaggttgagaaacccagcactaagggaaggggtaggagagaaaagtaaagaaaagatccgaccaaacctgaggaatgccaacattttgatgttgtgtagatgaggaagagtcagaaaagggcaaccttgagcctcctttggtgaataagggtggtgcctgggaaagcatggagggatcaggctggtgatcagcaagcttgcacttcatttgcctaaggacatgcagttgcacttctttagagtcagcttttcacaaggttgggtgaaaattgttaggaggcagcacaaggggagcaaagatgttactaaccccagtcgccaaagcctgaggtatctggcctgtaaacataagcagtcttctctgcttcagagagcctggtgagaagggatgggaagctgggtttcagttaagctagagggaaagtgctggaagaggaggtacgtgaacaagtagcagataattgagcaagagttacagagaacacagtggaaggatttggaagaaaggggaagatttggaagaaaagaaagggatgcaccattgttacatcaaatagtgagatgagtgcggagcagtctggggatggggtcataatagatggtcctgggaggtttcaaatgccggtaaaaattgagataaggaaagatatgagacctgttgaacttagtttttatattccgttattaggcgagaactgggacctgaaggctttccacaatagcttggcaggggagagggttttggcagttaggcatgactgcttctgaaggttgtaggcactaaaatggtacaggtcatgccttgtttttgtttttctgttttgttttgctttgttttcccaatatagacatccagttgttgctgcaccagcttttgaaaatcctttctccgtgaaattgctttggcattttcatctaaaattagtgactatatcttatgagtctggctctggattgcctcttctgttcattgatctctttgtctggccttatgataatatactgtcttgagtattgcagagttatgttaaaatcagaaagtgtgagtcctccatctttgtgcttcaagattgttttggttattctaaaatagccacatatattttaaaatcaactaggcagtttctacgaaaaaaaaaaaaacctgttgggattttaattgggattgtgttgaatatatcaatttgaagagaactgacatcttaatgatgttgagttttctaatctcactggtatctccatgtccagcctcatgggatctcttcatttatttaggttttcttttgtttctttcacaaatgttttgtaatttttggtgcagagatctcacatgtctcttggatttttggggttttcgttttttaatagagatggcattttgccatgttgcccaggatggtctcgatctcctgggctcaaacgatctgcctgccttggcctcccaaagtgctagcattacaggcatgagccactgcacctagtatgtctcttgttattttaatatatcaagtattttaatgtaatttttgatgctcttttaatgaagcagttaggaatttatcaattttattaatcttttcaaataatcaaaattttatcttggttactttcctgtatctttttgtccttctcattgacatctgcacgttattatttcttccttcttactttggatttaatttcgtcttttctagtgtaagcatttaatacaataaaattccccctaagcactgcttcagtgatatcccacaaattttgataaagtgtattttcattttactccatttgaaatattttctaatttcttttgtaatttcttagaccaattggttattcagaattgtggtgtttaatttctaaatatctggtgctgttccagatgtcttcttactgttaattgatttctcatttaattccatgtggtcagaagatatactctctaagatttcagtcttttgagattgggacttattttatgcgtgtggactatcttgacaaccatttgtgtgcagttgaaaagaatctatattctgaagttgttggttgtagtattctatatcaggtcaagatggttcaaattttctatgtccttattgtggtttttttttgtttgttttttatctactacttttaattatgaaaagagggatgctaaaaatcaccagctatgattgtggattttcctgtttctccctttctttcctcttgaattctgattgatttatccttaattcaagatataaccctttaggatcctagtttttggagggggtgaaggttttattaaactctactctgggccgggcacgatggctcacgcctgtaatcccagcactttgggaggctgaggcaggtggatcatgaggtcaggagatcgagaccatcctggctaacacggtgaaactccgtctctactaaaaatacaaaaaattagccaggcgtggtggtgggcgcctgtagtcccagcgactcgggaggctgaggcaggagaatggcgtgaacccgggaggcggaggtcgcaggcagtgagccgagatggcgacactgcactccagcctgggtgacagagtgagactccatctcaaacaaacaaacaaacaaacaaacactctactctggatgggccttgggccttgtccactgtttgctgtgccctgtgagatctgtaaacagaagctcaagtccgtgttgtttgttacatacatttaagctatagaaagcaacctatggtcaccttcctctctgagtacctgccttcatttgggttttgggggttttttttggcctgagaattgtttgaatttcttatggatacatttgagatgtttgtttgtaggggaagggaagggaaatctaggcagctggcccagcatattacttgctatatggaaaagtttatttttcttagtctgactttataattgtttcctttataatttggcagataagaggaattttagactttgagctggaaggtctggtgtagaaaataagtatggagagaaaaaaggaaaggtatttcaagtttagaattggcaaaaatagggtatattcctttggtagtgaaatagccataggttggcattaagttaatggaaaacatgtttatgactttttttatttttattgagatgaggtctcgccatgttgcccaggctggtcttgaactcctgagctcaagcattctgcccatctcggcctcccaaaatgctgggattacaagcatgagccaccgcagctggtcatgtttatgacttctaatctgaagcttggcctcctcttccaagctctcgtggctgtcagaattcagttctatgtgcttatagaactgagatggcagtttccttgctggctattagttgggaccactgtcagctcctagaggccaccttcattcctggccatatggcccctccattttcacagccgggaaaagagaatctcctttgtgtcaaatcatctcatcctatagcagtctggagtccaataaggagatagaaaccacagtcggttaagcaggggaagataaagaattatttttttcttttgcggattaggtagccacgtaaaccaaaataggttgagagagatttcagaattattattatggcaaaagagttactaaaagatacaaagaaactatatttggttccctaggactgagggagagtaaccaaagaacagacttggaagggattcagacctcactagacaaagtatggttgagcccaccagatagcaaaggagtttgttggtttggccagaccagggtttgcctggagtttctgggcaagcaattggcctcttctggagtacaggcagggggcgaggtcatcgggggcatggatgtagtgggagtccctgtccccatacgagcaggaggccttcaaggcatgtatgccgggcaggggctttgcttaacatgtggagagggttctgaagttattgccaggccaaggctacaagatcaaagaggtaccacgttctggcctcgagccatagtaggcttcaccagaggttctcacacccactccgcgacctccggcctacgcctgaaatgtccctccagcttcctctactgagaaagcttaacagcgtgctcactttacaggagaaataaagtaattcacttgtttatcacagagcacacattgaattgcacttcatttgcctaatgttcagagctgagaggcaataaattcgtgactgaaacacacactccaaatgtctttgtaagggagagtcctgttcctttttttttcttttcttttcttttttttttttttttgagacagagtcttgctctgtcaccaggctggagtgcagtggctcaatcttggctcactgcaacgctccgcctcctgggttcaagcaagtcttctgcctcagcctctctagtagctgggactacaggtgcgtgccacactgcccagctaatttttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccagctacttgggaggctgaggcaggagaatggcatgaacccgggaggcagagcttgcagtgagcagagattgggccactgcactccagcctgggtgacagagcaagactctgtctcaaaaaaaaaaaaaaaaaaaaaaaactcaactgagggctgggtgggtgactcatgcgtgtaatcctagcactttgggaggcgaaggctggcagatcacttgaggccaggagttcgagaccagcctgggcaacatggtgaaacctcgtctctaataaaaatagaaaaatcagccaggcatggtggcatgtacctgtaatcccagctactcgggaggctgaggcacaaggatcgcttgaaccaggaaagcagaggttatggtgagccaagattgcaccactgcgctccagcctgggcaacagagcgagcctgtctcaaaaaatacaaattaaaaaaataaataaataaaataaaagaactcgcctgaagccatgcccagtggtggcacctcatgcctgcaatctcagctactcaggagactgagatgggaggattgctaaaggccaggagttcaagaccaccctgggcaacatagcaagattctcatctcaaagataaaaacaaaaattcccctgaacaggtcacattcactcaggatagccacttccctttttttttttttttttttttttgagacagagtctcgttctatcatccaggtggctggagtgcagtggtgcaatcttggctcactgcaacctctgcctcccatgttcaagtgattctcgtgcctcagcctccggagtagctgggattacaggcgtgcaccaccacgcccggctaatttttatttttagtagagacagagtttttccatgttggccaagctggtctcccaactcctgacctctggtgatccacccaccttggcctcccaaagtgctgggattacaggcgtgagccactgcgcctggcctctttttttttttttttttagatggagtcttgctctgttgcccaggctggagtgcagtggcacaatctgagctcactgcaacctctgcctcccgggttcaggcgattctcctgcctcagcctcctgagtagctgggattacaggcacgtgccaccacgcctggccaatttttgtatttttagtagagacggggtttcaccatgttggtcacgctggtctcaaactcctgacctcgtgatctgcctgccttggcctcccaaagtgctggaattacaggcgcgagccaccgtgcctgtcctggatagccactttgttaaagccagctgtatcagataatataatctaaccatggagtgactattctgtcagattcactgagttttatacagagtgtgtatactgagtggtgggaacctcgggagaattgaaatctgcctgccatagagtgggtggtcgcgggagaggaggtggagatgagaatgactcagtgctacatgagaaactcctttgtgaagtaaataggttgtatttcattctgtggcttgaatacatttttagctgtcttacagagaaagagaagaaataaccagtgtttattgaacatctatttgtcagccactgcatagagcactttacttatattatctctttaaattgtaatactataaggcaaggattattatcaccattttacaacaggagacagtgggcttggggttgtaaggacatttgcctggattcagttcaccgatatttagtgttgctggaattaaaatccgactctgtctaataccgaatcccatgttttctaggagcatctaataatgttgctcctcttgaaagtatttttatcattcagttgagatgagaggtcgttttagtggcgctagggcaaatcactttcctgcatttctgctgtctcttaaggagctcaccgacagaggtcactgctgtcatggccctggctggagggacagtggatcagaagagaggtcctggccagacttccccattccagtagggaagctgagactgctccatctgcgtgtcaccgggaagtaacctgtgcctttgttccctgttcttatatctgaatgtggaacagaagaacaaagcagggcttgagagagctgagtatagtggtgagggcatagtttatgctgggagagttctagtaaccaagagctgagctcctaagaagtggccagggagggtttatagtatgaaggcacccatgcatatctctacaaaaacatattctactactctccttggcttatttctcacagctcatgagtccctttgggttggcccctcagccatctccttttcgcatcctcagaggttgacatggaacatggcactgctaaatgattgtggaataaatgaatccctaggctgcctgatttatcttttttttttttttttttttttttgaaacagggtcttgctctgttgcccaggctagagtgcagtggcatgatcatagctcacggcagccttgacctccggccagtgatcctcccacctcagcttcctgagtagctgggactataggcatgtgccatcaagcctggctaattgaaaaaaaatttttttttatagagacggggtctcgccatgttgctcaggctggtcttgaactcataggctcaagcaatccacctgcctcagcctcccaaagtgttggaattacagacatgagccactgcacctggcctgtttcatccttaatagcctatagaaacagcctagtataatgggactcaggagtcctggattccccgcttccagcttcccccttcactaatttgctgtggggtattagtaagttcactaggacttaatttcctcatctttaaaatgcagaacttagacttgatctcagatccattccggctctgcagttctctgaagacattattgcaccatagctgcctcaattgtttgaataatctcagattggttattaaggctggccctcaggttatgaagacatgcggtacagttcgggcaaacatgaaaggtacatttagttccttttcttgtacacatgaagtaatagattcattggaatatgatctcttcctccacccacttccatcaattcagagtggattttttttcccttccagttctctgcgtgtttgtcagctttaaagggaaattttaagtcaggaggtagtcagaggggcaggcacaaagctcagcgggttaggggggtaaattcctctgaaatttcaaataaaccagactagactgtttcctaggtaaatttttttttttttttttgagtcttgctgtgtcacccaggctggagtgcagtggcccgatctcagctcactgcaacctctgcctcccaggttcaagtgattctcctgcctcagcctcccgagtagctgctactacatccatgtgctactgtgcctggctgatttttatatttttagtagagatagtgtttccccatattggccaggctggtcttggactcctgacctcaggtgatccgcccgccttggcctctggagttttcttgaactgtggtttcttgttttttttttcttaagtgagatgtgtgcgtgtgtgtgtacatgcatatgtgtatgcatgtgtactttgataaccatatacagaagagtgaaattgaaccctttctgtcaccatatacaaaagtcaactcaggatgggttaaagatttaaacgaggccgggcatggtggctcacgcctttaatcccagcactttgggaggccaaggcgggcagatcacctgaggtcgggattttgagaccagcctgaccaatacgcagaaaccccatctctactaaaaatacaaaaaattagctgggcatggtggcgcatgcctgtaatcccagctactcaagagactgaggcaggagaatcgcttgaacctgggagatgaaggttgccatgagctgagatcgcgtgccattccactccaggctgggcaatgagtgaaactccatctcaaaaaaaaaaaaaagaaaagatttaaacataagacctgaaattataaaacagctagaagcaaacatagggacaactcttcagagcattggtctaggcaaaagttttatgactaagacctcaaaagcacaggcaacaggctgggtgtagtggctcacacctgtaatcccagcactttgggaggttgaggtgggaggatcagttgagcccaggaattcgagaccagcttaggcagcataatgagaccctgtctctacaaaaaatttaaaaaattagccaagcctggtggcacgtgcttgtggtccaagctactcaggcggctgaggtaggaggattgcttaagtccaggagcctgggagatcaaggctgcaatgagctgtgattgcgccactccagtccagcctgggcaacagagcaagacacttgtgttaaaaaaaagaaaaaaaggcacagtcaacaaaaactaaaatagacaaatgggactatattaaactaaaaagctctgcacagcaaaagaaacaatagaataaagagacaacttggccgggcgcggtggctcacgcctgtaatcccagcactttgggaggccgaggcgggtgaatcacgaggtcaggagatcgagaccatcctggctaacatggtgaaaccccgtctctactaaaaatacaaaaaattaaccaggcgtagtggtgggcgcctgtagtcccagctactccggaggctgaggcaggagaatggcgtgaacccggcaggcggagcttgcagtgagctgagattgcgccactgcactccagcctgggcgacagagccagactccatctcaaaaaaaaaaaaaaaaaaaaagagacaacttgttgaatgggagaaaatatttgcaaactacccaactgacaggggactaagatccagaatatataaggacctcaaacaacttaacagttaaacaaataatcctattgagaaatggacaaaggacatgactagatatttctcaaaagaagacattacaaatggccagcagtgctcaatattattaatcactagggaaatgcaattcaaaactacaatgagatatcatctcactccagttagaatggctattactaaaaagcgaaaatatggccatgcatggtggctcatgcctataatcccagcactttgggaagccaaggcaggtggatcatctgagattaggagtttgagaccagcctggccaaccatgttcaacatggtggaaccccatctccactaagaattaaaaaattagctgggtgtggtggtaggttgtaatcccagctactcctgaggctgaggcaggagaatcacttcaacccgggaggtagaggttgcagtgagccaagatcgtgccactgcactccagcctgggccgtaaagggagactccatcttaaaaaaaaaaaaaaaaaaaagccaaaaaataacagatgccagcaaggatgcagagaaaaggaaacttttatacactgttagtgagaatgtaaattagtatagaaaatggtatggagtatagaaaccagtatagaaaatggtatggagatttttcaaaaaactaaaaatagaactgccatatgatccagcattcccgctactgggtatttatccagtggtagagaaatcagtatatataaaaggtatacctgcactctcgcatgttgatcgcagtgctgttcacagtagcagagacagagaatcaatctaagtgtctgtcaacagatgaacgcatgcagaaaatgtgttatatgtacactacggaatagtattcagccataaaaaaagaatgaaatcatgtcatttgcagcatcatgggaggaactagaggccattatcttaagtgaaataagccaagtgcagaaagacaaatatcacatgttctcacttatatgtgggagctaaaaaatttgatgtcaaagacatgaagagtagaatgatagatatgagagactgggaaggaaggaaagttgtgggaataaagagtagcacaatgggtacaaacatgtggggtacccgtaaaatgggcacaaacattaaacagaggaaataagtttcttctatgtttgattgcaaaatagggtgactatactcagcaacagtactttgtgtatttcatactaacgggaagcgaggacttgaaatgataccaacacagagaaatggtaaatacgaagaaaaaacagtttctaaatactgacctgaccaagaaaggggtcttcattctttcttctggatattctttagtgaaggcaccaaaggcttgtgttgaacttaatcagtgctcagtggatggattctcattttctgaattctcaatttagatttagctaaattaatgccttctgaaatgttctcagttaaaatattccagaaggtcactttttgaagtgggaacagtaatctgatctgattcctggtctaggatctactactacctaattagcattgtgaccataggccaatcacttagactctctctgcctgtttcctagtacaagaattaaatgaaaggttatatgtgaaattgtgatattgtgaaatacaaatttagtctttgttcccatttcctggtatacaactcctaaaatccttagaatctccaaagtgacatgtgtctttgtatgctaatgagttgactgatgattggcagccccttggtagctccaggatgggatctaatcacgaaccaaggaaggattagagggttgggactttcagccccacagcccaaccataggggaagggggaggggctgaaccttaaactgatcaccaatggcccgtgatgtaatcaatcatgcctacacaatgaagcttccataaaaacccaaaaggattgggttctgagaggttcaggaaagctggaagctattcctggaggctggtgttcccaggaagagcatgagaactttgtgcccctttccatagctcaccctgtccatcccttcatcagtatcttgtgtagtatcttttgttagtttgtttgagacagtctcactctgtcatccaggctaaagtgcagtggtgcgaccttggctcactgcaacctctgcctcccaggttcaagtgattctcctgcctcaccctcccaagtagctgggactacagatgtgtgccaccatgcccagctgatttttgtatttttagtagagacgggtttcaccatgttggccaggctgatctcgaactcctgggctcaagtgatccacccgccttggcctcccagtgtcgagattacaggcgtgagccaccatgcccagattgtagtatcttttatagtaaaccagaaaacgtgtttccctgagctccgcgagctgctctagtagattaattgaacctaagaaaggttagagcctccccgatttatagccagttggtcagaagcacaggtagaacaacctggggcttgcgattggcatcagaagtgaggggcggtcttgtggaaccaagccctcaccctgtgagatctgatgctgatgctacctccaggcagataatgtcaggattgaattggaggacacccagctggagtccgctgcagaattgattgtgtgcttgttggtggggagaaatccccacacatttggctgtagaagtctcttctgtgttgattattgtggtgtgaaagcagaggaaaaggagtcaatgttttttccactctcagaaatagcatcagtatattttaaaagttccctgagtgattataatttgcagctggggaggagaaccactccgctacaacatcctacaaagtgctgggaagtggtgttttcattctgtgctatattcttggtaacaaaaggagataggggctagtttaaattctaatggatttttttagtatttctaggcattggccagttgtctcagtctcttacgaaagtgttttttcaggcagcttgtattgcctgccgggattggggaagtccttggttagtttggaattttccatgactcttagctctgcaccattagcgtcaactgcagtcacagagcttttcagtgtgtccgcctgtgctgttctcttcctttttttataatgtcagatggatgatgttgaacctcaactacaagtcttagtattgtgtttgtgtttaataccctacttctaaggatggatcagaaaatctcatctgaatgaactttttgtttattaagtgagtcagcttgaactatctgttttggcctgctttcctcaggtgtcatgtttcctgtcacaaaatcaccttttgtttctgtgggcacaagcttctgatatggtgctggctaattctccagcaatctctccattggtgatcagaatcagccttttgatcctctgattggaaaagctctaaaaatgacagtaaatgaaagaaaaaagatccacccggataatggcctagttggggcttggctagttccccgcttatagggaaatttaaagtcctgaaagcgtgaaaggagactgctgtagtgatatatccacttacccttagaaagtgattccctgctgggcgtggtggctcacccctgtaatcccagcactttgggaggccgaggtgggcggatcacgtgagatcaggagtgcgagaccagccttgccaacatggtgaaaccccatctttactaaaaatacaaaaattagccgagtgtggtggcaggcgcctgtaatcccaactactcgggaggctgaggcgggagaatcgcttgaacccgggaggcagaggttgcagtgagccgagatcgtgccatcgcactccagcctgggtgacgagagtgagacttcgtctaaaaaaaaaaaaaaaaaagcgattcctggccggctgcagtggctcacgcctgtaatcccagcactttgggaggccaaggtgggcggatcacaaggtcaggagttcgacaccagcctggccaacatagtgaaacctcttctctactaaaaatacaaaaattagctggggatggtggcgcgtgcctgtaattccagctactcaggaggctgaagcaggagaattgcttgaacccaggaagtggaggttgtggtgagctgagatcgtgccactgcactccagcctggacaacagaacgagactccttctcaaaaaaaaaaaaaaaaaaaaagaaaagaaaagaaagggattccctagatcccaatgtaccatgcagaaaggatagcagtatgttaccaaatttcactctcccagattggtagttggaggttggttgggcttgtttaccttaaccctgccctcctccccacaccactgcccaccaatgaaagaaattcaaattcatacacagttgacctttgaataacgtggaagttagaggttccgatcccctgcacagttgaaaatccatttataacttttgaatccccccagatttaattactaatagcctactgttgatcaggagctttaccaataacataaacagtcaattaacacataatttgtatacgtattatatcccgtgttcctataataaaggaaggtagagaaaagaaaatgttaagaaaatcataaggaagagaaaatatgtttactattatattaagtggaagtggatgagcataaaggtcttcatccttgttgtcttcacactgagtaggctgaggaggaggaagaagagggcttggtcctgctgtctcaggtgtggtagaggcagaagaggtggaggaggtggaaagggaggtggaggcaggacaggcaggcatatgagcaggcccaggcatccaagtcgacctgcatggttcaaacccatgttcaatggtcagctggattttgagtaggaactaaaggcagtgtgtattctgcttcattcccctgtctgtcttcctccttccctgaccaccctgtcgaaataatgccccgtcaagccactctctattccttctccttgcttgacttccttcataacagttatcacctgacattctattatgtaagctctgtgaggatagtgacatttcatttttcgccattgtatttctgaggcctagaacttagtaggtgctcattaaatatttctttagtaagtgaagaatggtttgaatactcagacatttgcatatttttttgttgtttgcttttgtctgagctaagtgattctcaaaactttatttggcatatgaattaccgtatcatatataagaccctttatacagaactttgtgagctatataagaaaattttaaagataaatctatgctatttttcttttctttttttagagacagggtctcactctgttgcccaggctggagtgcagtgatgtaactatagcactgcagccttgaactcccaggctcaagggatgctcccacctcagcctcctgggtagctgtggctacaagtgcaagtcagcaaacacagtgaatttttaaaatttttttatagagacgggttctcactgtgttgcccagactggtcatcaactcctggcttcgagtgatccttatcctcccaaagtgcgggattataggcatgagccaccgcacccaacctgtttttcacttttaaccctgaagtcggctgggcgaggtggctcacgtctgtaatcccagcactttgggaggccgaggcgggcacatcacgaggtcaggagatggagaccatcctggctaacacggtgaaaacccatctctactaaaaatacaaaaaatgagctgggcgtggtggcgggcgcctgtagtcccagctactcgggaggctgaggcaggagaatgggtgaactcgggaggcggagcttgcagcaagccgagattgcaccactgcagtctggactgggcgaaagagcgagactccatctcaaaaaaaaaaaaaccctgaagtaagatgtgacaccattttacttcctttatagtttagtctgtaatacagaggaatacctcattatttagattctgaagtaaactggggagaaggtaaatgcccattctgttaagttccacagtaggatgtgttacatattttggtggtgatggggattagaaaaggggaccttacatgttatagtctaataggaagatgataagctacaatcaaaccttgcctgtaccagtaaaaatgggtgtgtcatgtaggttgtgggtcttaacatttggagaatggataaaataagacacattttccctgaggttggaagttgtgatgatgataaattgagattaagtgaaaacgctttgaagcgaagatatcatgaattcaggaaatcttggatacttggaaagataatcaggtaatgagagaaaagtcagagacttactgtgacaaagcctcactgctttgtgatatgtctcaagatgaaggcaggctacgtcctgggaaacattttgttatcagacatgctgctgttaacacaatgtatatggaaagtttggtgtgaatgcagtagatttaagttttgctagtgtactttttccatgctaattgaaaatggtcatgttccaacatgatttcaccgcttcgttgtttctctcccatccttcttttagttggctgattgcaattctggcccaactcaaccctctctttggaccgcaattgaaaaatgaaaccatctggtatctgaagtatcattggccttgaggaagaagacatgctctacagtgctcagtctttgaggtgactatgcttgtgacctttcttatcagtatggtcaggcagtcagagtttgccttgactttttctcacattttatggccattttaacacgtggcaagggcaagctgctgaatgcaaacacgatctgaagagcagaaataaaattggaacttaagccttagcttacctaaatctcattaagattctttttagattctgctatcaccctgcctttttaaataaatacagtttaatttacaaaattaagcttgcatgcactctttcagacgcagatcaaaaaagtaactgtttatacttggcattgtgagatccagcaactttaaaaagtggctggcagatttaaaattgagcaggtttctttccagcagtagtcagccatccggacagaaccgttcctgtgatggtgttacactgctgggagaggaatgtcttgtcttcatccggttgcctgcgccactgttctggtggcgtctggcactggtgcaagacagagctgtgcttccccgagagtgtgctaagcattcactttggctgcttagttctagtctgggagcagacagagaaaacaaaattaaggtttttgaatgctttggatggagaaaggtgcctgcgtccgtttgttttgtgttgctataaaggaatacatgagactgggtaatttatatttggctcgcagttctgcaggctgtataaacatgacacccgtatctgtttggcttctggtgaggcctcaggaggtttttacttatggcagaaagcaaaaggggggcagccgtgtcatatggccagagagggagcaagagagagagaaggaggtgccaggctcctttaaacaagcagctcttgtgtgcactaacaactacttcactcgttactatggggaggtatattagcccattttcacgctgctgataaagacatacccaagactgggtaatttataaagaaagagaggtttaatggactcacagttcctcgtggctggggaggcctcacaataatggcggaggatgaaaggcagttcttacatggtagcagcaagagagaatcagaaccaagcaaaaggggtctccccttataaaaccatcagatctcgtgagacttattcactaccatgagaacagtatgggggaactgcccccatgattcagttatctcccaccaggtccctcccacaacacgtggaaattatggaagctacaattcaagatgagatttgggtggggacacagccaaaccatatcaggagggtaccaagccattcatgaggaatccacccccatgacccaaacacctcccaccaggccccacctccatcattggggatcacatttcaacatgagatttggaggggacatataatccaagccatatcagtgccttttgaaaatcagtctttggtcgtgcgcggtggctcacgcctgtaatcccagcactttgggaggctgaggcaggtggatcacgaggtcacgagatcgagaccacggtgaaacccatctctactaaaaatacaaaaaattagctgggcacagtggtgggcgcatgtagtcccagctactcgggaggctgaggcaggagaatggcttgaacccaggaggcagagcttgcagtgaggcgagatcgcgccactgcactccagcctgggcgacagagcaagactccgtctcagaaaaaggaaaatcagtcttaaggttgcagcttctatttgtcctgagggtcagagaggttagtagtggtatagtggaaagatttattcactggccgagagtcaggaaacctcttatttaatctgttcgttgttttcattattttgttaaatggaagttagctttaaatgccttgactagatttaggttcaagttttttggctctttaggtgttactgtaaactgtgtattgcctcccatctggagaaacaggatgtctggctctggctctcctatgtttagtaaggctgatgtgatcactgggttcaggtaatgacagcctggttccttcatttgtaaagtcctttttatcaagtgattttatccattgatgatcatagcctgaattaatcattttagttgaaatggcaaatggtgatttgctgctgctgctgttttttgtttttgtttttgtttttaattgagacagaatctcattcttgtcacctaggctggagtacagttgcacaatcacggctaactgcagtcttgacctcctgggattaagcaatcctcctgccccagcctcccaagtagctggaattacagtcatgagccaccataccctaacttttttgtttttgaaagagagtctctgtcacccagctggaatgcagtggcaccatcatggcttactgcagcctcacactcctggctcaagtgatcctcctgcctcagcctcctgagtagctgggactacaggcacacaccaccgtgcctggctaatttttaaattttgaatagagacaaggtcttactatgtggtccatgttttggctaatttttaaaattttatttattttttatagagagagagggtctctttctatggcccaggctggagtgcagtggtgtgatcatagctcactgctgccttgaattcctgggctcccgagatcgacctgtcttagcctccctaacagctgcaggcacgcagcaccacgtgtgacttttgttttgttttgtggaaatgaggtctcaccatcttgcctaagttggtctcaaactcctgggctcaagtgatcctcccactttggccttccagagtgttgtgattatggccatcagccaccgtgcctggccgcaaatgatgatttttccagttctatttttatttatttatttatttattttgagacagagtcttgctctatcacccagtctagagtgcagtggcacgatctcaactcactgcaacctctgcctcctgaattcaagtgattcttctgcctcaggctcccaagtagctgggactacaggtgtgtgctaccacacccagccaatttttggttacttttagtagagatgggttttcaccatgttggccaggctggtctcaaactcctgacctcaggtgatccacccgcctaggcctcccaaaatactgggattataggcgtaagccaccattcccgtctgatttttcaattgtattattacctctgcatttgatgagctgaaatgcttctataaagataactttcctgccaggcacagtggctcatgcctgtaatcccactactttgggatgctgaggcaggcagatcacttgagcccaggagttcgagaccagcttgggcaatattgtgaaaccttgtctctacaaaaaatacaaaaattagccaggcaaggtggtgcacacctgtagttccagctattcaggaggttgaggtgggaggagaacttgagcctgggaggtggaagttgtagtgagccaagatcgcaccactgcactccagcctgggtgacaaagcaagactctgtctcaaaaaacaaacaaacaaaaaacttttcctcatcaacaggatgatctaatagacttgaaatatagatcatggggccgggcacggtggctcacccctctaatcccagcactttgggaggcaaggcgagtgggtcatgaggtcaggagatcgagaccatcatggctaacacggtgaaaccccttctctgctaacaatacaaaaaaaattagccaggcatggtggtgggcgcctgtagtcccagcgacttgggaagctgaggtaggagaatggcatgaacccaggaggtggagcttgcagtgagcggagattgcgccactgcattccagcctgggcgacagagcaagactccgtctcaaaaaaaaaaaaaaaaaaagaaagaaatacagatcatacaaaaatacgggaaaagcagaatacaggtttaattcttttaattttcatagtaagatgttggtggccaagttccagggtattcaatgagattttttttaaattttaaataattatattttttaccctttatatggttgtgttttgttgttgttgttttttgttgttgttgttttttgtctgtgagaacctgtttaggatggcttctatgtacttttggtgttagtttttggtagtttccttactttctggcaacatcaaaatgtccaggcccctcttctatattttctgtccgagacttagatttagctgttctttgaattggtttctgaattccccactaaaaggatgtctggtttactaacagttctcaggcccatttgactctggttctgttcagtggaaatggcatttaagaatcacgatcggagtgctaggtgcgtttgttgctgcctggggtaattaagcataattgcttctaagccttttcaatggaaagaaccaggaagtaatgtatttttcagatgaaaaataatcttaagtttacattagtattttctcttcaaatataacattacagagtttttattttattttatttttttcttttttctttttttttttttttgagacagaatctcgctctgacgccaggctggagtgcggtggcgtgatctgggctcactgcaacctctgcctcctgggttcaagcgattctcctgcctcagcctcccaagtagctgggattacaggtgtgcgccaccacgcctggctaatttttgtgtttttagtagagacggggtttcaccatgttggtcaggctggtctcgaactcttgacctcgtgatccacccacctcagcctcccaaagtgctaggattacaggtgtgagccactgtgcctggcattctttttttttttttttttttttaaagacagagtcctgctctgttgccaaggctggagtgcagtggcagtatcttggctcactgaaacctccacctcccaggttcaggtaattctgcctaaacctcctgagtagctgggactataggcacacaccaccacacccagctaatttttgtgtttttagtagagatagggtttcgccatgttggccaggctggtctcgaactcctgacctcaagtgatctgcctgtctcggcctaccaaagtgctcggattacaggtatgagccaccatgcctggcctgaaaattactgttccttaataacagtaacttttattattctacaatgtatataaaatactttttttttttttttttttttttttttggagacatggtctctgtcacccaggctggagtgcatcaccacaacctctgcctcctgggctcaagtgatcctcctacctcagccttctgattatctgggactgtagacacgtgacaccacgcctggctaattttttgtatttttggtagagactcagggtttcaccatgttgcccaggctggtctcaaactcctgagctcaagcgatccaactgccttggcctcctaaagtgctgggattacaggtgtgggcctccatgcccggcaaaatactttcaagataacaccagtataactaatagatatgagctcatcaagtgctgttttctgaggtcacttagaataacagctggtacagtggtatgtgcctataatcccagctgtttggtgcggtgaggcagaaggatctcttgagcccagagtttgagacatgcctcggcaatatatcaagacctcatctcaaataataatatttttttttttttcgagacagggtctcactgttggtcaggctagagtgcagtggtgtgatgttagctcactgcaacctccgcttcctggctcaagcaattctcccacctcagcatcctgagtagctaggactgcaggcatgtgccaccatgccttgcaaatttttaaattttgtatggagacagtgtttcgctttgttgcccaggatggtctcaaactcctgggctcaagtgatccacccactttggcctcccaaagtgatgggattacaggtgtgagccactatgtccggcctgtaattattgttattatttcccctggcagtttcgtcaccagtttgatacacaattagactaagttgtttgtgttcaatttattgtatttttttctgttttatttgctgctgttttttgaatatataaaacatctccaaagtcaaattatgaacaagatatattcagagaaatctatcctttcactgtttcatattttgtaaagattaagcaaatacatatattcattcatatgtatatacacacatacacactgctgttacagaacagatatcagctacatatactattctgtaccttgttttattcactgaacaatatatgctagagattgctgcatactggtgtatagagatgtttctcatctctttatagccattgataatccttttgggttatttctagtcttttgctattactgataaagccacagtgccatcctatgcatatgccattttctgtttttgctgatgatctttaatgtagcctccttgaaaatgcaatctctggtttaaagatatatatgatttttctagatactgttgcattgtcttccatagagattatactgttttgcattcccatcaacagtatatgagtggccgagcgtgttggctcatgcctgtaatcccagcactttgggaggctgaggcgggcggatcacgaggtcaggagatcgagaccatcctggctaacgcagtgaaaccccatctctactaaaaaaatacaaaaaaattagctgggcgtggtggcgggcgcctgtagtcccagctacttgggaggctgaggcaggagaatggcatgaacccgggaggcagagcttgcagtgagcagagattgggccactgcgctccagcctgggtgacacagcaagactccgtctcaaaaaaaaaaaaaaaaaaaaaaaactcatactgagggctgggtgggtgactcatgcgtgtaatcctagcactttgggaggcgaaggctggcagatcacttgaggccaggagttcgagaccagcctgggcaacatggtgaaacctcgtctctaataaaaatagaaaaatcagccaggcatggtggcatgtacctgtaatcccagctactcgggaggctgaggcacaaggatcgcnnnnnnnnnnnnnnnnnnnntgtatgagtttctgttttgcccaacctgaattttgccaatttaatttccccttaaatatatatattttatatatatgtttatacgtacgtgtgggtttttgtttttgtttttgttttaatagatgggggtctcactctgttacccaagctggtcttgatctcctggcctcaagcgatcctcccaccttggcttctcgaagtgctgggattacaggcatgagccaatgtgcctggcaataataccaattttttttaacctgcctttttcatcaagttctgttttctactctttatttcaactgtagtgagtgttaggtaaggctgttgattggggttcaaagctgagaacttcaggcctcagttggttctagttccagcattgcttttcacttaacttctctgagtttcatttccttccatgataatgagagaattgggccctttgacactaaataacactgggtgggtggatctgaagacattttatctgcttattcttttcactcttatgtctctgtcaaccggattgacagattcctcatgttttcactctggtccacagcacacactcgggctccttgaaacccttatactaaagttggttcttttaaaagcaaaatgccaggaagtaggagggcaagccgggcgatccctaattatgaacatcgtgtcatgcctattctgcatttaacagaattatagtggtatcgtaacctaagactttggagttaacacatcaagagatctaatctctgcctagcgttagaacagacagacttaagacaggctgacttcactttttggatggtaaagtcaaaggattgagttttgtttaaccttttgaattttgaacttttacctaatggtgagatgataaaggagtttagaaggtagatttgggtctgacctcacctgataaggaaaaatgtttggtttagtacatgattccttttaagaggccagatttggaaagtaggtgtaagccagacatggtattcaacagagaaaaatgaggaccagttatgaaagctttagaataattttatatagatgaaatggaatcaatccaaagaacacaccgttaaatacatagccgatcttttgctgctttaatcaaggtaactgtcatgatttctttcctgaattgaagaaccgaaccacagcctgatgagaggctgagttacagcacgttatgtttattggctgcaaataaacgtgtccagtactcctaagagcagtgctcactccatccttggctttgccagcctcgtctgcttcccttagattcctgagtgtgacttcctaagatgtatgtgggactctaatgtcaaggttgctgtttttgttgatgttcactttcctacagccttgtggggtgtgctgctaccatggaatctccttggaggggtggcttcggcttcagatccagcatcctggaagttacttggtttagcaaggcattgttgcctggtagatgatctgatatggttgaccacagtctgaaggcatagaaatgctgttttattataaagtccgggccaggaaagaaatagaggatattgataattaggcctctgccctgtgggagctgtttttctatgcattcctaaaatacttgagtgcttgtgaggtgtatagtactgaagtaggggaagactgggctccaaaggggtttgtgatctgttggggtgttgaattaagccatacttgggagaagttcaatagtgcaaggtgtcgtgtggttaaaaagtaaatcttttactccgagtactctggctgggtattctgctgccatttcaggttcagccatgtctccatttcagttcccaatatcatagttttccttgtcagggtcagaacctgtcgcgtcacttttttctcctcttcctcaaatccatttgctctcattatgtctcttgtgtccgcctttcctttccattcctccttcaggcaccctgatttctgccccaacttactacagctctgaattatggcaggtgctcctcatctggtctccctggctctaccgtcatctatctacagaataccaccctgtttatcttcctggtgtagcacttcctgaaatagatcagcttgcctcagaaactgtcagtagttctctggggcctgcagcaggattttttgttttgttttgttttgcttttctgttttgttttgtttaacctaaggtctctgattgtagagagtacatgccccttgaaatgcgatataaaatgttataagcacacaacttttgccgggtcaccagcggtcccatgagccacaacagataagaacggctaacctgcaggtcatgtccagctctgacttgactgtcaaggccttccctccccagtctgccttccttctcactactttcccctccaggccctagtggtgtgggcccttgttcttgacctcattagctttacttggtttttcctgactctcactaccctattacattcattaatttagaaaacaacttagtaaatacactctcccgtgaaaattccttctgctttcttgcctcagttcacccattctctcttaattctttctgatgctttctctttcagtgcccagctggcaaatcctagcacttccttccttggctactttgtttcaaagtgatttcttttctttctgaacatatttagctctccagtttttgccattcatttggtacattgccttgaattgttaaatacatgcttaactccttgtatttaatctcctacaatatatagccttacatatcatagtaaagaaggaattattttgcaaatttatctaaaatttttaaacagataaaaattaagcctaatatatcgtttaagaagaatattcacttacttttccccgaacagatttcttggttctagacttaatatttttatgttatcttcattgtcagttttttgtttttttttttttttttgaaacagagtctcactctgttgcccaggctggagtacagtggcatgatcttggcttactgcaaactccgcctcctgggttcaagtgattctcgtgcctcagcctcccgagtagctgggattacaggaatgtgccaccatacccggctaatttttgtatttttagtagagacggggtttcaccatgtttgccaggctggtcttgaactcctgatctcaggtgatccgccccgcctcccagagtgctgagattacaggtgtgagccactgcacctggcccattggcaggtttttgtttgtttgtttgtttgagatggaatctcgctctgtcacccagactggagtgcagtggcgcaatcttggctcattgcaacattgacctcccaggttcaagtgattctcctgcctcagcctcccgtatagctgggactacaggcatgcaccaccatgcttggctaatttttgtatttatttatttatttatttatttatttatttatttatttatttgagacggagtcttgctctgtcgcccagactggagtgcagtggtgcgatctccgctcaccgcaatctctgcctcccgggttcatgccattctcctgcctcaggctcccaagtagctgggactacaggtgcccgccaccatacctggctaattttttgtatttttatttgagacggggtttcactgtgttagccaggatggtctcgatctcctgacctcatgatctgcccgcctcggcttcccaaagtgctgggattacaggcgtgagccaccgtgcccggcctaatttttgtattttttttttagtagagatggggtacatcatgttgtccaggctgttctcgaactcctgacctcaagtgatccacccaccatggcctcccaaagtactgggattacaggcatgagccaccgcatccgaccctttgtcagttttatctgatggtaaccttatgactctttttttttttttttttgagacgtgcaaaatgagaacatggaccctttgattaagttcttcagccccacccccagtcagctatttcttatcaaagatgataagaatacaggcttcctggccaggcgaggtggctcacgcctgtaatcccagcactttgggaggccaaggcgcgcggatcacgaggtcaggagattgagaccacactggctaacacaatgaaactccgtctctactaaaaaatacaaaaaattagccaggtatagtggcgggcgcctgtagtcccagctactcgggaggctgaggcaggagaatagcgtgaacctgggaggcagggcttgcagtgagtggagatcgcgccactgcactccatccagcctgggcgagagagcgagactctgcctcaaaaaaaaaaaaaaaagcttccttaatttactccaaaatcagccgggtgcagtggctcacacctgtaatcccagcgctttgggaggctgaggtgggcagattgctcaagcccagaattttgagaccagcctgggtaacatggtgaaacccccatctcaacaacaacaacaaaaaatacaaaaatcagccaggtatggtggcacacgcctgtagtcctagctacttgggaggctgagatggaaggaacttgagcccaggaggtggtggttgcagtgagcggtgatggtgccactgcatttactccagcctggatgacagagcaagaccctgtctcaagaataaataaataaataaaaataaaaatttattccaaaatcaaaccgcatgcctttgccatgtaacataatgcacatttacttttattttattttatttatttatttatttatttatttatttatttatttatttatttatttattttgagatggggtcttgctctgtcacccaggctggagtccaatggtgtgatctcagctcactgcaacctccgcctcctgggttcaagccattctccttgccttagcctcccaggtagctgggactacaggcatgcaccactacagctggctaatttttttgtatttttagtagagatggggttttaccatgctggccaggctgatctcgaactcctgacctcaagtgatccacctgcctcggcctcccaaagtgctgggattacagacgtgagccactgtgcccggcctacatttattttaaactggtatcattgatcttgagtgaaaactatcccccatttgtatatggtttttcaaaagtgaaggcttatttttcccttttttgattgtttctttgtcacaaaatgcctgtactatgaagaagtctaatcagtgtgctcttcatggaaaattaacagacaaaccatatgtattcactacttcagtattctcagataaaatttattttattggctgggtgtgatggctcatgcctgtaatcccagaactttgggaagccaaggcaagaggaaacctgagcccaggagtttgagaccagcctgggcaatatagcaagaccccatttctatgaaaaatttaaaaattagctgggcatgatggcgtgggcctatagtcccagctacttgggaggctgaggcaggaagattgcttgagtccagaaggtcgaggctgcagtgagctgtgtttgtggccactacactccagggcaggtgagagagcgagactgtctgaaaaaaatattatttattgattagagacagggtcaggctctgtcacctaggctggggtgcagaatggcatgatcatagctcactgtaacctcaaactcctgagctctagtgatcctcccacctcagcttctggagtagctgggactactggtgtgtgtcatcgtgctgtagagagtctcgctatgttgcccaggctggcctcaggtgatcttcccgccttggcgtcccaaagtgctgggattacaggtgtgagccaccacgcctggcctaaatttataatctgcctggtactgatacttgtacaaagaggctgttctgctggcctaaggaagagaacagaaaattatccctagattaagtgaaagatattatgaggctttcacactactacaagaaacaagtagctctggtaattaccactccttggcctgatgttgttttcctagtacattgtaaatatagtctgtttagggcatgatggctcatgcctgtaatcccagcactttgggaggcgaggatgggcacaacgcttgagcccaggagttagagcccaacctgggcagcatggtgaaaccctgtctctacaaaaaaatataaaaattagccgaatgtgttggcgtgcacctgtagttccagctacttgggaggctgagatgggaggatcatttgggctcaggagattgagactgcagtgagccgagatcacgccactgcactccagcctggatggcagagcaagaccctgtgtccgaaaaaaacaaaaataaaacaaaacaaaaaaaaagatggtgttgaatttaagctgctagaaaaagaaaagtgtcatttgtcacctacactcgagatagccagaacggggagcaagctacagggcagcctccagtacaagaccaatgcaaggagcccgctccccaggagcctggccccagagcagagttcgccatgcctgcggaacctcccctccatgctataagagggaagggaaaaatacagactcttgaaactgcggtgaattcattagattccagcacaatcaatctcagtcagcttcattcttcctgctttctgtaacatagagtgttacttgtgctcctcatttcagcagtgtccttggttactggaccttttgccacagccctgcaaaacctggccaaacttgcaccaagttgattatcctgtgtttcatattttgttgagcatctgtgcattttaaagtgttggcttggttaactttctcgatgttaactttttgccttcctgaggaatgtatgaggaccagttaccagaatggttttgttttgcaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaagactccagtggggtggtcagtaggagagcacgttcagagggaagagccatctcaacagaatcgcaccaaactatactttcaggatgaatttcttctttctgccatcttttggaataaatattttcctcctttctatggaaatctgggctcggtgtttgtaaagttcatttttataagcttttctatcgctacataatgcctttttaaaaaatgattttgtagtctaaacttaggttgagtatataaaccctgccatgtagcttgagatgcctgaaaagactggtaagtgcgtttcttaatcgttcagtaactatttgagtgcctactgcagccaaggcactggagggatcaaagatgtgtaaatttggagtccctgcaagttcacaagctatttggagagataaggttagtatacatagaactgtaatataaggttgtgttggagcattgtccttaaagatggtaccatggtgagcagttcaaggttacctgccagctgcagaacaaggcagcaaatgctcctgagatggaaccatcacagcctcagacataggactaaagaagtcaagagtgattaaaaagccaggggcaggagacagtaattttgtatttcagtagcaggcatctcgatacactaatttgagagctttattacttttaagaaattaaaaattaaaatgaacctaaattttcaccagctcatggctttttgacagccagccaagaatggatttcctgttttgcagtttctactttctattcctcccaaactgtctgaactcattactttgctattcttatgaccaaagtgagtttcaagttgaagtgactctcctgctctcgtttcttttcattctttacttttgttttgcgcagtctgttaggcaactccatgctttacgtttccagcaggagggccacattagctaatttcatggaatacatgaaacattgatgatttgaagttgaagggggctatggtgatataggctaaccccatcattttatggataaggaagctgagcccagacagggagaatttctcgcccagcttaatgcagttggtcagagctagacaggggagtaagatccatgttttctttctttttttcttgagacagagtctcactctgtcgcccaggctggagtgcagtggtgcgatctcagctcactgcaacctctgcctcccgggttcaagcaattctcctgcctcagcctcctgagtagctgagattacaggcacctgccaccgcgcccgactaatttttgtatttttagtagagacagggtttcaccatgttggtcaggctggtctcctgacctcgtgatccgcccaccttggtctccgaaagtgctgggattacaggtgtgagccaccgcgccctgccatcatactattgttgaaatgtgggaatgacgaaatcagctcaggttttatgagaggaaactcggtaaattccctttgctcaggaagtcacttcacccttgagccctagttgtttcatttattaaattcttgagaaggttcagtgccattaatacctaaacccaggcacatgttctctcgtcacctcacccttaatagcagaactgtttgttaacaacatgattaggcatcggagatggatgttggtgaatcatattttcctgaccgttgccacactccatccagtgtttgtcagggcccagactggaaggacctccatttagcccgttcagaggataccgaaaatgttcctgcgctccagagcccttccaggcgaacgtcatgtggcctcctgggacaatcactagattagcagaggtcctaggtttgccatcttactcccatcactcgctagctgtgtaacggggcaaatcatttaatttctgactctcagtgttttcatctgtaaaatagggataatgcataccttttctactatacgaagttgttaccaaatgagattttggcggggaaggtgatttgtgaattataataatacatcaagagtattttccaaataaatgaccaaatccccagggtacactgacagtacttttctattcagataggacccagagggacagccaagtgattttttttttctacgtagggttacactttgggttctttgtgttttgttttgtttgagacag

SEQ ID NO: 16717 - DNA, 20662 bp, Human
aaggggtcagggcccaatgcatgggcaatcaccaggcgtgggacacctaactggacatagttgtgctgagcctggcagaagctaggtgggaaatgcagctactgatgccctgggtatgccctccacatagatggtgggggtggttctaggtttcactcaacaccagccagttcccttatcctggtgtggtgtcaatgagattcaccctctgggagagagctcccagggactggggacagcctggaggccactgggaggctatgagacaggggcaggcttcaggctggaaacaatggaggaccagaaggggacatgataaatgacatgctctctccttggccttctctccgtttctctctcttgccttcgtgaaggctgtttgtgctgcacagcaagtacgtgtgtccttcatgttgaccgttctgagcctttcccatgtcagcccagaccctccacccaatggtcttatctccctctgtccaagtacacctccctgctgggcactagggtctggcacagaacagaccccctgctgtcctcaagggccagctgttcagggtgcccagagtggagagcctgttttcttctgtcttgacccctcctcccctcactcctgcaggactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacatgttagacattaccgtaaaattaaaacgcacaaatttgcagatctgtatgactcccagtgtaattgggccaataggcacaggaccagaccacagggaaacaggcacaatcacagaatgccaggtgccacaccaaggaaatttggcctgtgaacgcccagaggaggtagcaactaattctgcgccccaagccctcccacatccctctccccctctgcgatcagcgaacgctttttgcttttggctctgagttttgaaggaagggtattccaggtagaagggacaacatgcccaaaggtcttgagatagtaaatgctccttcagaggtggctcatgcttgacactttggggcatttgcccacttagggctgtgggagctgtgtcctgagacagaccccatgcttttcatagccggagcattctcaatccccatgtcggaggtgaaggagctgaggccctgctaagtaggaatgagaatccagaggctcctcgccgggctgcctctcagtcagtaagaaagccaaggggagaggggagttgctgggggtcagggctgagggcgctagcaggaaagggagcgttgagccgcctgcagaggccgctgcgagcccggaaccctccatgggggatcccggcagcggcagacgatccaggccggagccacgcgcagacccagggcatgccgggaactgcgagccggccgcgggtcttcgggctgcgtgggcctgggaggcgccgggaagagcagtcgcgacggggctagggacgacacactgcattcactggaagggacaacgcagcgccagtacatagcctgaaacgctccccagaaggtcccacgctcgccgcgcggtcgacaaccgcatcctgcgctcgcccgcggtgtctcggcaagcgctaggcttgtcgggaagagctggagggcgcaagtgcggcgctggccggacgtgccgcaccgtcagcgcagggctcgccgggaaatgtggtttctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggtacggtgggcttcatggggtcctgaggacaggaagggcgatctgcgagggtcccagggcgggtccaggggcgaagccggggggtggtgtcctggggtaggatctggtaatgaggtggatggtgctgtacaggacgctgttcagggcaggggagagggttccgagggagtcccagagcccgatgtcccgggacagggtactggaactaagttgtgtttgtggatattgggctggggtcccaggtgctctgaggtggggtgaggagtccagagagtcctggagccgtgtcaggggtcctcacttgcaggatgattggtgttatcttagaagatgatggatcttagcagttgagaggtgatacctaacttccgtggcagctctcctgcttagtcccattccttgggtgccccccaggagggtcctgtccttaccgccctccactcctttctttccaggcgcagcaagcacacagtggtggcctataaagatgccatttatgtatttggtggagacaatgggtgagtgagtctcagcatcagtgtttggaccaggtagggagaagtactgtggtcagggactgggcctgtccagctccattactgtcctttcagatgctagctggtgcctctaagcttcagtttccccatctgtgagattccttgcactcacctccctggtcgtggtgaggattaaatgagatcctgcactcatggtcctcagcacagcttccagtgggtggcacatgctcagtatgtggaaatgtccctcttctgagtagatgcagccttgaaagaaacacaaccacccttgcggccagccctgccaggcacttttctttccctgtgcctcatcggtatggaggacacagttttatttatttcatgcatttttcactttttgtgggggttttcccaaattgctccaaacatcaggcaacaacgtgatgttttgttggtgggcacacctcctttcacataaactgtctccacttaagttgtggctggtttccttatgcagagggtggagtatttgcacatgactagttgtgtccatgtgtcctagccctgcctctcagccccaggaactagcatgaagccctggaaggtctggcctcttactggctctgcagccttggtcctgtaggcctccttggggggcgggcttgaggatggtggggtagtctggaccccaccaggatctgcatactgggcagaagagcctccttgggcatggtcccctggcttcaagcctgtcttcctcccactctctttccccaggagtagccggtggggcccatttacaaaagcaagtcagagtatgctcctccttggctcatcctcctgtaatgcctccctgcctctctgagtaaaagcccaagtcctcatgagagtctgctgctcctctgccctcagtccctcactgcactggggcggcacgggctgccttgctatgtttggattgtaccaagtgcccccctgctcaggcccttgcactgcccattctctcctctcaccttcctgcccctcctctgatgtttcttgtgactgaggccttacttggccatctggaccaactggagaccattgcttcccctccatacctcttaccatcttcatttgttcctgaggcacacagatgttggttattatccatctcttcagtcaaggcagggcctgtgctccctttaccattgtatcctggcatctagaaaactccataaatgtttgtcaaatgaaggaatgaaatgaagaagagatgcctacccacaagcgtttactgcagccttaatgagaaccctccaaaccagaaagggctttagtgtccagtacaaggcagcaagtgggaaatgggggaccttcatcctcaagagtgtccttagcaggtagtttgtgtgacaactgtgtagcaataagcagaaacatttttgctgcagtatgacaaagaaataggatacaaatttgtctcacactagtcttaactttataaagactgcctgagtacaaagaaagatggcctcctgcggcacgtggggcaagtaagggggggcggggggtggcggtatcacaatcaccaccagcttctaggctcctggcttcctggctgcatggcctcagacacagcctttgagccactaggctttgttgccatctgtgaaatggaggtgagagagcacccactggtgcagactaagtgagaccgttcagggggcacccagcacaggctgggcatgacggggcgctgggctcctgtcagtttgcccttcttcccaagggctgggtagtgatatgccagctggtagtgttaggtggtgcaatggccagtgaatttgttttctatttgattgtatggcttttgcaacaaagaaatggcaggggccaggtgcagtggctcacacctgtaatcccagcactttgggaggctgaggtgggaagatcacttgaggccaggcattcaagacgagcctgggcaggaaagcaagacttcgtttctattttttttttttttttttttgagatggagtcttgctctgtcacccaggctggtgttcagtggcgccatcttggctcactgcaacctctgcctcccgggttcaagcgattctgccgcagcctcccgagtagctgggattacaggcgcctgccaccatgccaggctaatttttttgtatttttagtagagatggggtttcaccatgttggccaggctggtctcaatctcctgacctcaagtgatccgcccgcctaggcttcccaaagtgctgggattacaggcgtgagccaccgagcccagcccattgtctctatttcttttttttaagaagtggcaggaagatcagagagaagcaaagggcctctcctgaggcacgggcaagcacttgcattgcagggtacagctgcagaggaaggggattgggacgtgtgaataggggttctggaggctagggtgaggtgtgagggtgactctggcctttgggccatttcatgccttcatgtcagctgctggttgggctcctggtggccacattcatgctttggtcctgaccccaggcaggctggtgtctgcctgtgtggcagccctggtgcccatatcagttggggagcctcctttgtggtcaccactcttgttcttgggcatcagctggttgcctggctgtgttagtgacccagcccacaacagccccctactctaccctggctacatgcagtgcccatctctggggtcactgcagagtagacctggctaatgccaccctctcttccggctgcctttcaggaagaccatgctcaatgacctcctgcggttcgatgtgaaagactgctcctggtgcaggtgggtggccccgtgctccagggccctgcctttcctcctagaacacagtggcacagtgctgggtcccagttgctagcagagtctctctcatcatgggaagctagaaagaagcttccaggaggagataaccacggcctcagggatgccacatccagagccgccctgtcaggctgaggagatcaagtaaccaccccgcacctgcagctgccaagctgggcacacagggcggcacccttctgggctgtccacctctacctcgaggctgatgctagtatgggtacagaagttgctatgtcttttctctcacacttgattttgtaagatggctagtagttacaaattaatttaaaaaatcattctgaaggcttcacaattatttgtcaaaaattgcttaagtataaaactcagaaaaaagctaggagttcaagaccagctgggcaacaaagtgagaccctgtctaggaagatagatagacagatgatagatagatagatagatagatagatagatagatagatagatagaaaaaaagatagatagatgatagaaagacaaagagagatgatagatagatgataggtagattagacagatagatgacagatagatagatagtggatagatgatagatgacagatcgatagatagatgataggtagatgataggtaggtagattagatagatgatgggtagatagatgacagacaatagatgatagatgataggtagatagatgatagatgacagatagatgatggatagattatataggtagatgataggtggatagatgatggatatatagattatatagattagatgattgatagatgataggtagatagatagatgatggttagatagataggtattaaatgaaattgatggaccccgtgctgtaagatgctgcactgctgctgagagcaggagtgtggatggtcctggagtagcatgaggacctggtcacattctgtgagtggaataagcaatttacaaaatatctgccacttgattccattttaaaaaatttcatggaagcctaagtatgcgtaggagaggtgtgcagggaagacctcaaggtgttgccagaggttttctggtaatgggaatttgcatgagctttagtgcctattttgttttttccttattggtgattttttttttttaagtttctatgatgagacaggtatcaccttcaaaatacaaaagtgaaacgtagctgggcgcggtggctcacgcctgtaatcccagcactttgggaggctgaggtgggcggatcacctgaggtcagaacttcaagaccagcctggccaacatggtgaaaccccgtctctacaaaaatacaaaaaattagctgggcatgatggtgggtgcctgtaatcccagctactcaggaggctgaggcaggacaatcgcttgaacccaggaggtggaggttgagccgggatcgtgccactgcactccagccgggacgacagagagagactccgtctcaaaaaaaaaaaaaaaagaaaaaagaaaggcagcacagggatgcagggccaccctgtgggggtgtggacctcatgggtgacccccgctgactctcaccacccctgtgcccaccccagggcctttaccactgggaccccaccggccccccgttaccaccactcggccgtcgtctatgggagcagcatgtttgtctttggtaagcagcctcttgcctcccaggggctgtgtcgccccgaggcccacagacaccctgcccttctgcaggcctggggcatttgtgctcgtgctgtgtacagcaggggctctctctccacccgtggctttgtctgccagtcttcggaattctgcgctggatctgggaccccttgccctaacggccctgagctcacagggttgggtgtctttctgtgttactgagctgtggctgggaacagtgtcctgctcatctctgtgtccccagagcccagcacagaggcagacaggcagcaggtcgttccggggcttgtggaaggagtcctggcttatgcattttcaggggggccagattctgctccaccttccagggtttgaaatctccaagactgccctttgggtttgacagtttctcactctctttactcagggggttacactggggacatttattccaattctaacttgaagaataaaaacgacctctttgaatacaagtttgcaactggccagtggacggagtggaaaattgaaggacggtgagaaactttgcagaaacatttgggacaggctgggtcctgggtggcattggacctgggatctgcccccttttgcctcccagatgaggaccctgagggcacgcaatagcagggagcttgggattggtggaatatcccccggtgcagctatgcatggcctgctcccagcccttagactccctcctttcagaagagacccaaatggaccaggcgtggtggcgcatgcctgtagtcctagtactttgggaagccgaggtgggaagatcacttgagcccatgacttcaaggctgcagtgaaccatgtgtgccccactgcactccagcctgggagacagaacaagaccttgtcacaaaaaaatgttcaataagatccaatgtactgctgatggcgcttctggggtcccgctttttgagcaccccctttgatattttgggggcacctaggagaaggttctgtgcctctgtggctgtctgaattcctcttcaagccactagtcggcctctggggctgttgtttattcctagtgccttgtggaggtcctgaagccccagtgtcgggtggatgtagccatgcagcctggctgtggcccctgcactgaccacatggggctgggtggctcaggtctgtgctgggcggcctcactccctcccctcttccctcacactccaggttgccagtcgctaggtcagcccatggggccacggtgtacagtgacaagctgtggatctttgctggctatgacggcaacgccaggtgggtggtggtccggcctgtgcaccccacctccgacagcactgagacccggagcaggccgtcctggcatttgagggcttaggctgggaggattttgagtgcctggtggattttgagtgccactctgtctgggggtttcttgggagggggatggggaaagaggaggatggacagatggaggtgagggccactgggtggagccccgtggctaccagagtagcttggatgaggatcctcagccaggagttgccctgcggagctgagttggtgggcgggtgggcggtgcccaggctcaggcccagccctggttcttgcccaggccaaaggccttttcctccttattttagaaagttggctttgctctctttttctgatcacaaaagtagcatatgctggtttcccaaaacttcagcatcatagaaactcctaacgatgcagtgatggtggcatctgggatatctgtgtcctctccccacccaggagggacactgagtgaggagctggcactgccacactgccctgatgtcatgcatgagagtacttgttctgtctgggccgggcagggggcctggcacagcagggatttgaggcagtggctgccaccccacacagaagttcccgcctcatggccgcacaagtctcctaccctgtgtgggggtggggctcctccctgcagccatcccttccagccaggactaggcccaccctgaccaccagacccaaggggtcctcactggtctgtcctaatacaggttgaatgacatgtggacaattggcctccaggaccgagagctcacctgctgggaggaggtgaggggcgtggggagccagggcgcaggtggaggaggtgaggggcatggggagacagggtgcaggtggagggaggtgggaggcagggggagccaggctgggggtcgaggctgctttcttccccttgcaaagcccagcctcgacctgagcctcgctctcctccctggtgacctgcgggccttcacgaccagttcctcactgtggctgcacagtgattcgaggtttggtgctttggatgggcagagtgccacgtgtgtgaggatgtggttttgctttaacgcaccctttatttcagtgcagtgagggccgtctgctatccagtgtcctgctccctggagctccccctgggcttgctttcccctttagaaacatggaatttatttatttattcattaaaaaaaattgtttttcagtcttctgggcatgaaaaacatgagtttagcccctgatgatttaaccctgacgattttaaccccagctgttcacaactgggccccgtgaagtggatgagacagggctatgagctgttccaagacaaaggaatctgtgaatcctcatctggggaagtttcaagaataaaagcagtcccatctcagcagtctcgagtgtggtgaaatgtgagcgggccctgtgaggccggggctgagctgtcctctccccctgcaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtgagtactctggccagtggggtggagggaggacggtcagttccctcgaatccttctgaatatgaagaacgcctcttgcacctggtggccatggtaaccatccttgtgagctctgcaaacagcaggaggttacagcccggagcagggatgtgcggtgcccctggcaggtccccaggatatggctacagcttagcaagataaggcctggcgaggaggcccctggctaggcctccctctgaacgtgaaggacgtccccttcctcgtgaatagcttggtcagtgccaccagtaacagacgtggcctgcatagatctcaaataatggcagaagaccagaggggcctgcaggtcctgagaggtctggcccatgctgcccctggctgctggccagcccttgatccctgcaatggggctgcaggagagggcacaaggagtgtgagctgcaggtacagggggtttgggaagggacttgggagcttccctggaggccacgggtgcgtgggaggaagggcagggagccccaggatgagggaaattgtcaagggcctggggctcagcatggagccagatggcatagccctgccaggccaggatctgttctgaagtcttcagctaacttagcaaaagagaggacttgctgggaggtactgggaagcctgggaggtggaaggtgctggggcagcatcaggatgtggggtacaggcagctcccaggatggggactcagctgtggggatgctctgactgggcagcgtgaacacagtgacctgcaatggtctctgcacaactttactccccagagagcaggactgcctgggcgggtcagatgccaccctcctgcccatcactgctgcctgctccatggggagaggggggagctctggcaggaccctgcggtgggccacatggagccaggcagggctggtgcccgtgctggatggggtgagaggtgctcagcgcaggtgtctaggccctccctctggaccctgggctagtcaccgtaagggatgcagggggacctcccagtgaaggcctgctgtggggaggccccgagggtgagcaggagcccctgtcccagcattgattcactgttgtgtacccccaggtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggtgagggtgcccaggggtgtcctgacctgccagctggacaccagtagctcctaccctgctcccacccagctcctcacagctttggggccccctggggttccagacagctaccaggagcaaggccaggacacctgggcctcagccctggacacctgccccggcctccagccccagcttcaccccacagcctgcaggtagttaacgcttcacaccccatcatggctgcatggggctgctgtgctgcagacctttcctgggaagcccacggccatgcagctcttccttctttcagaacccactctcaaggccaggatggtgggggtctctgggcacctacctggcccttgccaactggtctcatgcccatgtgtctcccctcttcaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggaggtacaggctgggatcctcattaagactccatcaccccctgaaacaggtcctgtgatcaacacctctcacacatggggagactgaggccccgagaaatacttgcttggggtcacaccacaaagggggtacagggccaagggccctcaccctgctggccaggctgcagctttctggggtgggtgccacacactggcccaagtgccctgaccactctgagggtctccatggcccgtcatgccccactcgcctacatgggtaccaggtcccacctgtgtctgtacccaggggccctcatcccttggggaccctgccccctggcccttcatggccatgaggtgccgcatccttgccttacctggctgcaccagccgcactgtggaggctctgctcccccaccattccaccctgccttcttgtcccccagctgcccagtgggaggctcttccacgcggctgctgtcatctcggacgccatgtacatcttcgggggcacggtggacaacaacatccgcagcggggagatgtacaggttccaggtgtggggcctgtgggcctgtagagccggctgggtggacggatcccccgtgatgagaaactgaggccaagttggggggcagggcttatccaggccattgccagggccacacctggcaggatggaagccttgggaggagccctgtgggctgagggtgggctgaggtggcactaaagtgggcagccttcgtgcagtggggcaggcagatggtgctggggctcacggcagagtcagtggagggagccgggccaagctgggctcagcaccagagcctcacaggcatcatagcctggcccagggcagagccagggctgacagtggcttgcgttgacagccccttcccaggcctggaggagcaggtggtcagggcagggactcacagccacagtgaggtcagggccagcttcctggaggaggttgggatgtgctggtgggggccagtgtgaggacgcaggtccaggcagagtggagacggcagagctctgctgaggcctggggcccagccgaaggcaagagaggcaggggagccctttcctgctgtggagccggccgtggacagttgcaggtgctgaggctggagccaggctgtattttcagggtggggtagcggctgcttcctctcctcagccaggcccacctgcctcctgggccctgagggtcagcatgggccaggtggggacctcagggtcggcctgcacagccacactggggccaccctgctgtctgcaacatctagtctcactgggcccctcttgcagttctcctgttaccctaaatgcacgctgcacgaggactacgggcggctgtgggagagccgccagttctgcgacgtggagttcgtgctgggtgaggtgggtgcctgtcctcgcaccctgctctgcctgctgtgcctgggcagtgggaatttcgcccctcagaaaaacagctgctggcctggtggtgctgaccttggctggctgggtctctgttctctggggcgagggtcctgtgccctctgccagtgcatcattctttgtgcagaaggaggagtgcgtgcagggccacgtagccattgtcacagcgcggagccgctggcttcgcaggaagatcacgcaggcgcgggagaggctggcccaggtgaggtgcctaaccgccctgccctgacctggcagccatgcctggtgtccactggggtgtccttgagctcccttctccccacagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggtccgcctgggtgggggtggagcagggttggtgtgggctggggtgcgggcagcagagccaaaaggtgggtgctgccagccctgccttactgatgggccccctgaggctcagaggctgcaggtcaccctccttacccatgatcactgcagctggacgccatctgagtcccccgaggccttgttcctacctagtggccccagcccacactcttccatggggggagccctgcgccctgtgccctgccctcccctctccggctccctgagattcgggggctctggggcgcaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggtgtggggtggggtcagcgcaatcagggttgggtggggtgtgctcaggcttaggccccctccctgcccaccactgtgagcccctcgcccagcctggggccctggcttgactctgcctgcctgcctgtgcctgtctgccccaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggtagggagccccgttccccttccctgggggctgggagggatggtgttcatctgcggtaggagattgggagccatggagagcacctgccaggccctcggggtgggggtgggtgccatgggaccccagagtgctctcctgggtacagggaggaaacagatgaaggcagaagcccccgacccatggggcttgccacagtgggctgtgtcctggtgacctgggatttcctgagccaatttctgggggtggacatggggcacctctttcgggctaggatgtcaggtctgatggcccagggtcacggtgatcagtctctggacttctctttgcttgtaatgtcacaggccccttcattcccccagctctccctggggcttgtgctgaccccggttgctggctcttggtgatgtctgcaggcaccagaggccatgcagtgggcctggagggggcttgatcatgaggtcagcgagggggtacagcaagctgggtggaagatgagacgctgggtggtgggctgtgcgtggggcatagtgcttgagtcggccagggcgccgagggaggacagaatgtggctgatggtacctcagggcgagtgaggccttctgcctgggtgaagttttgttcagggcagcaacatgggcagatatgcaggaaggtagtgccgtggggccccaaggccagaatcccaggctgtacctgctcagggaccctcctacccccaggcacatctctgatccaggacatgaaggcatacctggagggagcgggcgcggaattctgtgacatcactctgttgcttgacgggcacccacggccagcccacaaggctatcctggccgcccgctccaggtgggtgggggctggacaggaggggagggtgggcctggatggtgtcttcgttctgctgacggccaggtgcctaccgctcgttgtctgcagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctgcatcctcactccccagtgaactcccaggtccccaccaaggggtcctggcacccacctcaggtggctttgaggcccgctctcctgccccagctaggtgatctgggcccagcgcctccctccagagggtttgctggtgcctggggctgggcctggtgctctctgaagcagttggcagctggcaaggaggggtttgcagccaggaggaaccagtgggttcctgaccctcacaactgcccagaggacggggtgggtcattgctttgtgtgacagttgagcacagacatggaggtactccttatgtcacttcagtaggggtctgaacatggagggtcaggatgcctgttaggcctgcaaggccatggaacagcgctacagatgtacagacactatttttctcgggaggggattcatggttttctttggatcctgaatggggcctttgacccactaagtagttcagaatccatttggagagcatgctggcgtgggggcttggggctccagctgcgcccttccctgtccttccctgggagggtgcgggcggaccagcttcctttagtcagctccttaaccaggccccagctacttgtttgcggccccctactactacggcttctacaacaaccggctgcaggcgtactgcaagcagaacctggagatgaacgtgacggtgcagaacgtgctgcaggtagccccccagccccgtgcacatggctgcagctcccactgagtgggtgaaaggggcagcgcctcaaggtccctgccattgcagatcctggaggcagctgacaaaacgcaggcactggacatgaagcggcactgcctgcacatcattgtgcaccagttcaccaaggtcagggctctggcctccccttcaggactcgcttccccttggcagtggccatgcccaggcagggagggtgcccaggctctgtggtcccctgcagtggtgggccctgggggtgagagaagcagagcagcccatcactggccgcaccttgcttcatccttgggaccagcctgagccctgagcagggtaggccccacagggctccactgcccaccatggcccttaggtggatctggtcccatctccttccggcctgcttgccttacaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagcaaattttacgaaattgtgtggcagtttctgggactagaatgaatttcatttgtgctcctcggcagggagaggccatacttgcagtgagtcaccccaagacggagctgtttgagaactgcagctgcagcaaggccttccaggttcctgggagttgaaggaaaaggatgctgaggccaggacctgagtgcttgtctccatgttctggccacctcttcctagatttccagggactagcttgttggggctttactacctgctgacatgacccaggaggttgatgattgtcatcatcatccccgtttttcaaatagagatggtagtgaagggggcggggagagggttgtccagcttacccaccaggctgatggggcctgtggacagaagcctgtcatgctcctgcttgagaaccggatctagactgggttttagaagtgttctcaaaggggctggctggtttaagtcagggctgtttcagatcctatggaaagggcgcctggagctgtcttcctggcccctactcacaccatcctgccccttcagagaaccctgtggggcacggagctgcgctagcagggctgactgccacctgtctaccagtagctctgaggggtgagagccaggctccctgttctccttggcaaagagcttggactgagccctctaggagctgcagccactgtctggggcagcaagcttagtactcagaggggctccagcccccagctgagccagacagcaggccctccgtctagaatccgctttattatggcacctggtgggtctggtgggatctgagggaggaagaggctgcagtcttgctgggcagcccctcggtcagtccagcagcccctcaggccatgctgctgctcagctgcatggcaaagtcctgcacatgctccttcagagtctggcgggcatctgcctgtgcccgcttctcccgtgcccgctcctgctgcagcttggtcagtctcaaccgcagccgctgctcccgccgcttgcaggcctgcagctggcgctgggccttgtcaagggcatcaagggctgcctcggctcgccgcttccagagtaaggcgctgcccacctggtagctgtgttcattctggatgtaggctccggcgggtgggggcaggcgcagcatatacgctgagggggagactggccgtggttcgagaggggagggctgccgctctggtgaaggctgggcgctgcagcctgcttcatctgcctgggcacccaaggggcccagtaggtctgaaaaggggctgctaaggccaggctccagcctcccagctggggaggccggcaaagtggcaggtgctgaggcctcttccacaggaaagcaggtgacatcagcaggtggaggtggagaaaatggagttgtgggccctcggccctcggagcagctggtaagggggaagagagagactgatgggctaggctgagggcttgccagacccccctccaccagcccacctgatccacccttaacacccaaacccgatccacaggttctgtgtagcaagaaccctgtccagcgagactgctggcagacacccctagggcccagtccctcagcctaggggtgggagtggggcatcccccacccatatcacataccgcttcctgcatcgtctgagccggctgacttcaggggggccaggtgggtaactgtgtcctttggtcttggttgtccggcgcaacttggagaaagactcaaatatggtggggactgccccctcctttagcctgtgatatccactgcggggaaaagcaacccagatgagctggagagcaagtgctgcctccccaggccaatctgcccccagcagcagcgccgtgggatgctggaaggcatcgtgcaaacaatacgtctggggaacgccaagttacagctacaccaatcgcttccccgcaggactcctcacagtccaggtgtgtggaaagcctgcataagccgagctgggctgaccagccagaaagaattctttgatttgtggacttgctggcaagactggggctctgaaagatactct

SEQ ID NO: 16718 - DNA, 17628 bp, Human
ttttctcatttaattaatgagataaattaatgtatctcatttaattttcacaacaacctcatgcagtaggtgtaactgtcaccctcatttcagagagcagaatactgagagctggaggccaaggggcaatttcagccagggtggctggtgacgcctcggtgaaaccaagagcgaacagtgagagcagcggccacctgctggtctgcagggatggtgtcctgggcagaaagaatagcaagtgccagggctgtgctggggccgggctttgcatgtgtgagaacaagacagagaatgagggaggtgggcccacgaggagtgtgggcacagacagcagcctctgcctgtggtgccacgctgaagactcagtattgtatgtgacagatgaaggctctaagaagacagctctgacaaaagctagagtgcaaaatcagactcagacacaaccaccggtctgtgtcctgaacacaatggacctttacactctggaatttctcaaacggagcaatgcacagacacccccatgggccccttgcacacccgcagattctcctaggagtcacattctctcttcagatagactctgggtgccgacactcccaaacatgctcttgaggagcagtctctgtgataagctgatcttccagacaatccagaatattcttaaaactttttagatcataaaatttaaaacacaaattaaaaaacaaattatcataaggccgggcacagtgactcatgcctgtaatcccagcactttgcaaggctgaagcaggaggatcacttgagcccaagagttcaagaccagcctaggcaacatagtgagaccctgtctctacaaaaaagtcaaaagttagctagacatggtggtgtgcacctgtattcccagctacttgcagggctgaggtgaggaggattgcttcagctcgggaggttgaggctgcagtgagccaagatcacgccactgcactccagcctgggtaacagagtgagaccctgtctcaaaaaacacatagggccaggcgtggtggctcacgcatgtaatcccagcactttgggaggccgagacgggaggatcacttcactccaggagttcaacaccagcctggccaacatagtgaaaccccgtctctactaaaaatacaaaaaattagttggacatggtggtgtgcgcctgtaatctcagccactcaggaggctgaggcaggagaacgcttgaacttgggagacagaggttgcagtgagctgagatcgcaccactgcactccagcatgggcagcagcgcgaaactctgtctcaaaacaaacaaacaaacaaacaaacacccataaacacaaaatgtatcacagcctcagagatccccacgaatgcctaagtggccctgaatttgggaggcactgctcagtaatagtcctatctgtcccacaacagacaggagtgctgggctgcacctactggcaacaaacacagcaacccttgactgaagaaaggtccatgccacaatccccttattctgtaagccactaattttgtcctctctcctccacctttcactgaggaacgagctcttggaaggacagggacacccgcctagtagctgagccagccacatcagtcctggagagcaggtggagggcagatgctgtgatcatcccagaagagaggacacagttggaggcagatgcatggtctctactttcagctaccctcaatgcagcctggtccccagaggcctgaagagcgccttgtttatgtggtgacctcaagaggggctgctcctgcaccaaggctatgtgtgcatgctaacacagtaaccgtcatatactcaaaatgtcagctctaagaactggagatgaggagctgcaagccactctacagttatcaaaggcacagctgagggggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagaggtaagttgggtttctaatgtttctgctgattataaattatttttggtgtttacggataggcaactggttcatttttctagcaaactaagaattcagaagctttctacactgttttagaagtgggaaatggtttcatttttcaatgtgcctattataaaattgtgtcagttccattgttgggagagttgacaaacttagaataggagctgtggaatagatgaaaatattgtacttatattaaattaatcgaattggataactgtcctgtgattatgtatgagaatatccttgctcttgggtattttccctgaagtattagtattaaaggttagaggggccgggtgcagtggctcacgcctgtaatcccaacactttgggaggccgaggcgggtggatcacgaggtcaggagttcaagaccagcctgaccaacatggtgaagccaagtctctactaaaaatacaaaaattagctgggcgtggtggcacgcgcctgtaatcccagctactcaggaggctgaggcaggagaatcgcttaaacccgggaggcagaggttgcagtgagcggagatcgtgccactgcactccagcctggacaacagagttagactccgtcaaaaaaaaaaaaaaaagaagaaaaaagaaaaaatgttagaggaacaagatataggagacctactctcaaatggtctagaagaaaaaatgtgtatgtgcatgcctgtgagaacacacacgtacgtacacacacacacagataatgacagggcaaaggttccaaaattttaaacctggtaaatctcggtacgggtatacaggagttgttctactacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggatttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgccactctatctggcctcagatacgttttcctgaatgcttatttattcaagttggtttttgttttgttctttaaccttatttttatctgagaagaaaacattttccccctttgttccttcttcttttggctttcttttttaaaatagagatgaggtcttgctatgttgctccagctggtcttgaactcctgggctcaagcgatcctcctgccttggcctcccaagatgctaagattacaggtgtgagcccctatgcctggtcttcttcttcttgatcttagccaaaaggccaagaagtgataagaggaggacacttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggccgagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggtggcagtgaaccaatattgtgccactgcactccagcctgggtgacagagtgagaccccgccgtctcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaaggaatgggactggcactgggaaaacagctaggaagctgctctgcacggccagggagtctggaagcatcctggtactccagagcgaacaaggctgagcgcttgatgtggggcttagaggcttaaccaacttggttcgaatctagccactgccacttattagtgacagtgacgaaaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttcaaatatttgcttaacaagagcagccagtaactcttacctggcctcaactggcagcagatattctgggcctcaaatatctatctaataggaaatggtcacagacacaaaataagcttaacaaaaggcagtttttttttgttttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctctttttgcccaggctggagtgcaatggtgcgatcttggctcaccacaacctctgcctcctgaattcaaacgaatctcctgcctcagcctcctaagtatctgggattacaggcatgcgccaccacgccggctaatttttttgtattttttgtagagacagggtttctccatgttggccaggctggtctcgaactcccgacctcagatgatccgcccacctcggcctcccaaagtgctgggattactgacctgagccaccgcacccagcctatttatttaatttttcacagagatgaggtcttgctatgttgcccacactggtcttgagctcctgggctcaagtgatcttcctgccttggtctcccagtgttgggattataggcgtaagccacagcgcctggccggcagttctttctggggtgattagaagttgggaccatgtattacctgtctgagtcagcattataaacacctatggtcactgtcctggcaaaacatggaatcatcaaagctcatctaaccagagtgcagttaataaccaggaagtaagcaagagaaagacaaaggatttggcagtcaaaacagatttgacaggccaagtcagatcctcctctgaacgagtcagaggaacaaataaagacaggattgccataatgcctctgtgctaaaagcttatcttgtttacttaaataaagggagtgcccctcaggtcttgagtaagagcttgctgacatcaccctcacacagactttatctcttgtttctaaccctgtgttagaagcagtaacacagaagatttagttgctcctgacagcagtgggagctattgtctaagagatacaaaggagaaaaaagtatacctgcagcaagtgatatcacctctggggctgccaccacatcacctcactacgccctgagggggtctcagcactagacaagttccaaatcttttgcaaattaaacaaccccaggtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacgaaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagcccagctcttagtgaggtttccctgactctctgggcacttccactcctaccacacagggtagagccacacccctttccgtacccccatgtgctctggcagcattattttgagagccttcgctttactgcacgtctgtcccatctgtcccctgactggtccatgagcccctggtgggaactttgtctctggtaactaaacactgtctggaggtggtggacaaggtgtctggagaaaaacaaactcctccctgggatgcctgagctcccaggattctagaaggttagttttgcaaacctttaaagaagggattttcatcaaggggcccacagatccttcattgaggtttatgagtcccacatcaaaggttgggtgtctatctacatcagattctcttaaagtccatgatcctaaaacagttaagaactaatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctgaagtgacagtagcatctgacacttactgagccctaactctgtgctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccactgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacctgtgaactattcagcttgagcagctgacattgacacctacaagtgcttttcaggatacttttgaactactgggcaggtgggatggagaaataaattactatttccccagcaactgttctgggctgagcacaagggcactttttaaggaggtcaccccacacccatcacacacacataggacccctggaatcctaggaataaataagcatggatttgtaaaatccaaacctctcttttcaaatatcctcacctggaccagaccagaagaaacctctactttactctctaagctgagagtgtggaaggggaaacacgaggaatggttcggcttcaggactaattgcggtgacacacaaccacttctctttgccaccaaggactaccaggtacctgcaaagggcagtacttggaggccagtgctttctgctagttagctcccgtggttttatagcagcccaggcgaaggaaggagaccccccccagctcctggcttctgttcagggaaagggggccagagcccctcctgatctgtccacacacctgctctgtgccttggctgaggcccctgcagctctacaaggcaggcattctgctggataggccaagcagggtcactctgacacccaggtttccaccccaaggcatggcacaatgctggcctcctgtgggtggaatcaaaggctgagttctaacaggcttgcggcagacacacacacagagaccacatgtacatgatgaacacacatatccttttcattacaggttattagtacaagttttggaattgagcaaacaagagtctaagcgctggtttcaccacttctcgtttgtgtgacctcagacaagtcattcaacatctctatgactcagtttccttatctttatcacagagatgacacccactctgacagggccgagggaagaaccataagcgatggcaatgcaacagagtggcacatgacaagagctcagcgaatttgagggaatgaaactgtagattacaatactagtacaatatgataaacatatgatattgttagtgacatttattttacttctactagcaaataacctatgtttaggactgactttagaacaggctggcagaagcatttttggcagcatcaaagtcctccaacctactggtctgttggagccccccaagtacaccaaagagcctctgcattagccctggctgagggttcagggacaggcagagaagtacagcagtgagccatccctgcctgcatggaggtggagaaatgatcaggcatggtcagttgacaatctcctaaacacagtaacccgtgtcataccacagtgtaaacacacgtgcaaatgcttctgcttcctttccccatcatgagaatagtcactcaatgccgggcatcacaagggatcaaatgctaggagtacccaatcattcatggatgcttctcaaaggggacgagtgtctagaagtgtaattttaatttcacttaatttcatatggaatcatctccattactaattttgttctaattttaatgtgataatcactttgtaaagcacaataaacagaggcaggctctcatgaggaagtcagaaggaaagaatcccaagagacatgggacagctccatccaaactgaaagggccgtgattcccaaaagagcaattttgtccccaaggtctgaagacacttttggttgtcacaacctggggggttggagtaagcattactggtatctagaagggggaggctggggatgttgctaaacaccctaccatgcacagggcagcccacattgccacaaactattatgtggcccaaatgtcaaaaatgctgaggttgagaaaccctgggtgaggcagactcagggagaagggaatcgagcttcactcacaggcaggcaggagctgtctggtacttcaacctccaagacacctcctgctcatctcatcctggctgctctacccaccagctagaaaccttgaacaagttacttcacttctttgtgcctctgtttcctcatatgtaaaagagggataacaaaacgcacacaacttgcatgttgctaggagcagaaatgagataatacaggaaaggtgctgagaagaatgcccggcacatggccagttctcaactactagtcacccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcatgcctataatcccagtgctttggaaggctgaggcaggaggattgcttgaggccaagggtttgagaccagcctaggtaacatagcaagaccccatctacaattaaaaaaaaaaaaaaagacagaaagaaaaaatagccaggcgtggcatgtgcttgtagtccaagctactggggagggaggctgaggcaggaggattccttgagcctgggagtgtgaggctgcagtgagctatgatggcatcgccgcactccagcctgcatgacacagtgagacctggtctcaaaaaccaaataataataacagtaataaaagctggaaagagctcaaagttactcatttgacagatgtgacagatgaagaaatagaagcgagttaggtgccttaccatggtcaaacaactagttcgtatcagaccctactccagaaactattccagtccgggtaacctctcgttaacctctcttgttagaaatgcaaatttctgcccaaatcaggcctcaggaatcaagagactgtggggtcggctctgcaggctatctgaatgaggcctccagggaaatcagattcactctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacaggtatttcacactgtgtgtttgttcttttgagctcccagatgctgggggtgtctgggaatactggaaaatggatcatttttttaaaaagggagaattatgtacaagtacccaagaacttccatacagggccactctgttaattcagccccaatttgttgcttgagataagagatgattagagagcattcataagggacacatctgccctctaggggccagtttcagaagttagaggcagatgacttagagacagcttggtgcttgctttgtggcttcgagtcccagcttcatcatccctaaaatgggtataattccattacttccccgggtcacttgagaaaataacagaatcagcgatgctgagcgcccctcccagtacttggaacctaggaggcactcaaaaaaagattggctcaactcttccctgcccaggaaattccaaggtcctcttagcctaccgaggacacatcattcatgatttcctctattattattcgttactttgtagttaaaactgcaggtgttaagtacttattgagattattattgggtcatggcagaaagaatggagaggtcttatttctgtcttactggatactggctaggcccatatgaagaagtgattctggtttgaacctccttataggacaagaatacaaacatatgcaaccaaactgagaaaagtaggctctcagaggaaggtatttgcccgggtagccagtcatcatgctctgtgaatttttccttaacaacgtcccttctgtacctgcctccttccattcctccctgcagcccggcagctcttgagaaagggactgcatcttttttttttttttttttttgagacagggtcttgttctgtcacccaggctggagtgcagtggcatcatcatggctcactgcagcctcaacctcctgaacttaagtgatcctctcacctcagcctcctgaatagttgagactacaggcgtgcaccttcatgcccagctaattaaactttttttggtagagatgaggtctcgctgtgttgcccaggctggtcttgaactcctggcctcaagcagtcctcctgccttggccttccaaagtgctgggattaacaggcgtgagccgctgtgcctggcccatttgacttttaattgagatcttacttggtgcaaggtatgagctaggtaaaagagtgaagaagatcaagccttcctgcccatccagctgggattgcaccttaaatctctttatcccctgcaaagtgccagactaactccacaggcactactgttgctatccgcccccttagggattgagtaagttgaggcaaagattgagaatattcagcattgtctagtatatacaggaaaggttctttttaaaagtacactaccagatattcgactccttaattacaaaaaaaaaaccaaatgcctaaaattgggaaaccaaaccagagaattattttagatgcctttttaaaccataaaccaggaaaagttctgctgctaaccttgaagataggaaacgaaccatacagtctcaaggaaataatcatgcaacagaaaacacacctcagttttcagtagcggaattacaaaggagtgtgcttcctaaaatcctcaactgacagtcccggaatataaattttaataagtgctatatcaattctgtgataaatataacccgtggccctttaaagggaaaatcatgattcttttgtaacttgtggttcaataaaactgggcccccctttccttttctgtctagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctggtaaccactcccttgtccacccccgacccgtccccagggtctgcctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcaggggggatcccaagagcagccatggggtgagccccactcccgctgacaccagagacaggggagacatgtgctgcggtctgggaaatagctacccccagccaaatcatgaaagagccattaaacaccgcactatacacatacttaacttaaaccaatcgggcgctcagcaaaagagagagaacaccagtccaaacagtgcagcagacccagttccccatcccggagaagtgcgcagcagtgtggggagctggagctggggtggctgtcctgcaccagcccccacgaccctcagaccacaggcactgccaagagggaacatgaacctagccggcctctaagtgcaacggctgcccctgacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacagttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgtatctgttataattctctattttttgaagctcaaatatcaaaagccaaatccaaattcctggataactccaggtatgataaaggctgagaggaagtcacttgagcaccacaatgtgccacagcagggcatgttctcaggacaggacaggtgtgtgctgaatcctggggagggtctgtgcagtaccccagaactgtggggtgctaagtggcacacaagccccagggctcccacagtctatgccaggctgctgcagctttcatccctcatacctggtcctgcagtgggtctggtttgacagagcagatgacacctgaggaatatgtttctggatccttcaatccctgggtaagacaagtgaaatccacagaggctgttcagcacgcaagagtgccagtgctctttcagtgaggggatgactgacggtcacaggtgctgtgtgtgcaggtgtctaactgtaacccccacagcctggcagatgaggaagacaagggttggaagagttctgaaacctgtccaagatgctgaagtagtggggctgggttcaagtgcaggttggctggactccagggaccacacaaggagtcctgtcacaggcttctgaccccatgagaccaataccagtaagaagagtggtaaaagggagtagggacggaaggggaacgtcactgccctttgtaggcatgcctgtgggttatctcacagagtctccttaccctcaatccctagggggctggcactgttacccctcctttttacagctgcagaagcaatttcagctcacagaagggaaggcctctgcctgaggcctgaatccacacccaggcagggggaccctgcagccctgctttcccctgctcccttcctgacttcccacactgggctctgcctccttactctgctgagagcagatggtgcaggggctggatgaattgccccaagccatcctctcggcttcctggtgaaccctgatgctgcggatggcccactccttcaattcattctccaatctgcttcacccctcttcttttctgtcattctccaaactgcttcaccactcttcttttctgtcattctccaacctgcttcaccactcttcttttctggtgcctgtcctatatttctcatcttgctgcagcttccttttggctcttctcatttctaaatgtaataatctcaaaaaacccttttagtcctttgccatgtctgtcccatacccagaaaggcagtggtcacttctgctcacccagcgccctctctgctacagccggtgtggagtcctccacactcttgagcatccagacacccccgtttcaatgccttttgttcatgtacacccactcagaatctctcagatcccctcttacagaaactagcccatctgttactcaaagcaggagagtactcattcagaacacaggctctgagccaggctgcctggtttgaatcctggctctgccatctagtagctatgaaactctagtagcaggttctgtgcctcagtatcctcatctgtaaaatggggagaccagcagcacttaccttgagggattgctgtgaggattaatcaaattaatgtctagaaagcatttatttatttatttatttattcatttattttatttttttgagacggagtctcgctctgttgcccaggctggagtgcaatggcacaatcctggctcactgcaacctccgcctcctgggttcaagcaattctcctgcctaagcctcccgagtagctgggactacaggcacgtgccaccacgcttggctaatttttgtatttttagcagagatgaggtttcaccatgttggacaggctggtctcgaactcctgacctcaggtgatctgcccaccttggcctcccaaagtgttgggattacaggtgtaagccaccatgcctggtctggaaagcatttagatcactgcttggttttagcaagaactaggaaaggttgtcacattattctcaatctaagagagtacataagccaggcct

SEQ ID NO: 16719 - DNA, 33152 bp, Human
attcaataaaacagcactacactccattagtcagactatctaatgataacagtgctcatacattaggtacccacgtgcctttttgttgctcttcacaatactcctatgaagtactaccttgtatttgacagaagatagcaaagtatcagagaagggaactgacctgtctagagtcacactagtgaaagcaagtgatacaggatttaaattcagaggttccattttccaaactcatgtcctttccattgcattgtactccctctttagctagaagtcaggttagcaccaatctgccgggaccttctcaccccgaaggtgcatgataaaatcaaatatgagaaccgacaaggccaaggaccaggtcactctgccaaaagtgcctaaaacagcctttcagcttcatccatcagcagacagccacaaaaccactcccaactgcagcaggctggtctccggtcaccactgtcttatcttgtcggaaaacatcctctctccatgtgccaaaaagttgagtgggaaaataattccatcctttcagagctaaacactgtgctgagtctcatcgcacacgggtgggcaaagaaagttgacatttactgctcacccactctgtgccttgacctgtgcaagatgctttatgctagaactcatttaattctcaagaacaacctcattttacagataaggatacagaggctctaagagttaaatttacccaagaggacatggtaagtaagtgccagtgcagggaacaaattcaggtccgactctaaaatctgtctctttccagatctcaaggcacaccactgagttgcctttcacctttctcccaagatgaggattgctctggcatgacttcacctttctcttctgaagcaattccgagttcacttctctgcccactgacagttcactctcctttccctgccactgtcccttctgcaaacgcacaatcttttacccaacctaacgcccccagcctcgtagaataacactgcgcagttggtttacagtcacaaagcactttcaagacagtgtttcgtctcctggtcaccacagtccggtgaagccggcaaagcagataaaagcatccccattttacaagaaagccatcttcccaaggtcgcggaataaaaagcaggtgaaatcgggagcagaaccccaggtcttgacccctggtcctcggctcatcccactgctccgcacagccgcccacgatccagcctccacctccgcgatgtcacaagatgctccctgggccagcagctcacatcccccacccccatcccacaaccacccacctgcagcggccctgcaggccccgccgacccctcccccacggtccctctctcttcaccagcccctcccactagggcctccttcccccgctagatccctccgctcaggcgccccctcccgcacaggctgccggcgagcccagcctcggcctcccacagaccctcgtcccgcctccacgcttcgtcaccccagcccctcctcctgtcagcccgcggcccagcccgccgacgttaccttctccaaggatgctggtctctgcaccgccagggagcgggccagtgacaggaccgtgttgaaatagaagccccgcgaggcgctggagccggagccggagcagccgccgccgcctccgcctccgcctccgcctccccgggccggggccgccgccatcacctcacgagccgcggcgctgcccgccggctccccgctcctggcccgcgagcgcccgacctcagggcgcaggcgtaggtgcatccggctttcccgccacgtgacctctcagttgctgacactagatagggcgtggctgcggggcgggcccaccgctgcaggggagagaggggatggacagtaggctgcggttgcgcgcgccggatgtgggccccccccagccgacctgcgcgatggtcggctccgagggcggggccacctgcgcgcgacgcgcggaaggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggtgagcctggggcagggctggtgtggactcgccggtctctgtgctgtcaaacggagacgagaaatgttttgctcacaatcttttgagaattctcaagttgcctagcatagattcttgcaccttagtgactcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggtgagtaaaaattctgaacagcaggtcctaggtttgggaaatggagagtccgtttcttcgacattatttcctgtgcaaaatctggcacagggttttggccattccttccggagtgagccagaaagagaggactatgtgcctgcgagtgtcaggtgataccctgaagcatcagggcaggtggtccacgagttcttcccgcatcattgacatctccacctaaccaaccaatagaggtattgaagtcccttcagcccagacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttgagatggaatctcgctctgtcgcccttgcttgggtacagtggcatgatctgggctcactgcaacttccgcctccgggattcagacgattctcctgcctcagcctcccgagtagctgggactacaggtgcgccgccacacccggctaattttttttgtatttgtagtggagacagggttttgccccgttggccaggctggtctggaactcctgacctcaggcagtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacacatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttttgagacagattctcgctctgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtctgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacccgccgccatgcccagctaatttttgtatttttagtagagacggggtttcactgtgttggtccggctggtcttgaactcctgacctcatgatccacctgccttggcctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggctagagtgccgtggtgcaatcttggctcactgcagcctctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagggagacttgtaagccactcgtctctttccctgtttagtaagcatgatttcttcttttttttttcctaaggtttaatttttatgaagagagattccaatcacatggttcaaaatttcaaaacatacaaaagggtgtagtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctatttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatactgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgggatttatttttaattaatttttggtaaactatcaatgattgaatttgaccattgatggccaggtgtggtggctcacacctgtaatcctagcacttggggaggctgaggcaggtggatcccttgaacccaggagttcaagatcagcctggggaatgtggtaaaaccctggctctacaaaaaatacaaaaattacctgggcatggcggtgcatgcctgtagttccagctactcagaaggctgaggtaggaggatctcttgaaccagggaggtcaaggctgcagtgagctgaggtcatgccactgtattccagcctgggtgacaaagtgagaccctgtctcaaaaaaaaaaaagaattagaccattgatcccaggccaatttgctggcttgttggctgtaacaggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttaagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaaggcttgtgcctgtgcacactcccttgggaagggagagatggaacaaagataaatttcagatttctagattcagctcactgactccagattggcctccgtctacttatgatgaacctcatttatcagaacctgagtttacgagctcagtatgagaaacacagtattgatgcccttccgtcaggaacctggggaggtctcggtcacggaagcccacctgatgttataagatgtgttggctgcgagttgcagttgagatctgttggtcactgctgccctttgaaggccttagtgacatcctgtgggtgttccctgccgagtcctgtgggtagccccgctcactccccacacggttcctctgcccctgcacaagctgcaccctctgcctggtgcccttgccccaccccaactcttcgttgtgatttgtttttaggaaaactaagtccaaatggacaggacccccaactttctgactgcctaacttctcagtctctcctccagcctcaacagggagcctctctgacccccaccttaagctaaacaaagagtctgcagggagaggtgactctgtgtgtgtatgtgtttgtgtgcacgcgtgcagtagctttagtttctgcctcccccacaggactgtaagctcagtgaagcaaggactcatctgcctttcttggattccgagcattgcaatgttgtcaacaaatgaaaagctgagattgaacctcactcatcttgctctctgttagactgtaaacaccatcaggacagagacttgggattgtttcgtggacaaagagagaactcttgttggggttcaagggagtaagaagggcatcacctgtaatgcttagtaatcactgaaacaaggaagcactttgcatgtgcgtcctttacactgagggcacctgcggagctcactcccctagcagccacccaagtccgttcagggacctcattctcccacgggaagttggagaagatgggccgtggctctgcggaggggggtgtggacctgcctcggtacctggagcggttgaggcctgtcttggtggtggctggggcacaggtgtctgcctggcctgtccttacagactgtcagtgttctctttcctggtattttggtgtttgctctgtcaaacccttcttcctcattggttggaactaggtcacaagcacattaagtccggtcatttcctctgccttctgggggtggattttagcagaagaaacaactcctcccttgctggcctcatgacctctggtgaacactagctttcagcaaacagaaacttccagaggccagagcagcactcagtcgcctggccttccagcctcacaggcaagataagccaccctcacagacttctctgtgctcccatctaaacatctaaatcagccatctggtttccttaacagtagcacagactctgggagtttgagagaatgtgtctcttgtgaataagagaaaataagtccatactggggaaggtagctctccaaattgagatgaggaggtcagggtgggagggtgagtggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaaggagcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaaggaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggcccagtgggaactccttaaatgggaacttcctaaaggaagaatataagaaccaaagtccagggggcagtgccaggcccaacctgtgagggttcccagagttggagggctagagagaatctgcttccagttcaggccatagactctgaacctcacaggcacattgccatccatctcccctcacccccaaccgagacggagtcttgctctgtcgcccaggctggagtacattggcaccatcttggctcactgcaacctctgccttcagggttgaagcaattctcctgcctcagccccccgagtagctgggattacaggtgcccgccacaacacctggctactttttgtatttttagtagagagggggtttcaccatgttggccaggctggtcttgaactcctgacctcatgatctgcccgcctcagcctcccaaaatgctgggattacgggtgtgaatcactgcgccaccctctgccatccatcttaacatggcgccatgagccagcctctcaggaaaagggtctcatgaacaaatgaggaaagcaagtagaggtagggcagggagggagaggcaaaggaatgtgttgttggaaagggtagtgtgcccctcacagatgacagtacccgtctccagatgtgcccactgagagtttatgaaggggctgctccatgtggtccttgactgccctgggggagagtcacagaaagctataatgccactgcctctcggtttccccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaactaaaaaaaaaaaaaaattagccagacatgatggcacgtgcctatattcctagctacaggggagactgaggtggaaggattgctttagcccaggtgttagagactagagttaagctatgatggtgccactgcactacagcatcagtgacagagtctccctgtctctaaaaaaaaaaaaaaaaaaaaaaagatttaaagctaaataattaaaatcaaaaaaataaagttagaagttgctttcctcaggttttggctcgaaatataaaatcatacatgagactgggggccaggcacggtggctcacgcctataatcctagcacttggggaggccgaggcgggtggatcaccaagtcaggaaatcaagaccatcctggctaacatggtgaaaccctgtctctattaaaaatacaaaaaattagctgggcgtgatggcgggcgcccgtagtcccagctactcgggaggctgaggcaggagaatggtgtgaacccgggaggtggagcttgcagtgagctgagatcatgccactgcactgcagcctgggcgacagagcaagactccgtctcaaaaaaaaaaaaattcatgagattttggtagacttcagtgttacatgttcaaggataaaggaatggagtttctgctgaagtagattactattgtttgtatttcagatcactgtgtctgtttttattacaaaaacaacatggccacattacagacaatctatactttacctaccgcaacacaaaaacagaaaatttcattttccccttattcagtattttcatagttgtaaccatagtattcttttggtttgatagcctttttcttccatttaacccagaaaaactgcttgatattatgtgataactcaggttccataaccatctctctctctctcttttatttatttattttttattttatttatttattttttttgagatggagtttcacccttgttgcccaggctggagtgcaaagacgtgatctcagctcactgcaacctctgccttccaggttaaagcgattctcctgcctcagcctcccaagtagctgggatcacaggtgcccacaccatgcctggctaattcttttttttgagacggagtctcactctgtcacccaggctggagtgcagtggtgcgatcttggctcactgcaagctccgcctcccgggttcatgccgttctcctgcctcagcctcccgagtagctgggactacaggcgcctgccaccatgcctggctaattttttgtatttttagtagagacggggtttcaccgtgttagccaggatggtctcgatctcctgacttcgtgatccatccgcctccgccttccaaagtgctgggattacaggcgtgagccaccacatccggcctaatttttgtatttttagtagagatggggtttcaccatgttggccagtctggtctcaaactcctgacctcaggtgatccacctgcctcagcctcctagagtgccgagccaccacgccaggcttttttttttttttttttttttttttttttgagacagagtctcactctgttgcccaggctggagtgcagtggcaccatctcagctcactgaaacctctgtctcccaggttcaagcaattctcttgcctcagcctcctgagtagctgggattacaggcatgtgtcaccatgcctggttaatttttgtatttttaggagagatggggtttctccatgttggccaggatagtctcgaactcttgatctcagatgatccgcccgcctcagccttccaaagtgctaggattatgggcgtgagccaccacacctggcctctctctttgttttaattctgtaatgtggagcttttctttttcattttatttatttattttttaagagatgaggtcttgctgtgttggccaggttggtcttgaactcctggcctcaagcagtcctcccacctcggcctcccaaagtgctaggattacaggcatgagccaccacacctaactgcagagccgttttttttaatgcatcactaaggtacagtaaaatatgtgcatcttaagtggagagccagtgactgtgaacctgtgtacactagtgtggccaccacccagatcaagatgtagggtgtggcagggaggaaattagataactacttcaaactcagagtggggctggggagaaaccagtgtaggtaacaaagctggtggtgatggcagaaagaacaggcaggcgaagccatcaagagttatggagaggttcaggcatggtggctcatgcctgtaatcccagcaatttgggagactgaggcaggaggatcacttgatcccagcctgagcaacatgacaaaaccccgtctctacagaaaaacacaaaaatgaagttgggcatggtggttcaggcctgtaatcccagcactttgggaggccgaggcgggtgcatcgtttgaggtcaggagtgtgagaccaggccagccaacatggtgaaacccagtgtctcctaaaaatacaaaaatcagccaggcatggtggtgcctgcctgtagccccagctacttgggaggctgaggaggagaatcccttaagcctgggaggcagaggttgtagtgagcggagattgcaccactgcacctcagcctgggtaacagtgagactctgtctcaaaaaaaaaaaaaaaaaaaaaaaaaaaggccgggcatggtgagtcacgcctgtaatcccagcactttgggaggccaaggccaacggagcacgaggtcaggagattgagaccatcctggctaacacggtgaaaccccgtctctactaaaaatacaaaatattagccgggtgtggtggcgggcgcctgtggtcccagctactcgggaggctgaggcaggagaatggcgtgaacccaggaggcggagcttacagtgagctgagatcacgccactgcaacagtgagctgagatcacgccactgcactccagcctgggcgacagagcaagactctgacacacacagacacacacagacacacacacacacacacacacgaaaattagccacacacacacacacacacacacacacacacacacgaaaattagccggacatggtggtacgtgcttgtggtcccagctactgaggtggctgaggtggacccgaccttttggcttaggtgggaggatcacctgaacccagggaggttgagcctacaatgagctatgattgtaccagtctactccagcctgggtgacagagtgagaccctatctcaaaaaaaaaaaaaaaaaaagtactgcaggagggacctgcagagttggccctgggaacctgccggcctcagtgagtgccctggggaggcactagctaaggttatgagggttggttggtttttttggctcagccataatcaccattctgggttctccagctcaaccctaattttaaacatccgccatttccctccagttctagtcgttgcttgttttttgttgtttttttttcaatatacatatcagaaagatgttttatatcctaatctttggccacatttaattgccataggagaaggtaggatgttcatttgttttggtctaagacatcctccatgtacaaactcaggagcagagtgagcccttggaggagtgggaagctggcaagtttgtgactagcaccctttcacacccttccacatcctacatacctcttcacaaaggctgcttctggggctcttggaggcccctgcatccctgaacatagctatgaaagccatggaagtcctgtggctccaggggcagttttctttttttggagcatcatgaaaactcaggggcttcccagcaaaggcttccatcagtgaggcagccatagttatttcagtgaggtgggctttgtctcttgggaagtcctgtttgtccttgctgacagctttccaagctgcttgttctcatttccacttaaagctgatgcgttcccgtcaaggtccccaaagtcatgtaccctgcctggcctgcccctagattagccccaatcagttgtagcattcttgccatctcttagtaaattcaagaaagcaaaactttcacccacactctgcagttctgtgggagcagaagctgcaggaatgcagtctgtctgttggaagatatgggggaggcagacagtccacagggatgcagtggggacccagaggagagggaggttggccctggggacagaggaaggctgcacaaaggacctgactttttgcagaaggtgaaggttttgagggaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgccttttttttttttttttttaagacaatgtctcgctctgtcgcccaggctggagtgcagtggtgcagtctctgctcactgtatcctccacctcccaggatccagcaaccctcccacctctgcctcccaagtagctgggactacatgcgtgggccaccatgcactgctaattttcgtattttttgtagaaacaaggtctcactttgtctcccaggctgatctcaaccacctgggctcaactgatcttcccgcctcagcctcccaaagtgctaggattgcaggcatgagccactgtgcctggcccacttaaaagctttttttttttttttttgagatggaatctcgctctgtcacccaggctggagtgcagtggcgtgatctcggctcactgcaaactccgtctcccacgttcacgccattctcctgcctcagcttcccaagcagctgggactacaggcacccgccaccacgcccggctaaattttttttgtatttttagtagagatggggtttcaccatgttagccaggatggtctcgatctcctgacctagtgatctgcccgcctcggcctcaaaagcttttaaaataagtttctcctatcaaacttctgttcagtcatgcatttcctgtgtacatcattatcacacaaacccttcggccttctctgaagttttgtctcttgggaagccctgtttgtccttgctgacagctttccaagctgcttgttctcatttccacttacagctcatgcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcccagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaaaagaaaaaaattggctttctttgtgggggagccatttttcacaaagaaaccattgttttcctcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccagtattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgggcgcctgtagtcccagctacttgggaggctgaggcaggagaatggcgtgaacccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatattttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttgggaggctaaggcgggcggatcacctgaggtcaggagttcgtgaccagcctgcccaacatggtgaaactctgtctctactaaaaatacaaaaaatagccaggtgtggtgggggcctgtaatcccagctactcaggagcctgaggcaggagaatcacttgaacccgggaggcagaggctgcagtgagccaagattgcgccactgcactccagcctaggtgacagagcgagactctgtctgaaaaaatttaaaaaaaaaaaaaaaaaaaaaaaagccaggcagggtggtgagtgcctgtggtctcagttacccaggaggctgaggtgggaggatcacgagcctaggagttagagacttcagtgtttgcaccactatactccaaacttggtgacagagagagaccctatctcaaacaacaacaacaacaaaaacagtaatagttgagtacagtattctggtaatataagtgcactaatgagaggaatgaaactcttgaggttctaagtttgtcatctgaggtgcacatggtcatctctaaggccattctttgctcatggtcatataaaaacaggtgaaattttgttttgtgtattttaccataataaaaataacttggggccaggcgcagtggctcatgtctgtaatcccaacactttgggaggccgaggtgggtggatcacttgagatcaggagttagagaccagcctggccaacatggtgaaaccccatctctactgaaaatacagaaattagctggggatggtggcacctgcctataactgtaatatcccagctactcgggagactaaggcgggagaatcacttgaacccgagaggcagaggttgcagtgagccaagatcacgccactgcactccagcctgggtgacaaagcaagactccatctcaaaaaaaaaaaaaaagaacggggaaacagtacaaaaacaggaggtgagccagatgtgatcagcaggtcattgtttgctgactgtagtctaaagtaccggtttggttgttccatgtgcttttcatctgcctggtcctaggaatccaggtttccctgagagagggccacctaactcgatgctacactgctttttttttcttttttttcagtaaagacaaggtctcattatgtttcccagatctcacactcgtgggctcaggcaattctcccacctcagtttcccaaaatgctgggattacaggcatgagtcaccacacctggcttagctgccacacttctgaggcaggggtcttcataagcttactgcttggcccactgtgctcctgggagaagctgttgaaatccctactttggtcagaaggagtttggcacagaggaggcatttgatttttagcacacaggcattatgtgaaaagactgataacattgtcataggggtttttcctttttaaacgttttcttttttgtgaacttttatccaaagattgaaagaagctataagtacaagtaaagaacaggaagcaaagtaccaggccagccacccaaaccttagaaagctggatgatacaggtaagtggatacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgactgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagaccctgtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaaccctgaggacaccccgactcagcccagtgagacccatgttggacttctgacctccagaaccgtaagacaagtttgtggtcatttgtcacagcatcagtgagggactaatacagcctccagcccaagcagaaggagcagcagccacatggacaaggtgtgcaagacagtgttgatcgaatcattccacttctatcaagtgataggcccagaaacatcccttatctggaaaggaatttagggctcctggggcctcctccataggcccccacaatagccaggtacattgaaattggtgctagaaaccaaaggcttactgtgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgacagcaacctaggtaagactgagcaccacaccagcttctgtaagccactgtccttcaggcagcttacgccaagcatagcccctgcatgagcatcctccagcttcagttccctcaccacacatcacatcccacgccaagctgggtccatcttgccacctcactgtctctggaatctctccacttctcaccatttcctacttctagcccagccgagccctccccacctctcactttcatgaacagcaccagggacccaggagtccctgagaggccataaagtatagcctggacgtgaccgctcacttcatccttcccacctggccactcagagccctgttttcctccttgtgaaatgggctacctctgagaacagtggaaaggttacctgagccagaaagtgcctgggatggtaagagttagtgctcgtgttgcaattggcactttggccacacagcctccagcatgatgtttcaaaacggaagggtgtgcagggggccgggcgcagtggctcacgcctgcaatcccagcactttgggaggccaaggcgggtggatcacccgaggtcaggagttcaagaccagcctgaccaacatggtgaaaccctgtctctactaaaaatacaaaaattagccgggcgtggtggcaggcgcctgtaatcccagctatcgggtggctgaggcaggagaatcacttgaacccgggaggcagaggttgcagtgagccaagatcgcaccattgcactccaacctgggcaacaagagcgaaactccacctaaaaaaaaaaaaaaagaagaagtgaagggtatattcttccagaactctctcatggaaccccacacactcacagtgcagtccaggctctctttggctgccctagtcccttctgccctcatcacctgcaggctcgtgtgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagccactgcgccctagccagtgattattttttgaatggaaaagtcagttacttgaaattcaagtaggtgttggcctgtgggcagttctgtgagtttattctaagtagtgtctcagacttgctgcctcctcctaccgctactccctgagcagaaatctcccccgtggtgacctgggtcaccctgtcagtctcccagcccctgttaggagttggcaaagtgtaggggacaaataataaaatcctcccctgctgtaaaggtatctagtggaaggcaaaactgaaacccatgaagatgcacatggagtgtctgtgcacgggttttctcctgcttgctgtctgggaagccccagacagctgccacctccttctatgccctggactctgtcctccagagccaaagacttatctgaggcagaaggtgtgtctgcccagatctaaccactccagagaagcccagagaggcgtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccggtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttaccttttttttttttttttaattttaattatactgtttttctctttcttttcttttcttttttagaaatggagtctcgctttgttgcccaggctagtctccaactcctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgttagccaggatggtctcgatctcctgacctcaagtgatccacccacctcggcctcccaaagtgctgggattacaggcatgagccaccacactcagcctatctttttatttcattttttgagacggagtcttgctctgtcgcccaggttggagtgcagtgcattgatctcagcttactgcaacctcctcctctcaggttcaagtgattctcttgcctcagcctcccgagtagcagggaatacaggcatgcaccaccacatctggctaatttttatattttttagtagagatggggtttcaccatgttggccaagctggcctcaaaatcccgacctcatacgatccacccacctcagcctctcaaagtgctgggattacaggcatgagccattgtgcccggccaaaattacctttttaaaaaaactgattttggccgggcgcggtggctcacgcctgtaatcctagcactttgggaggccaagacgggcggatcacaaggtaaggagttcgagaccagcctggccaatatggtgaaaccctatctctactaaaaatacaaaaaaaattagtcgggtgtggtggcgtgtgcctgtagtcccagctactcaggaggctgaggcagaagaattgcttgaacccaggagacggaggttgcagtgagccgagatcatggcactgcactccagcctggacaaaagagcaaaatgctgtctcaaaaaaaaaaaaaacaaaaaactgattttgcttagatttgtggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagcccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgagccagtcgtttggtggaggagggtccttcccacacctttgtttaggagtcatcattcacacacacacacacacacacacacacacacacacacacactctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagctcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccttaagctacaggacagcgagctggtcctttctgccacttcttccccactcccatgcccaggaaggcctggttgctgatgctactttataaatgagttgctt

SEQ ID NO: 16720 - DNA, 10304 bp, Human
gggcagctgcagaactcttgagcctaatgagagactcaggccgggcgacgggggtttgatgggtggaggccacagtgagcccctggtcacatggatttggggtccatgtcaggagagccaggctgagtcaggtggcaggggtctgggtgatgtgggatgggactggggactggtccagagctcacgtgctctgagtggtcaggtccttgtgcaggagatgctgggggaggtgtaagaagaagggttgagctggggtgtcctgggatgtggggttacctgagccaggccagggcaggtgagtctcctagtagtgtacgctgaccccagagcaagtgtataggagcagtaagtgccaagtggggccctccatggtccctcaaagaagagacaaggtgtggggtgagaggcaggaaggaggaaggagagccagttcgggaagtgccagctgggatgggcagttttatcacctcacatccgaggccctgctgggagagaatggggggcaagagcgtagataaagcagggtgtgtgtgtggtggggaacggcagcaggcaccagggctcgtcctggcacgatgaaggaggaacccgtggctgggcaggtctgggatgtggcaagaggcaggaactgggggcatggaggatgggcgagggggcggtgggggcccgggcgaggctgcaagagctccctggccttggaaaaccaactcacacaccttgatctcaggtcagggtcaggcggaagggctgggaaggggccacaggggactaaatcatctcctggtactgggggtcccctggcagctttagggacggcatggccccagacgcgtggccatgctgtctggccggcattcccgcatctcatagggtgtatttattttcacttttctgttgcatttcttggaggtgtccctgtgctcattttgcccggctccccactgctcctttctgcccttcctcattcacaaatcgcctggcctcagaagacgccagaacatgtgacactgccttagagcctctagaagcactttttggggacctccatcattctctgaggctgggctcaaaggggcttccaaggcaggtctggaagggaccagccacttctcagtttccccaaccatcaatcagcaccccgaggaggaaactggggtacgatttcgccaagcctctctcagtcctgcttcagaatggaaatgctggaccgccttcccagaagcaccttcccagagtgtcccgacagaactgagtcagtcacccctacccccatgtcttcctagccccttccccagcctcacaggtacagtggtcagcagggcgagtgcactggtggtgtctggaggcctgaccctctggggccctgggcaacgtgttcccctcggagccccttggggcccagtggcaatgtgcagattggaggaggctacctctggggtggcttccagcgcccatgttcagttccactttatgaccgtctaaagtccacgccggccccggcccctcctcctggagcctccttctcagccaagccctagccctcctcctcccactgcccccctaaagccccccaaccagggggcacaggggccagtctccatctgctagtccagactcgctacctccccaaacccaggtgagtcagggccgtctggggcgcccactgctgggacccctgctgactcggccaggggccccctcctggcgatgcccatcttcagacaactcccgggacaagccaggcaggaaaaccacagggcgttttgtcgaaggcttcattataattttatcaatcaaattcttagaagagggaaaaagtctgttctccccaccctcccccctcactcgtccccccccttcactctcactttcttccattcataatttcctatgatgcacctcaaacaacttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcaggtaaatacacccgccccgcgccggcttcgcgtccccgctgcggggcgcggcggcaacttggggcgcttggcagcgcgagccggacgcccacccgccgcagacacacgaacacttggggcgcccgcgcagccaccggaggcgctgggtggcggcccggagcgagcgcgggcacatggtcccaagcaccgcacgccccgcggcaggttggcggcgagggagggggcgccgagccttcctcctcctcctcttcttccccctctccttctcctcctcctcctcctcgctccggacactcgctggctgctcttccctctgcgctttctcccagattcactctccctctctctttttcttttctttctttctttccgctttctcctttccaaccgcggtcccgggctgctcccagggaggggcgcgggcggcgagcagcttgcaaactccggcctgggacgggagcaggtgccgcctccatctgctggtgtctggaagcgtgtggtctgcgctaggtgagatataggggtgtggcccccctcccgcagccaccccggggcctcagcactgccttgggatgctgggacgaacaggggacccaggagaagtgaacttgaggaggcccctgtccccgctgttccagcatgggggatccgggggaggtctccagcctcactcgcccgctgaccccggcccccaccatcttcaggtgcccttctgcagagccctggaaaagcgtctaagggggcctggggggagtcgggagaacaggcccccctgggggaggggcaaaccaggacatgtcgggacagctcccagctctcctgtcacctttcactttccttcctccccgcccacccgactgcctatgaccttttgccttttctctctcctggtgcaccatttcctctccctccctgagccggtgtgtgtgtgttaggagggaggggaacccctgggacaagggacagcggatgagtcgggagaaggcatggagtcaggggctgtccggagctgggggaacagagagttttgaatgatgatttggggatggagagtggggacagccaggcagaaatggggtgagcttgagtgagataggggacactagggaaggaagagatagaggatgatgggggcgggggcagaattgggggcaattggcccagggagccagaatcaagtggcaggtttgggagggagatgagggtcaaccgaggactcctccccactcccccatgccccgtggcccccatgggtgcctggcttcggagatttgggctgcaatgggccagtgagtgggaagcgctgctgaggaacctgggccaccacgggaggtgggaagagaggggtctcctttctcctggtgcctgctgggcctggggcctggtgccttccagccagagggccagggggccttaggacctttgccttcctgagggaaagggtgggatggctgggagtctctcctggaccctgcaccctttgggtggaaatggcttgtgtcttgccctcatctttacgtcatcccagaagagagcagggagaactaaggtagagaaagggagacagagaaacacacgcagtgacagagtgaagactaggccccaggaagacagctgcaggtggtgagggggaaccaggagtcctctcccatgcggccattgttggacccccatccggtgtgccatgaccccaggccaccctttcctgcctttctactcatggcttcttcctgactgtccccaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctatgtaagttacccctgggatactgacaggagatggcagggagggggcttgtaaatatcattaggggctgtcctgatctgggttgaggggaccttttggggctggaaggagagaatggggagagggcttgattaaaccacccccagactcctgccacttcctgcccaagcttccccagggaagcttccccagggtgcccagttagcaaggggagaactgagtgcaaaggtggggacctggcacttcttatcttgtgattgtcctgctgcagggagcgagggatggaggggaaatgggcgtgaggcaccagggagatgcggttgagaggcagtgggctgtgggtgctgggcatggaggggcgtcccggaacattgtgagtgcagggatggaagtacttgtgtgtggtgccccagctagggctagacaccgagttttcccttctgtccccttagggtggtgatgatgatgatgatgataatgatgactgcgtgcatggctcagtctttgatctttagcaagggcactcacattacaattagttttggctctcatgacaattccagatgcttacagggcaaggagttgggtcctcatgcgctagatggggaaacagacgcaagagcttgcccaaagggttggcggcagggctgggacactgacccctgactcccacgtcacctcccttctgcccctcagtacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggtcttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagccttacgggtgaagctcagagaagggtcggatctgagagaatggggaggcctgagtgggagtggggggccttgctccacccccatcccctactgtgacttgctttagcgtgtcagggtccaggctgcaggggctgggccaatttgtggagaggccgggtgcctttctgtcttgcttccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagacgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatacttttttttttaagaaaaaaaagagaaatgaataaagaatctactcttggctggctctccggagtgtactgatgtggggagatgggctggaagggctgggactgtccctgtcctgggcaccagccaagtgggactcagcgaagggtggaggagggtgggggaggggcacctggcataggtgggggcagttaggtggtattttggccaaggcagaacaaggtgggtggtgtctagatcatggggtgcccccaaggagagagatggattgctcagaggtaaagggggtgctgggcacggtgggtcactcctgtaatcctagcactttgggaggctgaggcaggtggatcatttgagcccaggaattcgagaccagcctggccaacatggtgaaaccctgtctacaaaatatacaaacagccagatgctgtggcgtccgcctgtggtcccagctactcggggtgctgaggtgggaggatcccttgatcccaggaggtggaggctgcggtgagccatgattgcgccactgcactgcagcctgggtgacagaggaagaccctgtctcaaaaaaaaaaaaaaaaaaaaaaagaagtaaacggggtgccgtgtgatatctcagctcattccctcccaactcctcacttaatctcatgggatctccaggagttgccatccccacataccagaggaagaaatcgaggctcagagccatgaaaccacgtgcccaggggcacttgaagtgtttagggccagttagggccactccttcacctccagatctcatgatctttcccctacatgagacttcgaggacctgtaagataccagctgccaaggtctctgttgcccaggaatgtcctgttgaccattcagagggacataacaggacaactcgaatggctccagagtgggaggggataggtggtcctactcagaatcacacaggacactggggccagaaccaaggaggactctgcccgccctgattccgtccctcctcccgctgcctatttgggaaccgaatccccttccactgcaaccttcttcccagccttctgcaatcccttcctggggggattcaaggtcagaactgggaaaccacagacactgagactctggagcggccccgaatgtctccctgctctttgctctagggtttgggtctggggctccccgagccgagatttatttcggggatctgggcagtgtttctgagagtcacctactggcttgttcctgaatatttgtaagtgtcagctcctgtgccgggttgcaatgccttctagaagctcacaggctgggagggacacttaggatgtatgtgatggacgaggcacacagagggcggtgagtccacgatggggagagcctcgctctgggaggcagcagggggctcgggctgtggtcccctctgctctctgtaacatgaagggactgcattcaacaacatggcgcgaccttggcctcacctggaagctgattagcagtgccgaatcttgacctcaccccccgacctgcagaatcagaacgtacacattagcaagatcccaggagactcgtgtgcacattaaagtcggagaaaggccaccctgcgctttcatctctcgttcctcaggagtcccccacgccaagtgcaaatggccaagggccgggaaggcagctgcttgggagggagaggccggcaggcccacagctgtttctgagtcttcccctgaagtctcccgcccagtctccaggaggctggctcaggccctgggccacaccccacaacgtcctcccccaccgcccaggagtggaaacactcctcccctctgctcagggagacaaggttgaagcttttcaaaagcaacctttactaggaaactagaggaaaacaaaacaaatggcaaagcacagaaaggtagagaatgacagctaagtcctgggtggctggctggggacgccagggcctagggatgctccctgcctctctcagcctgggagagggccctgccctggcaaaatagaacaaaggactgttaattggttattgggtcaccctccaaaaaagagg

SEQ ID NO: 16721 - DNA, 22988 bp, Human
ctccagcctgggcgacagcaagagactgtctcaaaaaaaaaaagagtacttaatcttataggcttcttctaaaggttataagagttaatatatttaaagtgcttgggaaaaatacctgggatctactcatagcttgataaaagttttttttaagagaccgggtgtcgttctgtcacccaggctggaatgcagtggtgcagtcatagcttactgcagccttgaattcttgggctcaagcaatcttcctacctcagcctcctgagtcaccgggattataggtgcaagccattgtgcccaacttgataaacgttattatcatcgagtgtggaagctgaggaagagagaggagcccccaactttctggcatgggtgactgggtagctattcctgaggaaagaggttagagatgaaagtgcccagtagttagctgcacctgaagctgtttagtacacaagagtgttctgggacatcagtttgggccagattgtttagtctagaggcggaaggggaagtggaggacaccaaaaactgagaagagaaccaagaacagaattgggcggtgggagtggggatctccagcttcacagtgcaggaggtgaaacgggtcaggaaggaaacttgaatggaatggtgagcaagatgggaagacaggcaagaatggggcctaggagttgagagttttgtgaaggagtggtcaccattcacgcccagataatggctgtgggcagttgtttttgactttgtcaagagcacttaaaatgaatggggaccagatgggaggcagggaagtgggaccagcaagactgaagagaactcaggatgtttagctgccagaggaaggtgtgggagaaggcagcggcagaaaagaacatgaaggcagaggagaaacttcgtttctctaagataagagacttgaccctttgtttactaaggggaagaagctgctggtgaaaaaatattggtacttatgggatcgttagtgctgagccttccagtggaatttcacaaaacacttgagcattgaatgttggttaagacagtggagtagaggcagagagggcattcagggcagaagaatttgtcagcagatagtttcccatttctttattcagcaaacaatcattaaaaattccatgccaagcccatcgctgggtgcagggttacagacatggcctggattctggaacatggtttctcagaatgtagtcggagtccctgcatctgaatcacctgggcatttggtaatgtagcaggacgagtcgcagacaaaactcctcagacaccggattaaagaaggaagaggttttttattcatccgggagcgtcggcagactcgtgtcttaagagccgagctccccgaaaaagaaattcctagccctttaaagggcttacaactctaaaggtctatgtgaaagagtcataatagatcaagtaagcgtgaggaacgtgactgggggctacatacatcagctaacagaacaaaaagttttacagtgctttctcatacaatgtctggaatttacagataacaccagtagttttggtcaggggttaatattattattattttaaccaccagggccaggtggtggcaccaaggtcgtctagctatttatcttacttctgtttctttccaactttttgctttctcccttttctcctgtcttataaactagggaaaaggggaggttggggagaaactgggaaggacaacaggagaagtggtggtctcataccatagtaaaaatgcagattcctggtctcactgagatagtccagtgagagaggagccagggaagctgctcttctccctgggtccccaggagcagcccctgcaggtgcagtgaacttaagagaactgcttttctgaagtagagggttctaacctgagggaagtctgtgaatgaaagtctactctgaatgatatcctagaggagttttacagtggagaacctgctctgaaccagggactttaaaaccttatttcttttcctgtttgcacagcccacagaagaagaagcatcttcaaaggaggattctgcaccttctaagccagttgtggggattatttaccctcctccagaggtcagaaatattgttgacaagactgccagctttgtggccaggtaacagagctacttgggtgggtcagaggtgggtttcagcatgaagagacttcagcactgaatcagcacaagggtttttaaagagacgttgttggcttgggccttttagttcataaaaaaccacaacatggcactggggtaggcaataggtaggactggtgtccctgacacagcatagcagtggccaaagtgagaatcacacttagccccacagtcaccaggagcctctgcttctaaaactggcctgaggaaatgcctggaaagctgcttcatcacagatggtgtgtgtctgtgcctgagctgctggcctgaggaagataaaaaggggagtttattattctcattgtacaaagaccacattccaagagcctcaaatgacccatctgcaaaatggaaaaaatgccatctcagagttgttgtgaggcgggagtgaggtcatggggctgcatgcagttcagttccacgcgggtgctagtcacctcctcagatggcatgggcattgctccgagttcctcctgtctctcctcacagttccatgcaggtgctagccgccacctcagatagaatgggcattgttccgagttcctcctgtctctccccacagttctgtgcaggtgctagctggcttctcagatggaatgggcattggtcagagatcctctctctccccacagttccatgcaggtgctagccgtctcctcagatggaatgggtattgctccgagttcctcctgtctctccccacagtcctgtgcaggtgctagctggcttctcagatggaatgggcattggtcagagatcctctctcttcctacagttccatgcaggtgctagccgccacctcagatggaatgggaattgctccgggttcctcctgtctctccccacagttccacgcaggtgctagccgccacctcagatggaatgggaattgctccgagttccccctgtctctccccactgtacttaccctcacatccttagatggaatttttttactggccccttgactccaaaggtcagtacattctctagggtatttaaggtattcctttggcagccctcagtccatgtccagcctacagatgttttgtttgtcctcacagtaattttttcgaaactcaaatttgttgctactatttaaaaatgaggaggtcaggtgctgtggctcttgcttgtaatcctagcactttgggagcccaaggtgggaagatcacttgaactcaggaatttgagactagcctgggcaacatagtgagaccctgtctacaaaaaataaaaagttatctggctgtggtggcatgggcctgtgatcccagctacttaggaggctgaggcaagaggatcggttgggcccagaaggttgaagctatagtgagccatggactctagcctgggtgacagtgagaccctgtctcaaaaaaaacaaaacaagtaaaaatgagatttcacaatcagtctggatttctggacagttccttcatgtgtggaagcaggcccaatcagcatgtgttctccagggaccacgtcacccccctgaggcagtgtctcagtcagtatgcatcatttaacggatggtccttcctttcccaacctaataaaattagacataaagattactttggttagactttcttttttttttttttaaatgacatggagtctcactctgttgccaggctggagtgcagtggtgcagtctcaactcactgcaacctctgcctcctgggttcaagtgattctcctgcctcagcctcccgagtagctgggacaacaggcgtgcgccaccacgcccaggtaatttttgtatttttagtagagacgtggtttcaccgtgttggccaggctggtctcagtctcttgacttaatgatcccccgacctgggcctcccaaagtgctgggattacaggcgtgagccacggcaccagcctactttggttagactttcactatgtcagctctgcagattcatctcattacatttcaagggctttgattacctttgagtattaggttgaaagcttctctgtgcttgattgaacattgtgatgatgttgattgggtcatgtcagatttagacagtgttgtgtttaagataaatgtttaatggctcttagcagtgttcatgcctccccttttcccctgatactttaaaaacagaatatacagaaaaggggagttgggtgaagaatcaccatattctcattaccagagtagtgtctaccagctgttttcacatttttctgtttccttctgtccttggaatcctttttttagatccttgtaatactagtaaagatattccactctgtgttgtaagcatttttccattttgctccatggtcttcataatgccctgtggtcctttattaaggggatgcaccatgtagaggtgaaaggctttccttgacttggccaccatttctgtattttccttagaggaggaggtttccaacatttcttttttagagacagagtctcgttctgacacgcaggcaggagtgcagtggcatgataacagctcactgcagcctcgaactcctgggctcaagttatcctcccacctcagcttcctgagtagctaggactacaggtgcctgccaccacacccagctaattttttttttattttttttattttttttagtttttttgtatagatggggtctttctgtgttgctcaggttggtcttgaactcctggcctcaagtgatcctcatgtctcagccaccacaaggtggctgggattacaggcagtgaccaccgcacctggcctgttcccaacatttcattttggcaaattaagctgtggggaaatctctgagcattttctttcccttttagatcgtttccttagaagaaaattctgtgtggctcattattggctaaaagagcatccttaaaagatttcttaaacattttgccaagtagctttccaataattttgtgccatcctctgctgctaaagaaataagaggatatccaaggtccctttaaatatatatgaccaggttaggtggctcacgcctgtaatcccagcactttgggaggccagggtgggaggatcgcttgaacccaggacttggacaccagtgtaggcaatatagtgagacccctgtctctacaaaaaataaaaaaattagctgggcatggtggcgcatatctgtatttctagccacttgggaggatcacttgagcctgagaggtcaagggtatgatcatgccagcgtactccagcctggggcgatagagcaagaccctatctcaaaaaaaaaaaaaaaaggaaagaaaaaaatccaaaaccatgcacatccctagattgatttttagctatggtgattgcttttgtaggcatttctaaaatctgtgagccagtgtggtggcttacacctgtaatcccagcactttgggaaactgaggtgggcagatcacctgaggtcaggagttcaagaccagcctggccagcatagtgaaacctcgtctctactaaaaatacaaaaaattagccaggtgtggtggcgggcgcctgtagtcccagctacttgggaggctgaggcagaagaatcgtttgaacccgggaggcagaggttgcagtgagccaagattgtgccactgcactcccacctgggtgacggagcgagactccgcctcaaaagtaaataaataaataaaatctgtgaacttatcgtttacattgcaacaaagagaccaatatccaagttaaagcaggcatgcagaactctgtgcttcacttctcctgggttcacgtatatttatggagcatgcagtagaaatgcacaactgagcggttttccaaaagttttttcgctaggttaggccttttcatttcctgcatgttcctgtcaagaaactgaagtggaaattacccttaaaaagtcccaccagctgggttgagtcagaatcatgtctttttctgttgaaatctattccttctggtggagagtatgattctaaaattaacgttaagctaatttaaagcaactgaatagcttggaatgaacatgccaagccttctcattgttttatttttcagattgttcccagatggggtaaagttatggcttaggcagtggtacaggagacaaccagggcccctttttccaggagccctttgtctgcccgaggcatttgctgggtatagtggcctagtttagcaggatttaagtgtgcattcaccttcattcttatgtgtggtttgcattatttaaggagtagggagaattttttttccaaagcatgaggttccagttagactaatatactgtcaaattgagacctcatggtgttagttacacggcagggtatgaccacgacttgctgaggagccagcctgggtgtcgatcactagtgtggcacataattgctgtggtggttgatctggggcacagcactgcctgtaccctgtctcctgccatctgtcttaaaaaaaatttaaaaaatttttgttttcagaggtgaaatttcattttgttgcccaggcttgggtatgatcttctgggctcaagtgatcctctcgcctcagcctcctgagtagctgggactacaagtgtgcgccactgtgccgggctcccaccccctcttaaactcacaggccagggatatgaaagtctgaagagtggagctggctagctggcaccagatgccggggccatgccttggtgtgtttggggcagttctaagtacaaggttctcgccagaggagcaatggaaggccccacagacaatgtttatggaacaacccctcctagccccttgcatttgcaggccactgtacgatttgaaaagactttgagggctgggttcagtggctcacgcctataatcctatcactttgggaggccaaggcgcttaagcgcaggagtttgagaccagcctgagcaacatggtgaaaccccgtctctacaaaatgtaaaaaaaaaattagccgagcatggtggtatatgcctgtagtcccagctactcaggaggctgaggtgggaggatcccttgagcccaggaggtggaggttgcagtgagctgagattgtaccactgcactccagcctgggtgacagagtgagaccctgtctataaaacaaaaacactttggcatctcctcaataatgtttcaaggtagaaagggaaactggtgttagctgcattttacacatggggaaatggaagcaaagagtagtttggtaacttgctgtgggtcagagtgagtcagcagtgaacctgagacttgaacgtgttcatatcttgtgtctttaaggtccgtgtactttctgactgacacaggtgttgtatataagtgtggcactttgaatattactgttgggacattttaaaaatcagggttccctaaacatcattatagggacattttttcattatcctgaggttttgaaggcttgctggggacatggggcatatctggggaaccatcccaggtacagacagtggttggagacctccctgctgatcttaccacacccctgtcatctgaaggtgccttatacagctgtacgagtctgggttcttgctgaggatgtttcctgtgtgggcctcaccagtataatgggggtggttttagggagtacttggacaaggcgttaaaccaactatttgttttttgtttgtttgtttgtttcttaaagacagggtcttgctctgttttccaggctggaatacggtgacacgattctagcccactgcagcctcagactcctgggcacaagtgatcctcccacctcagcctcctgagtagctgggactagaggcacacaccaccatgcccagttaatttatttttatatttttttgtagagttagggtcttttcttgttgcccaggctcaaatcaactaaattttcatgtctttcagtctttcttgttactcagaggacaaagtctaggtttggtgctcatgtaccttttacacctctccagcacttgctacccctttgaactaagagaattagtctcagcaaacttccagctaaactttgacagtattactttgttttcattatgttcacttttgactaccttttgttggtaaaggcatactgatttttttttatttgaagtagtaatatgtattctccatcttaaatagattttttttaaagtaaattttattaaaagaaatgagcgatagcctagatggttttggaaatggcagaactggaaaaggagctaaggaatgactgggttcagggaaaccctgtggcagaggtggcctggttcaagctgaatgaggcagatggcactgatcgccaatgccaggaagctagaggaggacgtctgctgagggctgggctggtttgagcagtgggtggtggcaagaaggacgttccaatgggcagtgttctagatcacagcaggcacaagggagtggtgtttattcttgttgttttttcttcctccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtttggagcccagtgcccccttcacttacgcagggcttgagagggaaacagggatagggagggagtacacaattaactccaaatctcacaaccacccagggagagaagtgaggtcgttatccccatctctcagaggcagaccgaggcccagacagcaaagtactgatgttagttggcatttcccgagcactgcttgtcaagctctgtgcttggtacttcaggagtcttgtctcattgactcctcacagaggctgtatgaggaacctgagagttgggggacgtgtgatttattcaaggccttgctcagggtgtgagggcagtgccgtgatgtgagggcagcacttcctacttggctgtgctgaaggatgcagtgtggcctgtgggctcctccttgtgccatcccttcccttctatctcttcttcccaggacccctccatcctggcctcccctgataccaccttccctgtgctgaggcccagcactagggactattaggattatgaatgaagagagaggctgacatgtttttcctcctgtccagacctgccttctgcactcctgaaccatggtggaaaaggcagtccctccttttgcagtgggctataaaggttgaagtcaggttctaagaccttgcgttgcaatgaggcctaggacctcaggctacctcagtttcttcatctgtaaagaggattcacagtacctgtgctacctcatcgttcatgcggaggtcatggaaacactttgtacagtggggttttctgcacacatgtaggccttctgcacatccatccctcttggatgggatttaataagtcctattcttgttggatcttctgtcacccagttttggccctcaatttcaaggcaggagcagagatacagaggggaatggttctcactcagccattcaggaagttgaggccatagttggctgggaagtcaatgctcttgtgatttagaattctctcacaccaagtgctagtggtgtgtgcataattaacagaagtctagaggttcacagcatcctgctgaggggtgcatgcccatgtcccctcccctcccctcccctggagcctgttcacccctgtgcctctcgcctcatactccctttgcatcttaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaaggtgcctgggcaggatggggctggggtcctgggcccaggaaaggaaaacatcttatgcttggaagcactgtgtccactcactgtctacaaggacatcgcttctccatggggcctctgagcaaatgttttgaatcccagtttaatgtaaaaccttgatttctattcagttatttctttaagtgcaacacagactgccggtttctaaagagaagggaaatacatgcttgctaactaccattaggcgattgcctgctatgtgacaaggccacgtggtgcttgctgcttttaagtgcatttccgttttcagttgcctagtaaggccctgagaagaagccaacctttaagagttgcctccttttacctaacttagtcctcacaagaagccatgaggtgttttccccccatgtttgagaagcagaaacaggctcagaaaggtgaagtcacgtactcaaggtctgtcagctagtaagtactatgctgagatttaaaccacatttgaccctaaaactttggttcttcagcttataaagtgccttaaattggaaacagcatttaaataggtgttgagagacactttgatgtcatgtaagtcagtataactaacatcactaagaaattatgtatgcagcatcttctcatttaatctccggtagcctataaggtagccactattgctatgttcactttacagaagagaaaattgaggtgcagtgaagttagcatggccagggtcacatagctaggaggtggcagggctggggcttgagctctggcatttttactccagaccctaagaactcaattatcatttgacagagctgcaatcaagaatcaggacaagtcagttctggcatttaaaataatcagattattaatttattgcaaagtgcactgacagctttgcctgtggcacatttttcttgctacacatgtcatggaggttgttttccttccctttacagtgggatggtctgtacatctcttcttcatatccagaaacaacacctcaaagatctgacttgaaaggacttgagaatttcctaactctactcacttttaagtacataattagaattttaacaatgtgtgtgtttagaaaatgaccaaatccagaagctagtatggtagctaaaataacagtcattcaaggcccaaggcccaagggtttctataaatatgcaatatcaattttaaatgaaccctggattaatttctcccagtggactgcttccagggttaaaggtcccagatcactttttattctgttactttcctgttttttcttcagaacttgggtattggcatttaccactgtaacttgaggttcctgctgtctgttctagccatggaagactgagcagatagattcttggggtagaggtggaaggaggattgggatagggccgagccactttgccagtggcagtagaagctgttggggctgtttagaacaaaggcagcatttgttctctcagtaagtatacattgtcagacattattcagggggctggagatgtaatcgtgaacaaaagagaaatccctgtcttcatggagtttctagtctagtgaggaggagtcaagtgcattgtcagtgtctgttacatggtgctaaatactacagagagaaagcagggagcagaaatagagggaggtggggcaagtacgctgcggttctgaataggatagtcaggggggacctgcgtagtgtttttgaaaggatgagagcaggtcagtgtcatgaaagcagccgtctcatactgaccgtgttctgggtaatcggctagtgctttgcatgctttcctgctaatcctcgaagccacctttttaagttcatggtgccaactttgagtggtggtgccattattttggagaaggaaatcaagttactgaggttaagtaacttgccctaagtcccacagccaagtggagctgggattgggacacagaatcccatgcttcctcatctcctgtgctttatcacaggcccaggaaggctgcctctttgtactgcgttgtaaagcactgacagttgctttaactcttctgtatttcagatcttgattccacccaaaggtttattttcaaagctcaagaaagaggctgaaaacccccgagaagttttggatcaggtaaactgaatagcatttcttgcaaccagttactggtggttggttctgttttatgtttgaaaacagtctctgaggcaggaccttgttatgttccagtcatgggaatggtgggagaaaaggctttgttggctacaaaggccaaagaaacctggagtccggatgcttcccaacataccacaactttctgctttgctctcagcctcaatgtatctccctcttttccactctagctagaagacagaaggccagctcccaagcagatcagagggtggaattttcattctgtcccaactctgcacctgggtggaaccaggtgcaaatgccatagtttggaaccatacttccattctgttccgaaggaggcgctgactttgatgaaagccctggaggtggtagcctcatcaggagcagaccctgcttcagcgtagcaccaagctgtttcccatctctgcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaaggtaggtctgtgaggagtgactccagatggggagccaggaactcagacttcccgggaaacctggtgcaggtgttcccagagagcagtagaatctctcagagggctttatcagtgctgtctcctccctgctcccaaaagacttcagttctaccactttgcccaacttagattcaatacgtacttgccagaccctagatgggcctctggagatagctggagagaaaacagacatggccccagcccttggggagctcagacagggcaaataggtgggtctttgataaggaatacctttgcctctggctcaccctctagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgaggtaagctgctgggcaggcctgcaggatgaccttttcccctgaagccccaggaggtcgaagtgctctccaccagtcagatccagctcccctgtgagccttgaaaggaggcgtgggtcctgaacaaggccatacagctgcccaagtccaggcagcacagagcctctttccagctccggcaacaaagattcattcataggcaaggatctaaaagctgtgctgacctgttctgtggccgcctccctggcccggacagcctgctctcactgcctcgtgccagccctcagggaactcactgcattaccctgttctgttttgagctctcagctgggctccaagctcccagagcttttctaaatgtagcccacgcttcctttcaggcatccctacccccttcaagccaggccctctaagcaggcatggagtctccagaaccagactgttctcccccactcggaaataatttgtgcacagcctgagaagaaagggcccctgtctgtgggaaatgactttttctctccctcccagcattgctgtgtgagcagctaccattgattggcgactcgccgcccccacccctcgcccccttggcactgtccccccccggcatgttaagtgcccttggcctcttgggactgcctggtgccagctgctggaaatgcctgggaggagtgctaggaccgtggcctcagcactcccattcatgctgtgaggaagcagcttggcctgctgccggctggcctcagctgccctgggaggcttagcacatggatgctggctggcagaggccaaggctccttgccacccagagacctgccaggctcagctacagggaggtggcctcagcccctctctgagtcctgccattgctttgcttttcagggttcagatgatgaagaagaagggcagaaagtgcccccacccccagagacacccatgcctccacctctgcccccaactccagaccaagtcattgtccgcaaggattatgatcccaaaggtagggagggcctgcttcccaaccctcgggctgcccaggaagtcctgtgtgccctcatgtgttcctcacacccgtctttctaggagggcttgaggtgcagcttattgtaaaagcattgcaagcccgtctgttacaggtttcatggtgggaacagggcccagtcatctctggtgccctagtgcctttcacagtgccaggtacaagagtggcactgaatagatgccttgatgaatgatgcacgcatgaaataccaccctcttaactcaggtggctgcccaccagtgttcttactgaaacatctgtttccttttagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtgaggtgggggttccaggagagcccatggtagtctccgaattacagccatcttcttctaagcaaacatagaaagcaacaattgaggtcaacaaaagcttttgaggagagttgcactctatgatattgcaagagaactccccactttccagaagaactccccatagaaattccccaaaggcagacactgaaggagatgccatgtgcctgttgacatcccagagcaagctctggctttagctggaagggcttcctgtggctgtttagaaggagagcactgatggctggagtaccatgagctctttggaatggggcaggaactgtgccacaggtgggagactgggcttctagttttgactctgccacttacaccatgtggccctttccacacagttgccctctctaactcaccatcttatttatttatgtgttttatttatgaatgacggagtttcactctgtctcccaggctggagtgcagtggctccatgttggctactgcaacttccgcctctcacgttcaagcagttcttctgcctcagcctcccaagtagctgggattacaggcacgcaccaccacacccggctaatttttgtattttcagtagagacggggtttcgctatgttggccatgctggtctcgaactcctgacctcagatgtgatcctcctgccttggccccccaaagtgctgggattacaagcatgagccactgtgcctggcctaccgttcttttctaagtcagaggggttgcccaagcactgggtttataggcttagatcgggcagctttccccgagcccagaggacaagagttggggccctgagtcaccctcatcccatggaaccagcctcctccctgcacaccagaaaagctgctctcttgtcaggacacctggtttattttctctttctatcctctgcctctgttttgtgactgtacaggtctggatattgagagcagcttgaagcagttggctgagcggcgtactgacatcttcggtgtagaggaaacagccattggtaagaagatcggtgaggaggagatccagaagccagaggaaaaggtgcggctaaagtggaacctagtgccttctctgccccccgtcttccatacttggtcttagttccagaagcattgtggctttgctttcacttgcaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacagtaagccagcatctaccctggaactgacttttttagagcttcattcttgaggtcggacactgttggctgagaagtgcagctgccttttagtggggcctgagtgttgggtgggtcagtttgaaagagaaagagccctttaaatgcaagtgggaacctctctcttgatctgtttgtggaggagggttggaacagggagggaggtaagtggcaaatatgagaaaccagttggcgtcagagaagggctgcagggcttattgggtctttgaggactgttggcttgtctccaggagagacttagtcgaggtctcggcctcttttttttttttttttgagatgaagttttgctcttgtcgcccaggctggagtgcaatggcatgatcttggctcaccgcaacctccgcctcccgagttcaagtgattctcgtgcctcagcctcccaagtagctgggattacagggatgcgccaccatgcccagctaattttgtatttttagtagagatgaggtttctccgtgttggtcaggctggtctcgaactcccgacctccggtgatctgcctgccttagcttcccaaagtgctgagattacaggcatgagccactgtgcctggccaaggtctcagcctctttagtgactctttcagtgtttgccaaagtagcaggtcgagtttgacccgccaagtcccaagtagagagagtgtcatcctcgggctctcagcagctcagttcctattggacgcccagtgtaggccacagtttctcagtcccagggggccaggacgtagttgtctaacctccatcctcagagctgcaggcagccagttgccaactgtgtgtgaccttggagtccaactttggcttcctgtaatctgtgggtctctttcctgcacagatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacaggtcagtatctcttgcatcattttccaggccattagttcagggaccacgggccaagtactgtcagcagagcagtggctgatgctagtgccagctgttccagcagggtatccagcccagaggagagccctggcttcccattgaaagatccgcaaccctagagctgggagccaccgttcctggtagaaatgagaggctgaaatggtgtagccagtgtctgtgcattcagggatcaggtccccaacaggctcagaggcctgagaaatgcttgttgcttggcactagctccatccatcagtcctgcccctcctgcagtcctctgctgtccaatctgggcagcctcccaggtccccttgccagggaacctgctggctgccagacttagcagggaacagcacttgacacctctgactagaggaaacctttgcaaccttccctctcaacttctcatcagccctgagtcctgggccccttctgccctctcatggggctgcttattcttgtctttgcagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaaggtatgtaatcccagaatgctgctgaagtttctagctggagggttcagtcccgcccctgtcgtacacttgcgaaactgaccctatttcactcccagtcttggcttctggggcctaggtcagctgttggaggcatctaagggcttctgagcacacagtgaatgtggggccaacaattggaggagcagagagcattggtggtgatggtgatggtagtggtggcagaggtggtgactgtggtggtccctctggtgtagacttacagaggccaacagggagacccagcagcacgggcagcacaactcacgtgtgagagggaccctagacacctggaggaaattgtgtgtggtgttttaaaatttactgtggccttcctccccagctctagcccttaggaggtctgcctgttgggtgggatcctgttggggtcctggaataaggggaggtggggaccttgtcactgctaatcactagggaagctgtcaggctgcagtaaggagacagaaacagccccggcctctgctcccccaatgtatttgaccaaattgtttcgttttgtttttgcaacctctgcctcccgggttcaagtgattgttatgcctcaacctccggagtagctgggattacaggtgtgcaccacacacccagctaatttttgtatttttagtattttagtagagatggggtttcgccacgttggccaggcttgtcttgaactcctggccgtaagtgatccaccacgctggcctcccaaagtgctgggattacaggtgtgagccaccgcacccgctctgtttgttttttaataatagttcccatttcttaaacgcttaagtaccaggatagagctaagcactttacagacacttcccctcaatactcaaaacagtcatgaaccctgtctggtggataatgacattgaggctcagacaaaccttgttagctgggaagctgagttgggaatccaggtcttccgaccctgcaggtcatattcttttcccttggggtgtgcagagtattttcactaaagttcttcagtttagctccagactcaccaagagacaagatagagattgttttaaagaaaagaaacctaatcttgcaaaggggggtgacttgtacaacctcacaaggggttatcagtggtgaatcaggccagaatccaggagcccagatgcacaggtgacattgtctggacaggcctagggatagcagagcatagttcttgattggctccgagctccctaggcataatgaccacctcctgttttgtagggtccagtgtccatcaaagtccaggtgcccaacatgcaggataagacggaatggaaactgaatgggcaggtgctggtcttcaccctcccactcacggaccaggtatgggtactgccagaaactggcatcaggtgcatgggaaccaagcattcaggggaaagcttcctctagctggccttaccaaggagttgaatgaccgctgcttgatcccacaggtctctgtcattaaggtgaagattcatgaagccacaggcatgcctgcagggaaacagaagctacagtatgaggtgagtcagtttgtccacagacctgtcccttgggtcctgacacctctgctttcacagaagctaaatctgtcatggaagctaaaaggggagtggagtgatatctgggtgtggccatctgaatccatcctagaagtcatgatgctggctgggagtgttggggcaggtgtgcccaacaatgcaaggctctggtggggtcacagtagagtcttgtgtgggatctgtaagattctttgcctcaatgactgggcatagagatttagtgacaagacttaggcatgctctggtgggttcctgatccagtggttgggccatccctgccagtatgacctcaggcagcctgacttggaggtgatagtctagccccgcctgatgccaggtcacatggaggcattaatgttcttcttctctgaacttgaacaaatccctgctctgggcctcagttatctctatccattgaggctgttgggctaagtgatccctaaaggtcttgtgatttcagagtcagagctccatggagttggtgaggggccaactttttggggagttgagcttttgagtcaaatgttgacaaaggggaggagcgtaattggtgggaagaaaggaaacagtgggaggaatgagaggcctccagtccccaacaccctaccttctcacaagctcctgtatttgctaagtccagagcgcaaacagaccaagtgcacagttgtaaggttgcagcggtatccccaaggctgggttgccccacgctaaggcacgctgtctgttttccagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctctacttttatccattttatccattttaactcatgtaatcctcatgtgagtattcctgtttaacacttgagtaaactgaggcacagagaacataagttgcatgccatagtcacacactgtgaaagtgaaaagagaatgtgtgcaaaacacgtcacagtcctggtttctgagtaaaggcaggctgttatctttagaatcaagctatcacagggagataggcaatgctgtgggtgttggaggaaggtgagagcctgttgctaacaatttcctggttttaaagctaaggctgattttattgggaagatctcacatgtgtgtggcccctgagagttcccagtgccttttatttgcagtccttccatttggacctcctagctgccccatcaggtcatctccagggctcagaggggtgagaccatttcccaaggtcacagaaccagctctctagtcaccaccctgcctctccctctcacccagagtcagtaccagttttatggctttattacaaactgctgggtccctcccattttcaacttgattgatgggatgtcatcccttatcctgtctgacatttgcctctggcctggttgctagaagtttgccccaggggcaagagttgaaatttggcttcctgaggtgggctttgtggtttgcgtccctaaagtgagcccactactggttgcttgtccatggccaacaccagaaatcccctgagcactacctgggtctcattccaagaaggaagagggtcaggagacctggggagtctcatattccaagttcttctttctttctgggagcagtgggcagttcatggtgttagggcactcacccccacagactggcaaaccctgcaggacttccgtggctgaggctgtgaccggaggccaggaatgccgttgggtggattgtgagtgaatgggccctttgagctgccctctagagagcaaatccagtttcctggagctcctgaatgaatatctgtactggctcgctcagatgcagaagctccattgaccatgaggccttgtgaacatcagtggccacaggcccagtgtgctgcttggcactgcactagtttaggacctgcagcatgtaggtagcgtcctagtgtttataatacaaagctgctctgcacagcttttctgattcttcttgcaatctcctgaggattatctgccccatttttaaaacgaggtggaatacccaaggtcatgtagccagtgagtgctctggaaagccaaagcagctcatcccttcctggggaccacactgctctgctccaccagaccacactatgaaataggaataagtgctcctgttgcaggactgctgggaaaacaggtggggtgggacttaagtcaccataattttgaagacttgcatgcagagggctccaggaattgtagacattaaggaatttcactttcagttctacccactacttaagtacttgtcatgtactcttagaggaggccagtaatgatcagaaccattttactttaaaattaataatattgtattagagaatatattaaatggttatattgggttatgttaggatatatacttgaatggaaatacatgtactattagcaatcatatttcatttatccctgtaattaga

SEQ ID NO: 16722 - DNA, 50836 bp, Human
tgttctgtgaagtttttatgttcaataagagaacacaccaaggtctatttgtgagtgccagaccatctcctggatgtcaggggctgtttttctcttagcgcttggtttcaaatccaggtttgtgtgactggaaacatcccttgtattacttcttgatcacaggaacttgcaaaggtggctggcagactaggactttcatctatgagcttatttcatctactattttttatttttttttctgagatggagtttcactcttgtcgcccaggctggagtgcaatggcacgatcttggctcactataacctctgtctcctgggttcaggcaattctccagcctcagcctcccaagtagccgggattacaggtgcccgccaccacgcctggctaatttttgtatttttagtagagatgagtttcaccatgttggccaggctggtctcgaactcctaacctcaggtgatctgcctgcctcgacctcccaaagtgctggtattataggcgtgagccaccgcgccggcctttatctactatgttcacctcctactcaggtccgatccctaaccgttcctgggataactgtaggtacttaataaatgcttgttgaatgaatgaagatggctgtcaagaactccaatgactgcttgagtgcaaatcacaagctccatcacctatcagtatgtgatttgatacaatatgtattaacagctaatccacaatccatattcaaatttcattacttgtcccaatattgtccattacaactattccaccaccaccactaccccagtccagggtcctatttagaatcacacaccacattttgttgtcatgcttctttagtctcctttaaactggaacagttcctcagcttttctctgtttttcatgacaatgagttattttgtagacagtgtccttcatttggggttctctagcacttcctcatgagatgtgtacggtgcacttttgacagaaataccacagatgtgttctcagtgcattttattaggaggcccttgatctgacccattaactagtggtgttaactttgatcactttgatctgtttgttctgctaggttaaacctctgtaacatcaccattttccctttgtaatcaatagctaatttatgggagacacttttgctgttgtaaacatcccgtttctctagttttaccacacattattgatttcctaattccaccatgtttattagctagcattctactaaaaggaagactttcccttcacccattaatatgctcacttctttatgtttgtaaagactcatggattactattttattcaattagttatactctattactatcactccatattttgattctgaaattgccctgacttggccagtaagatctccttaaagacagctcctgtgttctttgacacattcccatgattcttattaccatcatccttatattctggtgtaacaagatgttccaagtttatctggtactttccggaatgagttagttctttctctctctcttttttttttttttttttgacggagtctcactctgacgcccaggctagagtgcagtggtgcgatctcagctcactgcaacctccgcctcccgggttcaagcgattatcctgcctcagcctcccgagtagctgggattacaggtgtgcgccaccacgaccggctactttttgtattttgagtacagaggggtttcaccattttggccaggctggtctcgaactcctgacctcaagtgatccatccgccgcggcctcccaaactgctggaattacaggtgggagccaccgcgcccggccggaatcagtttttttcttttaggagccccgaacccaaagctctttgaaaagctgccgaagctccaaggttcctccgcttcctgcccgcaggcggaaccttagagcttcggccatggaaattaacctcttccggttggggccggaagtccctccgagaggggcggctccgcgtcatgtgactggagtccgcgtaggaggggtcggaggtcttacccaacagattgacgcggcgttagtattggccgtgtacccgaaaaactgattgactgggctggcgttaactgtgcggaggcaggtatgtgaggggctggggttggggcgggggcgccaaagtttagggacgggggcgggagacccgggtccgccttcccaggacacacgggcttgaacatctgagcccaggggcccagagacagcaagaccggtcgtgtctgtccccgaaaagaggacgagctggcgttgtggttctgcgtcccatgaatacagattggggaaactgaggccttgcgaaagagaagggctcccacaagctctcctttcgaggcatgggcactgattcccattctatcccccgtgcgagaccgcctctatcatctgggagtgcatttcacgagtttgccctgagtggagaagcagaggccggggagcgcggtgaacagagttgggctgaaagtaagagacctggattcgagacttcgccaccgacagacaattgtgcgttctgggccaaatctcttccctgtgctgggcctcagttttctcgtctctaaaacggggcagtgtttttcaaaatatggttcttacaccatctgctttgtaattctctgagatgccggctttacagcgcgggactcaattcagacttctggtttagaatctgaacttatgcgtaggggggtcctgtatatactaatgtttgaagctcattgattttaagtgctttcctgctgtgagcactagatatccattcttcgctttgaggcagctggtgccagttcaggaactttgaaagaactggaatggttagctcagtaaagagagcactggaagggaattaactttttaaaaattgaaaatactgttacggcaaagagggcttccacttcatctttaggctaaaagaggcagaactaggactaacaggtgaattctacaggaaggcaagatttttgcttaatagaagaacttaaatggaagaatcgtcagaggtgaccaccgatggagtgaatggattgcctccgtgcctcctttcgagggaggtatataggtattagatgaaggtcctttccaacttgaaagtctgtgattccaaggagttgttctgcatctttctggtgctgactctgctctcaaggcaaatgtgacttttttcttctcttttgacacttccatcactttagcctacatctcctgtaaataaggccaatgcatctgaccttacataatctcttcctggttgtcctgtgcaccatccttcttttcaaggactttggaatgacccaatatctgatagaggcaccttaaatgtttattgaatgaataagtaaactgggtcccaccccatgggttagtagcttttttctaagaacaagttggaaatgcctctgaagattttatgtttgaccaggagaagccagtgaactctgaatcacaaaattgaggactctcagttgaaagcaccccttgaggttgttcagaccagccttctcttccctggaacataatccctgcttgaatcctctcttcagcaatatgtgtatagatgtgagagaatttttgcagtctgttggctagctttccatgcatcatataaaaacagtcctcttatagacttgacttgccagttcacacacatgacaagttccagctttttttttttttttttttgagtatttagtagagatggggtttcaccatgttggccaggctggtctcgaactcctgacctcaagtgatccgcctgcctcagcctcccaaagtgctgggatttcaggtgtaagccactgtgcctggcctctagcatacctttggttttctaatcaaacattattatgtccttattttgtgcattacaaagctctgcctaaatcactttttcaacacctgctagaatgcttaggaatgtttatgttgtcttagggagcagaggctccatattatgacccagttctgctgacttgctcccccgccgccacaaaagttagggttgagccaaaacttcctgccagttatcgacttgtgtttcccaagattaaaaaataaaaaagttgtgaaatgcttattcagatgttatccaggtactgggtaaaatgatcttaatttgttggagtttttagaacttctcgatctaaaagtttccttttaaagaagtgtctgaattgacattctcataagtatgttcttcaggccactggtctgaagaagtggctctgaaaaaaggatttgatgctaataataagtttgagaaagccacataccattattctttcttggagcttctcaatgtgtaataccacattaaaaccactgagaggtcctgcaataaggaaatgtgctttataagccaagataataacttgttccatttgtttaatctacttgatgtcaaatctttttttttttttaattgaagcacacgttagcaaattctgacctagagtggggatctgcatactatatataggctgtgaaccaaacctggacctactgcttgtttatatggtctgtgagctaagggtgctttttacatttttctttctttttttttttttttttaagacggagtctcgctctgttgcccaggctggaatgcagtggctccatctcggctcactgcaagctccgcctcctgggttcatgccattctcctgcctcagcctcccgaatagctgggactacaggcgcccaccccgatgactggctaattttttgtatttttagtagaggtagggtttcactgtgttagccaggatggtcttgatctcctgacctcgtgatctgcccgcctcagcctcccaaggtgctgggattacaggcgtgagccaccacgtctggcctgctttttacatttttaaatgatgggaaataaaagaagaataatattacataggtgacaattacaggaagataaaatttcagtgttcatttcagtcacacccatttatttatattcatatatatttacatattgtctttgggtgctttaatgctactcagtggagttgattacttcccataaaaaccatatggtccacagagtctaaagtatttactctatggccctttatggaaaaaaaattgccaattcctgacctgcatcgtgtacattttttttttttgagacagtgactcgctctgttgcccaggctggagtgcagtggcacgaacatagcctactacagccttgacctcctgggctgaagccatcttcccacctcagccacccgagtagttgggactacgggcacacaccaccacacccagctaacttttaggtttcttgtagagatgaggtctcactatgttgcccaggctggtctcaaatctccgagctcaaatgattctcctgcctcagcctctcaaagtgctaggattacaggtatgagccaccactcccagccatgtattgttttttaactttttattttattttatttatttatttatttatttatttatttatttgaaacggagtctcactctgtcctccaggctggagtgcagtggcgcaatctcggctcactgtaacctccacctcccgggctcaagcaattctcctgcctcagccttctgagtagctgggactacaggtgcacgccaccttgcctggctaatttttgtatttttagtggagacggggtttcaccatgttggccaggatggtctcaatctcctgacctcaagtgatccacccacctcagcttcccaaagtgctgggattacaggcttgagccaccgtgcctggccccttattattattattattattttttagatggagtttcactcttgttgcccaggctggaatgcggtgggacagtctcagctcactgcaacctgtgcctcccaggttcaagcgattctcctgccccagcctcccaagtagctgggattacaggcatgtgccaccacacctggccaatttttgtatttttagtagaggtgggtttcaccgtgttggccaggctggtcctgaactcctgacctcaggtgatccacccgccttggcatcccaaagtgctgggattacagccgtgagccactgcgcctggcctttttattttgaaataattttactcttatactaaacttgcaaaaataattcacaaactttctgtatatctgtcatctaacttcacctaatgtcaaaactgtacataattatatcagaattatccaaacaagaaatttaacattaatacaatattactagctaatctagagactttattcagattttgctatttgtcccactgtgtcctttttctgttccaggacccaatcctggatcctacatcacatttagttgtcaagtctccctggtctcatcagatatctgggacagttcctcattgtctttttttttttttttttttttgagacggagtctcaccctgtcacccaggctggaatacagtggcatgatctcagctaactgcaacccccctcccgggttcaagcgattctcctgcctcagcctcctgaatagctgcaattacaggcgtgtgccaccatgcccagctgttttttgtatttttagtagagtggggtttcaccatgttgggcaggctggtcttgaagtcccaacctcaggtgatccacctgcctcggcctcccaaagttctgggattacaggtgtgccaccacacccggcctgcatttgcactaaaatttattttttttttaattgtttgtttttgagatggaatttcactcttattgcccaggctggagtgcagtggcgcaatcttggctcaccgcaacatctgcctcccaggttcaagcgattctcctacctcagcctcccaaggagctaggattacaggcatgcaccaccacgcccggctaattttgtatttttttttttttagtagagacagggttgctctatgttggtcaagctggtctggaactcccggcctcaggtgatctgtctgcctcagcctcccaaagtgctgggattacaggtgtgagccactgcgcctggccatttgcactaaaatttatgagggttccagtttctccgcatccacaacacttgttattgcccactaaaaaaattatatctctcctagtgggtgtgaagtgatatctcattgtggttttgatttgcatttccttaatggctgatgatgatgatgatgatgttcttattggccatctgcatatcttatttggagaaatgtctgtttagatcttttgctcattttgtaattgagttatttgttatcgtgtacaattttgaatgtaggtattcaaagagtttgcagatctcttgaaataactcagtgatttgacctgcaaattctgaggcaatgccagtatgtccctgatctgaatgtagttggatttggacatactaaagcacaaagtaaatttccatttgaggctactgaccatgcagagcttgactcaaacccagccacttctggccatgtggagttggagtggccatgggcaagtgaaaggaagggtactatttgcgtccagaaatgaggttgtcatccaagatatgataagactagtcagggagccttcattttgggtgccactctgctgtatgtctggttataggcagggagtagaggagtcagtggtggtttgaatgctcaggactagctgctcatagctacataactacagtgctcctaggcctatcttgaccctacagcatttggccataaccaaaccatcttggacacataccttgaaacaaacaaaagcttcagtaatgtaaattgtgaaagtagtatgtgcttattttattattatttttttttagagatggagtcttgctctgttgcccaggctggagtgcagtggcacagtgttgactcactgcagcctccatctcccagattcaagcaattctcgtgcctcagttcctgagtagctagaattacaggcaagtgccaccatgcccgactaatttttgtatttttagtagagatggggtttcatgatcttggccaggctggtctcgaactcctgacctcaagtgatccgcccacctcagcctcccaaagtgctgggattacaggcatgagccaccatgccctgccgatgtgctcattttagacattttgggaaatacagaaaaatctccctctccccaccctagtcatccctagctctagtatctagagaacctttgttgcagttgctatatttccttcttgtttcctgctacggggcacatttttaatagttggaatcactcactgtacacaggtccatatcttgctttttcttattaacatctaaaactgaagaaaacacacactttaattttaatgtctccatgtttttgccagcctcttctataagcatttcttcttcttcttcttcttcttcttccccttccccttccccttcccttcccctcctcctcctcctccttcttcttcttcttcttcctcttcctcttcctcttcttcttctcgagacagagtctggctctgttgcccaggctggagtgcaatggtgcgatcttggctcactgcaacctccacctcccgggttcaaatgattctcctgcctcagcctcccgagtagctgggattataggtgcctgccaccatgcccagctaatttttgtatttttggtagaaacgggatttcaccatgctggccaggctggtctcgaactcctgacctcagacgatccacccacctcagcctcccaaagtgttgggattacaggcgtgagccaccacacctggcctataagcgttacttctgatggcctacatagatttccatttccttaactgttcatttatttaataagtcttactatgtagacgtaatgtgtataataagtacttggtgtgttcttagtgggatagaaatgtagttttgatttttaaataaggagcatagattttcttaaaattttttttattgtggtaagatgtacataacaatatttactgttttaactaattttatctatttaaattttttttgagatagggtctcactctgtggcctaggctgaagtgtagtggcaactcactgcagcctcaacctctgaggctcaagcaatcctcttgcctcagccccctaaagtgctggaattacagcagtgagccattgtgcctggcccattttaattatttttaaatgtacaattcagtggcattaagtaaattcacaatgttgtataaccatcaccactatttctaaaactttttcagcataccaaacagaaactctacccatgaagcaataactcctcattctctcctccccccagctcctggtaacctctgatccactttctatctgtatgaatttgcctattctggatatttctaataagattctaataagaaaatcacacaatgtatgaccttttatggaaacgtaggggggttttttcctttttttttttttttttttttgagacagtctcactccgttgtcacccaggctgagtgcagtggtgtcatctcagctcacttcaacctccgcatcctgggttcaagcaattattgtgcttcagcctcccaaatagctggaattacaggcgctcaccaccacacctggctcatttttgtatttttagtagagatggggttttgccatttgcccaggctggtctcgaacgcctgacctcaagtgatccgcctgccttggcttcccagagtgctgggattataggcatgagccaccgtacctgggcccagttttttaaattgtagtgaaattcatataaaatttaccatcgtaaccatttttttaaatgtacagctcagtggtattaagtacattcatgttctagaaacatcaccaccatctacctccagaactgttttcatcttgcaaaagtgaaactctgtgtctattaaacaataactccctatttcttcttccccctagccactgccaaccactattccactttctgtctctatgattttgtttactctaagtacgtcatataagtagaatcatacagtatttgtcctttttatttttgaagatgaggcctaaccgtgtggctggtgtcagactcttgggtttaagtgaactttctgcctcagcctcccaagtagctggggttatgtgtgggcaccactgcacccagcttagtatttgtcttcctttgactgacttatttcacctaacatgatgttcttgaggttcatttatgttgtagcatatgtgagaatttttcttcctttttaagataaaatgattttccgttgtatgtattttgcttatccattcatctgtcgatgcaaacttggattgcttccatgtttcagctattgtgaatactgctactgtgaacattgatgtatagctatttctttgcgaccttgctttcaattatttgggtacatacctagaggtagaattgctggatcatatggtagttcagtttttaatttttttgaggagcctctgtgctgttttccacagcagctgtaccattttacattcccaccaacagagcacaggggttctatttctctacatccttgccaaaacttgttattttctggtgttataaaaatagtagtcattctgatggtatctcattgtgcttttgatttgcatttccctgatgattagtgatgttgagcacccttctgtgtacttttgggacatttgtatttcttctttgaagaaatgtctctattcaagtcctttgcccccccgccccaccaccaccctttaaaaattttttttgagacagagtctctctctctcttgcccaggctggagtgcagtggtggaatctgggctctgcaacctccacctcctgggttcaagcaattatcttgcctcagcctcgcacgtagctggaagtacaggcgtgtgccaccacacctggctaatttgttttgtatttttagtagagacaaggtttcaccatgttgcccaagttggtctcaaacttctgacctcaagtgatctgcctgcctaagcctcccaaagtgctggaattacaggcctgagccaccatacctggccccacttttgaatcaggttgtttgttgttaagttttaggagttatctatgtattcaggatattaattccttttcagatatatgatttgcaaatattttctcccattctgtgaattgccattttactctattggtagtgtctttttatgcacaaaatttttaaatttttatgaaatccaatttgtctactttttcttttgttacctgtacttttggtgtcattccaagaaatcattgccagaaatatagtttttaaagtcatgaccaagtggctcctggtttaaaattctcagaggcggccctaattgctgcctggttatcataccctacttctctttttttaatttttagttttttaaagacagggtctctctgtcgccgaggctggagtgcagtggcgtgatctcagctcactgcaacctctgcctcccggactcaagcagtcctcccacctttgcctcttgagtagttgggaccacaggcatgcgccactgctcttggctaatttttgtatttttttgtagagatggggttttgccatgttacccaggctggtctcaaacttctgggctcaagtgatctgcctgcctccaccttccaaagtgctgggattactggctgagccaccacacccagccttcaaaccgtacttctctactctgcatctgctgtagatgacaggagtccatctcttcatttcattggtcgttgggaacaaagctcccgagtgttggatccttgtcttccagctggcctaaggacatgcaaagattagaagcagcacttctatgttcattgagccagattgtgtctgcttctgtggaaatggcctaggggactcactggccattctgtcctgggtccagttgccaggttaattcctgtgatagtttctatagcacctgactctgatactcgctctcttaattgctcctcagaagtgccttgtgatgtaacagtgatgtggttttttgttttgtttgtttgtttgtttgtttgagacagagtcttgttcagtcgcccaggctggagtgcagtggtgcaatctctgctcactgcaagctccgcctcccgggttcatgccattctcctgcctcagccccccgagtagctgggactacatttgcctgccaccaggcctggctaatttttttcgtatttttagtagagacgaggtttcaccgtgttagccagatggtctcgatctccttaccttgtgatccacccgccttggcctcccaaagtgctgggattacaggcatgagccaccacctctggccagatgtggtttttattttttatttattttatttatttattgagacagagtctcactctgtcacccagggtggagtgcggtagtatgatctcagctcactgcaacctccacctccagggttcaagcgattcccatgtctcagccttccaagtaactgggattacagacatgtgccaccacacccagctaatttgtattttttagtagagatagggtttcaccatgttggctaaggtggtctcgaactcctgacctcagatgatccacccaccttgtactcccaaagtgctgggattacaggtgtgagccaccacgcctggccaggtttttattttttaatatttatttatttatttttgagacaaggtctttgtatgctgcccaggctggtctcaaactcttgtcctcaagcaatcctcctgcctcagcctcctgagtagctggcatgttccactgtgcctggcatgtgggggtttttaaagatggacaggtctctgaatacaggagtggatcctgggcaaagcctaaggaagtttgttgttttttcttaacactatcatctctgccaaggcacttcttagtgtgagaagctttttgttttttaatagttacattctgacttggttataaactccttgagcacaggaaccaggaccttctctgatttacttatttatttatttatttatttatttatttatttttgagacagagttttgttgcccaggctggagtgcaatggcgccatcttggctcactgcaacctccgcctccttgggtcaagtgattctcccgcctcagcctccctagtagctgggattacaggcgcccaccactatgaccagctaatttttttttttttttggtgtttttagtagagacagggtttcactatgttggccaggctggtcttgaactcctgacctcaggcgatccacccgccttggcctcccaaagtgctgggattacaggcgtgagctactgcacccagccctgatttatttttatcatgggtctggtagttggcattctctaagtgtttgccaaacagcactggtaacaaatacaatggaggtggctcaaggcacaagagcaatttgtaaaagtcaatattatagacttttcaaaatggtatcattttggttttatctttaatcacagttggtcctagtcaggaccttctgttgaaagaagtgagaggctgggcatggtggcttgtgcctgtaatcccagcactttgggaggccgaggcaagcggatcacctgaggtcgggagtttgagaccagcctgaccaacatggagaaacaccatctctactaaaaatacaaaattagccaggtgtggtggtgcatgcctgtaatcccagctactcaggaggctgaggcaggagaatcgcttgaacctaggaggcggaggttgcggtgagccaagattgcgccattgcactccagcctgggcaacaagaacgaaactccatctcaaaaaaaagaaaggagaagtgagatcattgttttgtcaagtatataccgggtattaaaatttaaaaagttttctacttaattggttagatcttgtcaaacttattgtttttatactctaccttcagaatatcttagaggtctttagctcaacctcaggtaaaatatgaattaatgacattttatagaatatgaattaatgagatttcactgactgtgtgaaaataaaagtgaaacctggccaggtgtggtggctaatgcctgtaatcccagcattttgggaggctgaggcgggcagatcacttgaggtcaggagttcgagaccagcctgaccaacatggcgaaaccctgtctctactgaaaatacaaataaattaggcaggcattgtggtgcacacctgcaatcatgaattcagaatattaatcttactgcttcctcattaatttctttgtctaataggggctaggcactgtttcatacttatttaaaataacaacaaggctgggcgcggtggctcatgcctgtaatcccagcactttgggaggccgaggcaggcgcatcacctgaggtcaggagttcaagaccagcctggccaacaaggtgaaactccatctctactaaaaatacaaaaattggccagtcatgatggtgcacacctgtggtccccgctactcaggaggctgaggcaggagaatcacttgaacccaggaagcagaggttgcagtgagccaagatcttgccactacactccagcctgagcaacagagtgagaccccgtctcaaaaaaaaaaaaaaaaaaaagcaaaacccttattttttaaacttttctcatgacaaagggatggctggaacaattattccccatttgcaggtaaggacactggcatagtgagtgacagacctgagccttaggctaagtcctctggctccagattatttctttcatggtgttatactagaaattcacagcccttgactggtatctgtccagtctgaagagcttttctttaaaacactattttcctcagctgtattggtttgattgaaattaaatccccttcattcattcacataccttaatcaaacatctacttcctgtcaggaactgtgctgttggccctaggaggtatctcactggagtgggtaatagttcagtggataaccaaacctctgtgtgagtatgttatctttaatagggagaaatttgagaaaacttgaaactacttctggttgcagatccctcaatttttttttcatttgtgtaagagttttgggtaatacttaaaaaaaaaaaattgactctaagttatgtaacatttccagttctgaacagcatgttttgctgttataggatactgattttccacaactctagttggctatattgagttgtacagttctaattgctcctgggcatcagatctgtcaactcattcacacacacacagacacacacacacacacacacacacacacacacgtatgtatatatcaggtgctcctgaggcacctagccctgtgctgagtaaggaacctggaagctgggtctgcgcttgacaagacgcacaagaacagatcactgagttaccatttgttaaggacgttggcttgggttgggaagctttgcctctgactaggtctgtgaccatgggcaagtgacctaactactctgagcctttatttaacatcccaagggatgctaatgatgatacagtagtgtttacctaaaggcaggccataaagattaaatgagataattcatgtagagggctgagcagtgttagctatgttacttatagtgataagaaatataacaagtgtcccctaattttaacacttggggaaaatctgattttctctgggtcaaattgtatctaattttagatttcctctcagttcataaacatacacagttctgatgtctcatctactctgcattcaaggaatgatgctcattgagaaaggaaagttgtgactcatttactcagcaaattaaccaagtacctgctggttgcatatgtctatgaggaatatacaaaaacagtttaccttcagtgaactcagagaccttaaaagggagggggattaacatttcatgagtacttaactatgtgccaggcactatgctagtcccgtactgttttatctctatttcttagaactgtcttgtgaggaagatattagcctcattttagcaaatgagaaaaacaaaggctcagaaagaaaataacttgtctgaaatcacagaataagttgcagagctgagatttgaactcagccatcacattcctctgtgccgtgctagtttttaaggaaaaaagttaaggaacattttatgacaaaaggcaacttcttagatgacacttaaaagtttgtgccagtggtagtacaaatcccatttcactctttaaaaaaaattttttttttaatttaagaaacagagtctccttctgtctcctaggttggagtgcagtggcgtcatcatcactcactgcagccttgagctcctgggctcaagtgagcatcctgcctcagcctcccaaggagctagaactacaggcacacgccaccatacctggctaattttaaatttttttggtgatggagtctcactatattgttcaggctagttttgaactcttggccttaactgatcctcctgcctcggcctcccaaagtgctaagattacaggagtgagccaccattcttgtcctccattttgtccttttttaaaaatgaaacatggtaatttttcaaaaataattgaagcttaaaacccaacaaatgaacaaaacattctttgtatttaaaaataatggaagaggctgggtgtggtggctcatgcctgtaatcccagcactttgggaggccgaggtgggcggatcacctgaggtcaggagttcgagaccagcttgaccaacatgctgaaactcggcctctacgaaaaataccaaaaaaattagttgggtgtggtggcgggtgcctgtaatcctagctacttgggaggctgagatgggaggatcgcttgaacccaggaggcagaggttgcggtgagccgagatcgcgccgttgcacttcagttgggcgacagagcgagcctccgtctcaaattaaaaaaaaaaaaaaaagtagtggacgaaaatgtgaaaaagtaggaacagctggctctagaatccccactcagatatgtgttatctctgggcttggtggctgattgcctgtaatctcagcaatttgggaggccaaggctgaggcaggtggattgcttgagcccaggagttcaagaccagcctgggcagcatggcgaaaccccatctctacaaacaaacaaacaaaaaactagctggatgtggtggcgcacagctgtaatcccagctactcaggaggctgatgcaggagaattgcttgaacccgggaggtggaggttgcagtgagccgagatcacgccattgcactccatcctgggcaacaagagtgaaactgtctcaaaaaaaaaaaaaagccatatatcatcttttggaaaacatacatgtcattgtcaaggacttagggaaacaaatgtcttatgtatttctcataggaatataaattggcacatcttccctgggggtattcagcactgtctcaaagttacaaatataaatactttgaccctgcagttctacttctagggtttatactaataatatagtcaagcagtcttgaaggtagaaaacagggctgttgggttccagggatagggagagacttttcagcctatatccttttgttgtacctattgaattttgagccatgtaaacgtgttacttattaaaaaaataaattcataaaattaaaattgttaaaatttctgagatgattattattctaaggaccattcacacctcagttgtgaatgtacttaattcagattggtttcctttttgttctctactgagatctgaaggtattggacctttcacatcttttattttgtaatttgagatgggagctctctgtgttgaccaggctggtctcgaactcctggcctcaaccaatcctcccatcttggcctcccaaagtgctaggattacagatgtgagccaccatgcttggcctattttctcctgagtattaacagagtactcactatggaaaaggtggcaagtacatgtaagtattttttaaagcttaagaaatttgtccataagtccactgtccggagactactacagttaatatttttgacctctttttttggtatctttttaacctgctgataacaaataaattcaattttttttttttttgagacagaatctcgctctgtcgcccaggctggagtgcagtgggctcgctgcagcctctccctcccaggttcaagcaattctcctgtgtcagactcccagctgctccaaatcctgggctcaagcaatcttcctgcctcagcctcccaaagtgctaggaatgcaggtatgacccaccgcacctggccacatatatattcaactttgtatacaattttacatcctgcttttttctttttcttttttttttttttttagacagagtcttgctctgtcacccaggctggagtgtagtggtgcgatctcagctcactgtaagctccgcctcccaggttcacaccattctcctgcctcagcctcccgagttgctgggactacaggtgcccgccaccatgcccggctaattttttgtatttttagtagagacggggtttcaccgtgttagccaggatggtctcgatctcctgacctcgtgatccgcctgcctcagcctcccaaactgctgagattgcaggcgtgagccaccgtgtccagcccatcctgtttttttcacttaacattatgtcatgtaattgaaattcctacgtaagcaaaatctctgtggaagcattatttttagtggctgtgtaatctattatgtggacgtaccagtttatttaaccaggtaatgggagctagttggggagaaaaagagacgttaaaatcatggagccctttggaaggttaggcagatctgggttaggtaccctatagggtatgtgagccaggcaggccagggctgaagggcactgagagtcaaaggcttttcttcttcccttagtcccagcccttgctgccttaccatgaattatgcacttgttccttgtactgtgtctacatcctccccagcattccctgtcttcaggtactatgtacacacttctgtcagttcccagtacactgggttgccttgttggttcacttgtctgtgtctccctttagactgaaaaaaaagttttatttctgtatcttgaatgcctggcaaataataggatctttaatgaatctttgaagattcattcctatctactaagtagataggaagattagagggaaccagagaaaaggaccagtgcagccccaatgaaaagaagccagtcctttcagccttctctgttcttctgatcctgtatttgagggccaaatctccatgggctagcctaggaacctaaacaccacttagactttaaaatttcaaagctggtttatgtgtttccaagttccaataaacttattcagagttcttcccattccagccttctatgagtgtgatgtagacattcttggaatgcaggtcccatttctgcctacgtgtggtccagcagcagtctaatgagcagcgtagacaggctcaggcatgccagggttcctggcagaaagcttctgtgtgaataagcatgtgctcacagaaatgagacctctgctgggatcatgcctgttatttatcacccaaattcatagtcttcatatctaagattaacatttctaggtgtctcactacaccctggtctagaaattcttggagttaaagggacagaaaaggcagatgatgaattcctacagttctctagaacttgataattgaatttaagaatgctacagagaaatttcctcatgagatcaagttccctggtggttcctgcagggatattcaactctcgtgttctctttcttgctcaattcctgtgaggtgggccagaccaagtagaccaaaggccagctctgggaaggtaatatattgaagatactgggtcagtcaacttcagccgccaggctctgtgttcctacaggatcattaagtattgcaaatccgcgttagtcccagcaccacatgtgttgccctggacatctcaaagttaggactgttttttaaaactaggtgtgaacttatttcttaaaatgatcagctgtgttccagttggactaaatgctgattaatctgaattcagcagatttgtcccttaccccccaagtttatctgacctctctgtagtccctgtggattgtagctggataggccctgaggtttctgtccttctaaaatactgtattttgttggtattgctttgtgctattgatagagctgtaccctcttctagagctgggtttccaaaactctgttaattagagaatcatctagggtagaaagtgagggctacattaaaagcatacagattcttaggcctgatctaggtccagatcctatttaaatctctgaagggatctgggaaccagatctttcgtggggtgagaggatgctttgtttaagaaaaacaggcaaaaacaacaacgaaaggaaaaacaggtgagtttgatggagccccttgtttagaattcttaaaattaatctatgtgccttcagctcctgtactagactccaagacctcaacttggtcttattcctctttgtaactcctccacagttggtagcaccagacctcaaatgtaattggcattggaaaactgctggttggttgaatgaataagtggatgagtgattaatttactctgtactcatttcaaacagcacaaaagttacaacattgcacgataaatttgagggaagacaaaaaccaggtatttaattttgtaaagcagcatgttaatagaaaaacataagaatgaagagagtgctgaatattgtgttaggaagtctgaatttggcattgcgtggtgtcctggccttaggcagtcctctaatgtccctggcccagtgtcctcatctgtaaaatggcatgaggataaaatgcagcgatagatgtgaaatgctttgaaaactagagagtggattctggtcaggagaaaagaatggtcagggtagggacagaggcacagaactagccacaacaaggttgctctgtggttaggtgaaagtctatagcttctacagggaccatgagaaattttagcaggatggccatataggtatgctcaggacctgattctctttctgcctagttcctgagccgatcaggaacctctatgttttgggccactgtcccagtcctggtagacccatatggttctgtaggtgctcagtagacaatccccaggggaagctgctgatttctgccatgccaccttggtgtactgagattcctgtgcataggtgtaggagaaggtgagaagaggtggctccagggatgagtatgcagctgtggggcccagaatatgttacaaagaaaagttggtgaccagccagctgggagttgaccaaagtcagtcatgcgtgcccatcctcactcagcaaatatttgagtgcctgctaggatgaggctgtagatcctgggtggggaccatgtggtgtctactaagatttacaaggagagtgatatggcctgcctacagttgggacatgcaggcctgtctcagtgcctggcctggcacaaggctgccactccctgcaaactctgagctgacctgttactgtcccttaaccattcctactccaacacctaccttgatcctggttgtcccctcatgcctgtgtgtaggagtatgggccatgcacagctttgttgggtccacgaagtggggtggcagtggaccaggttacatggtatgaaatgtgtgcctccccaacagcaacagccctgtcctgccttggagggccctccaggtcactgtgttatttcataaggccacctcagtagccatgtaggaggcatgatactctcacttttcaggtgagaaaagagattcaaatcatcaagagatctaccgtggccatatggacagtcagtgatggaaccaggacttgaactcagaactttcaggattggggaaaaccagaacatggggtggaaaccagaacatggcgggggggtggggggtaggaaattttatgtattattattcttttgactgatttcaaaagtaatacatgtaaaggccgggtgcagtggctcacacgtgtaatcccagcactttggaaggctgaggtgggtggatcacctgaggtcaggagttcaagagcagcctggccaacatggcgaaaccctgtctctactaaaaagtacaaaaattagctgggcgtggtggtgggcacctataagcccagctactcaggaagctgaggcagggagaattgcttgaacccgggaggtggaggttgcagtgagccgagatcacaccactgcattccagcttgggtgacagactgagacttgtctcaaaaaaaaagaagaaaaaaaagtaatacagttgagtatgttcttccacattgttaaagactttttttttttttttaatacaatcagagtctcgctctaattgcccaggctggagtgcagtggtacattcatagctctctgcagcctcaaactcctgggcataagtaatcctcctaccttggcctcccaaagtactagggttacaggcatgagccaccatgcctggcctaaagccattttctaatacctatattcattattgtaacatatgtaaaatacttcacattttatgatttcctttttaaaaatgttcttgtgaaagtaatacttatttgttataaaacattgaaacagggtaagaatataataattcaatgtctcctagcccttataatcccagaaataactgttgatggtttaatgtgtattttctaggcattttctctctctctctgtgtgtgtgtgtgtgtgtgtgtgtgtgtgtgtgtgtgtgtgtgtctgcctgtctgtctgtgtatggatccacacacatacatactcatatacatacttagtttttacccaaataagtttatatacatactcttctacaacttaatctttttaaaaaataccttttattggggctaggcatggtggctcactgggaggctgaggcaggagaattgcttgagcccaggagtttgagactaccctgggcaacatagaccttgtttctacaaaataatttaaaaattagctgagcatggtggtgtgcacctgtagtcctagctgcttgggaggctgaggcaggggattgcttgagcccaggaggttgagcttgcagtgagctgtgattgcaccactgcactccagcctgggcaacagagcgagaccatctcaaaaaaaagaaaaaaaaaataccttttattgtaattttcaaacacacacacagactattacagtgaacctccattcatcacccagcttcaacaaccaacttccttgttcttgtttcatcttttctctccatttttatttttttcccctggagtattttaaagcaaatcccaaacattgtattgcttcaaaaatatgtgtctctacatgcacacgtatgtttattgcgggactactcacaatagtaaagacttggaaccaagccagatgtccaacaatggtagactggattaagaaaatgtggcacatatacaccatggaatactatgcagccataaaaaatgatgagttcatgtcctttgtagggacgtggatgaagctggaaaccatcattctcagcaaactatcgcaaggacaaaaaaccaaacacctcatgttctcactcataggtgggaaatgaacaacgagaacacttggacacaggaaggggaacatcacacacctgggcctgttgtggggtggggggagggggaagggatagcattaggaggtatacctaatgtaaatgacgagttaatgggtgcagcacaccaacatagcacatgtatacatatgtaacaaacctgcacgttgtgcacatgtaccctagaacttaaagtataataaaaatatatatatatttaaaaaaatgtgtctctagcagatcaggttttgtttaaaaaaaaaaacacaatatcattattatacccaacaaaattaacagtaattcctttttttttttttttttttgagacagggtttccactctgtcacccaggctggagtgcagcagcacaatcacggctcactgcagcctccacctcccaggcccaagtgatcctcccacctcagcctcctgactgtctggggctacaggtgtgtaccaccacacccagctaattttttatttttatttatttattttttttgagacagagtcactatgtcactcaggctggaatgcagtggtataatcttggctcactgcaacttccgcctcgcaagcttaagcgattctcctgcctcagcctctggagtagctgggaccatagacatgcaccaccacacccagctaatttttgttttgttttattttgttttggtagagatagggtttcaccatgttgcccaggctggtctccacctcctgagctcaagcgatccacctaccttggcctcccaaagtgctggaattatagacatgagccaccatgcccagccaacaataattccttcatatcgagtaatacctaggctaaacagtttttgtcaatcatgtcacaagtgtctttgtacagttggtttgtttgaatcttgttccaataagacccacatactacaagtggttggaatatctcgtatctcaatctataaccccaatcctgtccatgctatttattttttgtagaactttattgtttgtcctgtagaaagtcccacattctggatttggctgatgacatcttcatggagtcgtttaatacttgcacctatcctccatattttctgtaaatgggtaatttattttatttattattattattattattattattattattatttttgagatggagtctctctcttgtcacccaggttggagtgcgatgacacaatctcagttcactgcaacctccgcctcccgggttcaagcgattctcatgcctcagcttctcaagtagctgggattacaggtgtgtgccaccatgcccagctaatttttgtgtttttagtagagacagggtttcaccatgttggccaggcttgtcttgaactcctgatctcaggtatccacctgcctcggcctcccaaagtgctgggattacaggcgtgagccaccatgcctggctggtaattcattttagatgcttgatcagtgtctgagttttaacgcaaacatgtttcattggtggtgctgtgtacttctgttgcatcacatcaggaggctgatgtgactgatctgactttatggttgtctttccaaaatctatatgcataatttttaatttttttttttttaattttagtatttattgatcattcttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtagttgagattagggagtggtgatgactcttaacgagtatgctgccttcaagcatctgtttaacaaagcacatcttgcaccgcccttaatccatttaacccttagtggacacagcacatgtttcagagagcaggggttgggggtaaggttatagattaacagcatcccaaggcagaagaatttttcctagtacagaacaaaatggagtctgctatgtctacttctttctacacagacacaataacaatctgatctctctttcttttccccacatttcccccttttctattcgacaaaaccgctattgtcatcatggcccgttctcaatgagctgttgggtacacctcccagacggggtggcggccgggcagaggggctcccacctcccggacggggcagctgtccaggcgggggctgccccgagctcccggacggggcagctggccgggcgggggctgcccccccccacctcccggacggggcggctggccggtcgggggctgcccctcccttcccggacggggcggctggccgggcgggggctgcccaccacctcctggacggggcagctgccgggcagagacgctcctcacttcccggacggggcggctgccgggcagaggggctcctcacttctcagacagggtggcaggtcagagacgctcctcacctcccagacgggtggcggtggggcagagacactcctcagttcccagacggggtcgcggcctggcagaggcactcctcacatctcagacggggtggcggggcagaggcgctccccacatcccagaggatgggcggccagggagagactctcctcacttcctagacgggatgaccgccggggagaggcgctcctcacttcccagactgggcggctgggcagaggggctcctcacatcccagacgatgggcggccaggcagagacgctcctcacttcctagatggggtggcggccgggcagaggctgcaatctcggcactttgggaggccaaggcaggcggctgggaggtggaggttgtagcgatccgagatcacgccactgcactccagcctgggcaacattgagcactgagtgagcgagactccgtctgcaatcctggcacctcgggaggccgaggctggcagaccactggcggtcaggagctggagaccagcccggccaacacggcaaaaccccgtctccaccaaaaaatatgaaaaccagtcaggtgtggcggcgcgcgcctgcaatcccaggcactcggcaggctgaggcaggagaatcaggcagggaggctgcagtgagccaagatggcggcagtactgtccagcctcagctcggcatcagagggagaccgtgcaaaggggagacgaggaccgtgcaaaggggagagggagggggagggggagggagagcaatttttaattttttaagatttttttttttttttaaaaagaaacacacataggttgggtacttaggattgattgttgagctggaataatgaggaaagatagtaatgtggccctcaaaagtgggttttatcctaagatgaagagagcacatgtaatatgaagaagaggaaggtcagagagaaggtcttggagccgaggccagcgcacgaaactggtgccgccagcatccagctacccttctgggacattatgtaaaatgatgtaactgagtgaaaaagtggtgagctggcctcctctctctgctcaagtcactgagctggtatcgtggtgagggatactcatgaggccagagctctgagtccaccgtgtgaaggcaggaagctttctgggtctgagaaggctgtaacttttttggtccttgtcttctcatactctggaagctgacatcagggtgaccttctggtgttccagtggtaagtcctaaatttgtgaaggggccgcttgttttggaggtaacagtaggttaagatgacctggagaggcacagtctaagagctggagggggccacccaggacaccagggagtccagtgcctcattttacagatgagaaaattatgatcagtagagggaaagggaggttcccagaaccacctagcaagctagaggctgagtccagtatccaggcctccacttctctgactgtggtagccagcgaacatttcctacttggaatttctgaggtgatgagggtggccagataaggctcctgacagattgttaatgtgcatccagaattcctgggtatcccttggtgttggttttatcctctttcttgttcaactcctggctgggttctttgacttggaggtggtggtcaacagtggtctgtttataccagcatttagtggccagtttagtatgtagtggtacggtgcaaacagggtgtccatgagtcccagtctcagccccacattagtcagctagccaaggtaactgcagtttcctaaagaaattggaccagatcaagattgtccaaaacatagtatgagtgtgccaggtgatgtcaggtggtatgagggtaaacttttcatttgttacttttatattaacctttttacttatggtaagtattactggttttccatttattacagtgacataaacctcttctttaaatgtactgaggctaaaaagttgatatatttagataaaataaggtgaatagtattccaatgtggcagaaggaggattgaaaaagattgcaatatggaagaccttggaccagatgatctttctggtccttattagcttcctatcctttcatagttacaggaatttcttaatattctggcgtatgggctgggcacagtggctcacacctgtaatcctagcactttgggaaactgaggcaggtggatcacctgaggtcaggagttcaagaccagcctggccaacatgatgaaaccccatctctactaaaaatacaaaaattagccaggtgtggtggcaggcacctgtaatcccagctactcgggaggctgaggcaggagaatcacttgaacctgggaggcagaggttgcagtgagccaagattgtgccactgcactccagcctgggcgacagagtgaaactccatctcttaaaaatatatatatatgttctggcatatgacaatcacaaccttcctgcctcagcagattcacccatcaatatggaggctggacagcctgaacattccatttaatgtagcatgtatttgtcacctgggttgattgtcatgggggaatctaaagacaagtgagacaaggtcctggttcctgtggagaaccatctggaggctgctctgtatttggtggagtttgcgtatctgtgtgatatattctggaccatattcatgagaagtttctgggtcactgccctttgggtagtgccctacaactcttgtcttctgtagcgctttgggaagtctgctcagggattcagtcataatcagctctggagcctagagaagacaggaatgttggcatggaagctggggggagagggctgcagaaatggacagtcaagagttctctgccttttaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctggtcagtacccctacttccaccccagagagcacattgccaagtttggaaagcctgtggccctgggtggtttggagcagaatgcttcctgctcactttgggaatacactcaggctcaagggacaagagacctgagttcccatcccagctctgctaccaatgagctggatgaccttgggcaaatcctgtctccactctaagctcgttctccccatctctaaagtaataatacttaccatttagtgagcacttactacctgctacttgctgtgctgagcctagaggcagtatagcataatggttataagcaaggactgtggaactgggcttcctccttttgaagcttgactctgccaccttcctgtttgaccttggacaaggtacttacacacattctgcctcattttacagggtcgtttgcaagcattaaatgactcaaaatatgtaaaaggcttagaagagcacatagcttgcagtaaatactatgtgttagctatgactataattgttactatattttatgtttatatatagatagatacactcatcaaaatgaagtgtcaaggtcggtgtctgttccagccttgacggttacaggagccctttctggctctgagaacctaggtgctaggtgaaggtcggattttggttttgtgtgtgtgtgtgtgtttttttttgtcttgagattttgagctgaaccttgaaaggtcgatcaaaaaatgctaggtaaaggcgaagggtgtgtgtgtcactccaaggcagggagtttctagggacaggcacatgcactgttggactcatctgagacccttgaggctactgtatacctctcacagcactctggatgagggtctgggagtgttaggaaaaataatggttacagtagtgttgagccagattatcaaacccagattcgactaaagggacatagaggtaatgaatatttttgagcagagaaatcgtgtgaagaaaaggccgtttaaacaatatttaagggattttaagttggcaacagcgtaaaacatcaatttattggtgaataaatagaatggagcagagatttttgttcttgaggctcttgccctaattaccatcttgtgtaaaagctgttgtgatccacattctcctagaaattcaggatacttcagggtatcgtaaaaccaggacttgaaatgattgacaaaattaagaattcaaagacaggatacccctgatttgattatgtgaatgtatcaaattatcacatataacataaaaaatatgtacagctattatggctgggctcagtggctcacacctgtaatccaaacactttgagaggccatggtgggaggatcacttgagcccaggagtgcaagatgagtctgggcaacatagtgaggccccactatgtttaaaactagtcaggcatggtggcggtacctgtagtcctagctactcgggagactgaggtgggaggaaggcttgagcccaggaattcgaggctacagtgagctatgattgtatcactgcactccagtctaggcgacagagagagaccctgtctcttaaaaatatatatatattctgggctgggcgcggtggctcacgcctgtaatcccagcactttgggaggccaaggtgggcggatcacaaggtcaggagatcgagaccatcctggctaacacggtgaaacccgtttctactaaaaaaaaaaaaaaaaaaaaaaattagccgggtgtggtggagtgcacctgtagtcccagctgctggggaggctgaggcaggagaatggcgtgaacccgggaggcagagcttgcagcgagctgagatcgcgccactgcactccagcctgggtgatggagcaagactctgtctcaaaaaaaaaatgtgtgtgtgtgtgtgtgtgtgtgtgtgtttgtgtttgtgtatgtatttattaaattttataattataaattttaagattataaattatgtattttatgtatatattaactatacatatatttaaatgtacagctgttgtatatctttttttttttttttttttttttttttgtggagacagccttgctctcttgcccaggctggagtacagtggtgcagtcttggctcacttgcaacctctgcctcctgggctcaagtggttctcctgtctcagcctcccaagtagctgggactgcaggaatgcaccaccacgcccggctaattttctttttgtatttttagtagagatggggcttcgccatgctggccaagctggtttcaaactcctcacctcaagtgatctgcccaccccgacctcccaaagtgctaggattacaggcgtgagccaccatgcctggccctgtgtcaaatttttttttttttttttagagacgaagtcttgctttgtcaccaggctggagtgcagtggcacaatctcggctcactgcaatctctgcctcccaagttcaagcaattctcctgcctcagcctcccgggtagctgggattacaggtgcacccagctaatttttgtatttttagtagagagaggttttcaccatgttggccaggatggtctcgatcttctgacctcgttatctgcccgcctcggcctcccatagtgctgggattactggtgtgagccaccatgcctgctatcaattttttttttaaaggcagaatgccattggaaagaacacagactctaaaatgaaacagatgcttccagtctggatggtgcatccctgagcaaatctgctagcttccctgtactttggtttcctcatctgtaagatggagatgatggtactgcctcataggttaatgtgaccgtccagtgacattaagaaatgaaaaggtattcagccacagcgtggcacacagtacagtcatgcagtacataatgacattttggtcaacaatggattacatatccaacagcggttccataagatgatgatggacctgaaaagttcctataatctagtgattttaaaatgttatagagcagtgcgttaccttttctgtgttaggtatgttggattttttgtttgtttgtttgttgtttttttgaggagtctcactctgttgcccaggctggagtgcagtggcgtgatcttggctcactgcaacctctgcctcccaggttcaaacgattctcctgcttcagcctcccgagaagctgggattacacatacgtgccaccacacctgactaatttttgtatttttagtagagacggggttttaccatgttggccaggctggtcttgaactcctgatctcaggtgatccaaccgcctcagccttccaaagtgctgggattacaggcgtgagccaccacgcccagcctggtttttggttttttttgagatggagtctcactgcgtcacccatgctggagtgcagtagcactccagattgagtagcacgatctcagctcactgcaacctccacctcccaggttcaagtgattctcgtgcttcagcctcctatgtagctgggattacaggcatgtgccaccacacatggctagtttttgtatttttaatagagatggggtttcaccatgttggccaggctggtctcgaactcctgacctcaaataatctgcccacctcagctcccaaagtgctgggattacaggcatgagccaccacaccttggctctatgttaggtatgtttaaatacacaaatatttaccactctgttacagttacctatgatactcacatgctattcaggtttgtagcttaggagcaataggctatactatgtagcctaggtgtgtagtaagctatttcagctaggtttgtgtaagtacactctgtgatgctcacaatgatgaaattgcctaatgacacatttctcagaattatccctgtcgttcagtgatacatgactatcgttgcttaataaatgggaggaatggtggtcgttataaagcctgactttcccctgagggtcatccattcacctccacttctcccctagagcctttaagggaacttgccagtggagatctgccatgatttggggttattctccactcagtttagaatgacattgcaagattaatgttggagtcagatgttatggccaggaagattgtgtatttggtttgtgaagctaaactgtggttcaggaattggaaaaggaactatcctttgagttcaaagtgtactcagctaaagatacttggtatgtgaggtacagaagccatgcctgcattttccactgtcctggcctacatagtaggtacacagtagatatgtgttaactaaataaacgagagaaagaaattaaaaatgtgggccagacacggtggctcacacctttaatcccagcactttgggaggccaaggtgggcggatcacctgaggtcaggagtttgagaccagcctgactaacacggtgaaaccccgtttctgctaaaaatacaaaaaattagctgggcgtggtggcacacacctataatcccagctactcaggaggctgagacaggagaatcgcttgaacctgggaggtggaggttgcagtgagctgagtgagctgcactccagcttgggcaacaagaacaaaacttcgtctcaaaaaaaaaaaaaaaaaaaagtggagttgaatacttttctttcaattctgtagatatcattttttttttgtatgtggtgttagattatagaaagggcaatgaactagaagtcaggagacttttttttttaatcctgatgcagttcattttatgtttctgagctttggtttcctcatttgaaaatggagagagattggacagcagctctctaagctgaaggtaaccctttctgtcaagtagcatccccatcctttctattacttaaagatgcttttagagtagacctgaacttttaagctgcttcctgctaggagagttctcaaggatgaggacagcctgaagattttgttaaactggatctggactacctgagagtccacacatcccttgtgagcccgaggagactatgaacccactgaaattgagtgtaaaatagtgtgtagtacatgtgtatgtgaatgcccccatcaattttttgcacagggtgtccttagcttttattggattccttcagatgttgtaacctctcacagggtgatttgtagagaagctgggtctgtgtggtctgagccctggggatttcacatatactgagatctcaggggcagaggctggggtcttatctccattgcgttatttattttctgtgatttttaccccagtttttttttaatttccgataccagtaatccctacagaacctcaatgggcatgcagtgctccatagtttactcctgttttctcattctgctactaccactccacccatcaagtgtttctgctaatgaaaacatttttcttcctttccccttttctccttctccttgatgactggttgccctggggactctggcagttggccgtgtttacatcaggtaagatgcatttcattttactttgtctttcatcagctctggttgcacaagagagccctagtctcaggagactgctttcagaagctgcaatctgccctgcttgtgggctcatttgcttacttacccccacagccttctttacatacctgtccactgacagacacttgatgaaatcgggatggtcctaattctgccacagagggcctttttggatctcagttactcatttataaattggattggattgatagtatgttagttaggtcctttttatttttgagattctgcttctattaaaacagtgcctcctatcatatcaacagtcccccagcccttaaaggttatgaaaatattaggaaggggaaaacttttttggtgtcaacaaagagcttttgtgaggagagaaaagtctattttcctagctttagcacctacttggtgagacagagctgggcctggcattcacaagtggctgtgaataatcacagcctgctgaaagtctccctggtcgtcagcagtagagtaccacactcgtaggtggcctgggaatgtgggggaggacagaagttccagactgctaaagcttcagaatctggatgggagaaagaaggtgggaacagggctgcacattctgtccccagcgggacctggtagtacatattgactatgagtttatgaagaacacataacacattaagttttggagctatgaacagtaagagtagtaaataaaatcattcagtgctgccatctcctcagccctgaagtcctagattcatgtttatagaatgtctataaaaacacattttggccgggtgtggtggctcacacctataattccagcacgtagggaggccaaggcaggtggatcacttgaggcaaggagtttgagaacagcctggccaatatggcaaaaccccgtctctacaaaaaatataaaaattagctgggcgtggtggtgcacgcctatagtccgagctactagggaggctgaggcacgagaatcgcttgaatctgggaggcagaggttgcagtgagctgagattgcaccactgcactccagcctgggtgacatagtgagactctgtttcgagaaaaaaaaccaaaaaaccgaaaaaaaaatcaaaaacaagcaaaaaacaaacaaaaacaaaccaaaaacattttttatcacttgtttttttaagaaaattaatttttttttttttttttgagacagtctcattctgtcgcccaggctagagtgcaatggtgagatctcggctcactggaacctccgcctcccgggttcaagcgattcttgtgcctcagcctcctgggtagctgggattacaggtgcacaccaccacacccggctagtttttttgtctttttagtagagacaacggagtttcaccatgttccccacgctggtcttgaactgctgacctcaggtgatccacccgcctcagcttcccaaagtgctgggattacaagcgtgagccaccgcgcctggcctaaacaaaaaattttaatgtaaccagtgaaagggcctgagaaacccaaaacgggattttttttatattgaaagaaataggtgaatgcaaaaaatcaatgaaagtacacaaaaagcattaagcaaatttagataatgagcaaaacctatcctttagcatgtggtaagtcaccagaaaatgatcagcttatctcctgattctgatgcctgggatacacagttgttgggaaaatgctataaaaatgagaaattggccgggcgcggtggctcatgcctgtgatcccagcactttggcagaccaagggaggaagatcacgaggtcaggagtttgagaccagcctggccaacatggtgaaaccctgtctctactaaaaatacaaaaattagctgggcgcagtggtgggcgcctgtaatcccagctacttggaaggctgagacaggagaattgcttgaacccaggaggcaggggttgcagtgagctgagatcatgccactacactccagcctgggtgacagagcaagactctgtctggggaaaaaaaaatgagaaatcacagaaagaagaatatgactgacaggaaaatacagttgctcctactgggaaggtggggatttaaagtttgctgtacttacaccagcagcctaaattgaggctgggcatgtcagacttgacagccccagacttgcagtttccctccccctgtgttgctaggaggccctagagagaaacaaagcatgaagaagcctaattgtgatgattttttttcttttttttgagacagagtcttgctctgttgcccaggctggaatgcagtggtgcaatctcggctcactgcaacctccgcctcccgggttcaagcgattctcctccctcagcctcccgagtagctggaactacaggcatgcgccaccatgtctggctaatttttgtatttttagtagagacggggtttcaccttgttggccaggcttctcttgaactcctgacctcaggtgatccacccacctccgcctcccaaagcgctgggattacaggcatgagcaccgcacccggccaattatgatgatatttaaaggcaattttgattttaccactggtaggtatttgctgaatggtaggagaaggaatgggagtcaggttccttgagatgttccctgctcatgctggtgtttcccagtttgaggcctctggcctgtgttgttctggtggctctggctgatcactctggtgggtcttgggccatccacatgcatttttctctcctgtttgcagtggttggagaccagacctaacagacaggtgtgtcctgtttgcaaagctggcatcagccgagacaaggtcatccccctctatggaaggggcagcactgggcaacaggaccccaggtgaggactcaggatgcctctcccaaccacttctccccttggatgtgaattcactcccattcagcatcccctaaccccaccctttacttagtactagatgatctcttggtttcgaagcagtctcatccagatgagagtcagctaggaggggagggaagagaggggatccaagttgccacttgctaggacccagcagtgaacagacatcacaatcacaagtgtgcagagccctgtgaaagagcatttctgcaacctgggaagcaggatatgtagcaggagaggctccagggagcagggttgctgcatcagtgatgtataaagcatggcgggaggggaaacaggatctgggtgactttgtggagtttgggatttctagaaatggagatgtgcatgggtccagcattcaacaaacacaagtattgagagcccttcatggtctggcatccccaagctctccagaagaatctcttacctttatccagctaccctagcatatgctgtgtacccgacatattagactttctcttaaagggacttgctctttcacatttatcagcctgtgtatttgctctctcttctgccttcttccctccccagtcctgctcaagctacccctctacccccacctgctcctctaacttctactcatctcttatgagcagccctaaagttccctcttccttgaagtggtctgtcttcttcacattagttgctctcacccagttcccaccacagtgtcatatgactggctttatcccccttgaaaccatgaacacttcaagggttgggtctgtcatcagtattacagcatcctgcataatgcttattgtataactaagccctcaattgagtattcatgggttgagtgatttgagggggtgagactcaaaaataatagcattgggtatttgcccaagaatagtaggagatagagctgaagttaataggggaaggtcagagaaaccatgaacctcagcccttactgctgacaacccaccctctgttccagtatggatttgggatttctgttatctgtaacaggcccagggaaggcatctggccatgattcctaaccgatctgagtcaggatctctgtaagaggagtaggctgtagtgcaatctggtgaatatctcataacgagttgattttctccctggttctctatacacgtgggaagaacagttgcaggtagaatgaagagttcgtatttggagaattaatctggcataagttcatgtcctggacaagaaagaggctatggccctgaccctgttggtaaagagctccaggtcctcacagggagcaactcaaagcaatttgtaatagacttattttacaccatttctgtttcagagagaagacccctcctcgtcctcaaggacagaggccagagccggagaatagaggggtgaggaacattctaggagaagcttctacaaatgagctgatggctttagaagtttccttcttagccttacaatttttctccttgattataaaagtaaaggaaaacttgtaaaatacagaaaggaaaagagggggaaaaaaatcacttataaccacaccaatccagaggtaaccactggaaacattttggttctattttcttttccatttttctataattatatatacacacaaattttacaaatctgtgcgtgtattttacagatgtgtgtatactttttacagtttttgttttttgttttttacaatatgtggctcctgttttgtaaccctctcttaaaatttcatttgttctacagatacttagtaccttctttgtgtgagtgggagtcttttagtattatcttgagattttacattgccagcaatattttactaactagctgtttagcatttagtcgtgtggatttaacataattcaatcctttgttagacattagcggctttctttttccaagttaaaaaaaatcctgatgaacttacagataaatttgtgagcatgttcattattattttattaggataagacagggtctcactctgtagcccaggctggagtgcagtggtgtgatcacagttcactgtagcctcgacctcctgggctcagtctacctcagcctcccatgtagctgggaccacaggtgcacggcaccatgcccagctagttttttgagtttttttttgtctttcttttttttgttttgttttgtttgggtagaaacaaggtctcactatgttgcccaggctggtctctaactcctgggctcaagcaatcctcccacctcagcctcccaaagtgttaggattacaggcgtgaaccactgtacctggcttaggataaattcttagaagtaagattactggctaaaaaaaaattgcacatttgtctctagtggtctagtggctaggaacaaaaacatttacattttttgcatatttacatcaaatgttactcttaaaaaaattctgttaaaatgttaaagaaattttaaaagcaaaatatttacccaccattgccaagagcccagaacaagtatattctcatatcctcatgttctcttcatctgtaggctgtgcatatgtatttttatgtagccatcaccattctgtttgctttaaaatttaattttggcaggttttccatgatgctctgaagtgtcctctttattatttaggctgccatttatcctattgagttttttattattttttatttttccatgctattgctgggaacccattgagttttggttcattgtaatttgggttttcctcatcgaaggaccttttagttgtttccccattttgctgtttaaataatgctacaataaccatctttgcacacttttttttttttttttttttttgagatgaagtttcactcttgttgcccaactggagtgtagtagtgcgatctcggctcaccacagcctctgcctcccgggtttaaacaattcttctgcctcagcctccagagtagctgggattataggcatgggccaccatgcccagctaatttttgtatttttagtagagacgaggtttctccatgttggtcaggctggtctcgaactcccaagctcagatgatccgccctccttggcctcccaaagtgctgggattacaggcgtgagccaccgcgcactgccactttctttttttttttttttttttttttttttgagtttgaataatggcattttattaggatttccaggagtaggattattgagtcagggatcttgaaagaaattaaggttctcggctgggcgtggtggctcacacctgtaatctcagcactttgggaggctgaggcgggtggatcacctgaggtcaggaattcgagaccagcctgaccaatatggtgaaaccctgtctctgctttcttaaaaacataaaaattagccgggtgtggtggcatgtgcctgtagtcccagctactcgggaggctgaaacaggagaatcacttgaactcgggaggcagaggttgcagtgagctgagatcacaccactgcactccagccttggcgacagagcaagactctgtctcaaaaaaaaaaaaaagaaagaaagaaattaaggttctcttctccggattacccttaataataatactagcagtgaacacttgttgaatggttactatatggaaataactatatgttaagagctttatatgcatgatctcatttaagcctcacatcaactcatttaacggaggaggaaactgaggcccagataggtaaagtgatctgtccagggccacacgtacagtgctgaaacccagatctggctggtattgaagtctctgctcttgaccaccaggtgacaccactttaacattcctaggttttggtttcctacagagcattagcaactaatgcaggaatcagaggcccccagaagccagaggccctggccttgttgaccaaagtgcatacctctagcatttataagcacctgcagctactagcgatgtttttttgcatactctggcccaggaacataatcccaccaaatgtatggactggtgagatcataaagatgttgctagaagggaagcagaacggttagtcctcaggattgcactgaatgaatctgtggttcctgatgaaacaattgcaccttcccaagtaaggcagcctcagtcccaggagccattagattcaaccatgaactgagtaggaggcattttgtattgaggagatggaaactctttgttttccctccctttaggtttgccctctcattaagtcagctgttaggctttataggtgatgccatctggcaagaagtttggaactagatgccaggctgatcagtgtgtgatggagagcagctatttttgtgacttgcaaaaaactcataaatgaaggccattgagctctttgtgaagagcatttgacccaatagtctgtctgctttttattatttttaaaatcatttgttctaaacctctcatcaggggtgcaggggaagagaaaaaaatatttgaaagatgcgcacagtaattaagagcatgaaggccgggcacagtggctctggcctctaatcccagcactttgggaggctgaggtgggaggatcacttgagcccaggagtttgagaccagcctgagcaacaaagtgagaccctatctgtacaaaaaatttaaaaattagcaaagcatggaggggtacacctgtggtcccagctactcaagaggctgagatgggagcattgcttgagcctgggaggttgagtctacagtgagccatgattgcaccattgcactccaggcttggtgacagagcgagaccctgtctcaaaaaaaaagaaaagaaaaagaaaagcatgtgttttcagatcaaattgacctagttttagatctaaactgtactccttggtcaagttatttcacctctccaagcctcagtttggtcatctgtgaaatgcagatgaagccaatgtaaaaattaaacatgatttatatgtcctagtgcttaacatggtgcctagcacagagctcacgctttaaaaaagggagttatttattcacagtattgttcctgctgaatcttttcatgtgaaagatgatgcagtgtagaacatgcacatggaaagaaaactgagggtgatataccaaactgctgatagtggttatttcagaggtaaagtggagtggctgcgaagtgggaaggtgaatagaagatctctgactctgtcaattatttctgtaatatgtgagtttcttatagcaagtatatattacttttataaccagaaaacattatagtgttttaaaatgtaaaaattctatgtaacagtattaaaagaaattttaatccgtaacttgtccatatacctacatattgtcatgtagttgtgaccacagtgttcaaacaattttgtctgataacttggtcacaagagttgttcagtgttaccgcttaagtcagggtaatggttctttgaatgcatgtatcaagattttgatcatgacttccattgttggctaattagagtttcaacatttttgctattaaagataatgtgtagcttgtttgatgttcccttgggcacaggggtggctgtcaatattgctcctataaagcatgtagaaggtgttactagctaatgtgggactatggaaaatatcctcaagccctgtgagtgctgacttatgtcagcagagtgtttcacactgggtcagagccagtcctttttggcccattcatagattcttagctggaagctaaggctaaaagggcagagggcttgccagagttcctctacttcagggtatatatgggaggaaaagctgtcccccaccttcgaaacatgtggcacaaggtagggagaagaggcaggtgccacatgcaagacaacgtgaggtatgttgagttttgacaggcacaggagaaacctgcctgattctcctgcccttaattgcctttcttccacacagggatttcaaggatttggatttggagatggtggcttccagatgtcttttggaattggggcatttccctttgggatatttgccacagcatttaatataaatgatgggcggcctcctccaggtaagaccctatttccttgagaaattaggaagatatcttagtaatattgcttgaaagctccttggaattcagcagtatataagttacagataattgtcactacatggataatcagccttttcaaaatatcttaagctgtttttagatcacttacagacatggtaacaatgctgagcacttaccaactattaggcatgcatatatatagcactttccattccaagctcaggggatcatcacaaccaccctatggaacaggtgtgtgattagctgcgtttaacagatcagaaaatgctcagtaatgttaccaagacataccccatgtctataaaatggaaaactgtaagtgatactcagctgaggaaaagcctagttctgcacatttacttcccactttgaccatttgggggcctggaaatgtgagatgacccataaggagtgaaggcatctccattctctggcatctctgtctagcttccttcaggacacaacatgaggctggtcagaagcagcctcagccctgtgggaaccatgcctaggtctaccaactgctgctgcagttctccctcctactgcttgaaagtgccatccgcattcggtatagagcccttgctctataggtgcaagccacctctatgaggtgggtgccttgaactcttatcacagtctgacacccaagccaagatccttactgtggagcctgcagagatgccatgatcggttgagctctgcctgcacttgttggagcttcatgtgcactggacacagcatatggtacagaagtgaccattgtgtggttcacgccaagagcttatgccctaaagatggtaactgggtcatcccagttattctcatccccaccctggtccttggtacacagcaggtgatctataagtctttcttgactgcctgcctgcctgcctgtctgtcttcgtgaatccatcagagcatctagctgaggaatctcagcaccaagatatcttgggaatgccttttttttttttttttttttttgagatggagtctcgctctgtcccccaggctggagtgcagtggcacaatctcggctcactgcaagttccacctcccaggtttacgccattctcctgcctcagcctcccgagtagctgggactacaggcgcctgccaccacgcctggctaatttttttgtatttttttgtagagacagggtttcactgtgttagccaggatggtctcgatctcctgacctcgtgatccgcccgcctgggcctcccaatgtgctgggattacaggcgtgagccaccgcgcccggccctggggatgccctttcttactttatctgccttgaaggtttatcctctgttcacatttgtttttcagaggaagtataccccaaaagatagggtgtactctgccctgaagaaagggcaaattcctgtgaagccagcaagaacctgcctgatagcttgcatccttctaacctggtcgaaggctaaccttggattccccagctaagcagagttccacagccaggctagactctggattactttatccccctgccacagtcacagttttcccttgtcatgcttggtacaatttgcccatcctggacacagattcttttatcctccttcccccaaagtcaggacagggagctctaaatggtagcttttcctaaagcagagaggagtggagacttaggttctcaccccagttctgcctctaccttgaaaaacaagtcattttgcctgtctggatcctagttctcttctggaaaaggaaggcaatccctgtggggcccttgagaggcagtgtgtggagaggctgcagagctctgccactaatttctgagcctttcaatcttgaacaggtcacctcaaacctatgtttcagctgcttcctactcaaaatggaaataataatatccaccaaataataacatgtacaaaacacttagcagatagaagatacttaacaaatagtaggcttgctttcattatttcctgcaagagtttcctgttaatcacctggtttatttgcatgtgcaggccaaaccttttatgataaattggaccgtgtcttgtccttattgttattgttccacatagtttcattttgcctgatattatttggggtttagaaattttttttggctgggcgcgatggctcatgcctgtaatgccaacgctttgggaggctgaggtgggcggatcatctgaggtcaggagtttgagaccagcctggctaacatggtgaaaccctgttcctactaaaaatacaaaaaaaaaattagccgggtgtggtggtgcgtgcctgtaatcccagctactcaggaggctgaggcagcagaatcgcttgaacctaggaggtggaggttgcagtgagccgagatcgtgccattgcactccagcctgggcaacaagagcaaaactccacctcaaaaagaaaaaaaaaaaaaaaggccaggcatggtggctcatgcctgtaatcccagcacttttggaggctgaggcaggcggatcacaaggtcaggagttcgagaccagcctgaccaacatggtgaaaccccgtctctactaaaaatacaaaaattagccaggcttggtggcgcacacctgtaatcccagctacttaggaggctgaggcaggagaatcgcttgaacctgggaagcggaggttgcagtgagctgagatcgtgccactgcactctagcctgggcaacagagcgagactacatttcaaaaaaaaaaaaaagaaatctttttgtgtgtaggattctgatgttgtaaagagataaagattgatgctgtcaacttctggcctgagtgggcagtgtgcatagctgcagtgttctaatagcctgttttctcctttctgtctctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcagaagaccaccatcctcagaagccaagttgtcttttatgaagaggcaaggaaaggggaaacccacatgtgaccctgattttggtatggcttgatagagttccctgaaaactccttttatgtgtgctaaaaccagggaagcatgtgactgccaagcaggcaacccctgatgatttgtaaagccaggtggcagggcctggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttgtggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatgagcttggacttcttgtctgtgttgtggagggcgagtgggtggggagtagtcacactggtatgccctcctggaggctcctgtgcatcctccgtaatgtcacactgagaacgaaagtcttcaaagaagctgggcatgacttatgcctgtagtcctagttactctggaggctgaggcaagaggattgcttgagccctgagtttcaaggctgcattgagctatgatcatgccactgaactccagcctgggtgacaaagcgagactgtctcttaaaaaaaaggaaagaaagtctttaaacgactattgataattagagatgataaatgtaggctggaggcctggcttcatacacagccttgcccaatataaaacctgtctgacaggcagccccagtcctgacaagtacatggcattcctgagcttcgtaagtgacaagctgccacaatagagcttagcttgtcacttatcagagcctttagaacaatcataggttactcactgtcagcgtctctccatctgtttagtaacagggcaggtgggctgtcagccaagtcctctctctcgagcagaaggtgtgtccctccctaaggttccttagtagcagggtgtagtgtgagatggaagatgttgctgaggttacaaatctggcccagcctcagccttcccaacatgccagagctacaagtaattcctctgaaaagagctttttttcttcctcttagattttgatctaacagttatcaaattgaatagtaccaagatacagtggggaatgcaaaggtgagggaacttcaggagctcataagcccaatgagaaaagaccaggttttttttttttttttgaaagattttaattttaggccaggcatggtggcttacacctacaaaccccagcactttgtgaggctgaggtgggaggatcgcttgaggccaagagtttgagaccagcctgggcaacacagggagactccatctctacaaaaataaaaaatattagccaggcacagtggtgcatgcttgtggtcccagctacccgggagggaggctgaggtgggaagatcacctgagcctgggaggtcaaggctgcagtgagttgtgatcatgctagtgcattccagccagggcaacagacccttttagaaacagggtcttactcgggtgccctggctagagtgcagtggtgtgatcacagcttactgcagcctggaactcccggtctcagtaggttctcccacctcagcctcccaaagtgttggaattacaggtttaagccaccatgcccggccttaggtttttgttttcgatggggaaaaaaaaaaaaaaacagtagtagaacaggacaataaagcctccatgtagccataacccaactccagtaactatcaactcagatcagtcttgttgcatctatacctcccgcacgctgttcctctcccactgtctgaactattcggaaacaaaccccagtcatgtcatttattaagtatttcgatatgcatctcaagtattttaaaaacaagcaaaatatgccgggcacgatggcacacacctgtgatcctagcactttgggagggtgaggcgggcggattgccagagctcaggagtttgagaccaacctgggcaacatagtgaaaccccgtctctactaaaatacaaaaaattagccaggcgtagcggtaggcgcctgtagtctcagcaactcgggagactgaggcaggagaatcgcttgaacccgggaggcagaggttgcagtgagccgagatcgcaccagtgcactccagtcggggcgacagagcaagactccatctcaaaaaaaaaaaaaaagcaaaatacctttaaaaaatttcttaaaatcatcatatccaatcacattgttcagatttccctagttgtctcataacttgtgtagtttcaattgagatccaaatcagtttcatacattgctattatttgtctctgaattttttttttttttttttttgagacagagtttcacttgccgccca

SEQ ID NO: 16723 - DNA, 157822 bp, Human
atttttagtagagacggggtttcgccatgttgggcaggctggtctggaacttctgacctcaggtgatctgcccaccttggcctcccaaagtgttgggattacaggtgtgagccaccgtgcccggcccagaaatgagatatttaattttttaatttttactttttttttttttgagacggagtttcactcttgttgcccaggttggagtgcaatggtgccatctcggctcaccgcaacctctgcccccaggttcaagtgattctcctgcctcagcctcctgagtagctcggattacaggcatgtgctaccatgcccagctaattatgtatttttagtagtgacggggtttctccatattggtcaggctggtcttgaactcccgacctcaggtgatctgcctgccttggcctcccaaagtgctgggattacaggcgtgagtcaccgcgcccagccaaaatgagatattttaaataacataagtaaacagaaatatatcatgattttaatgataattcatgctctgaaaataaatgaagaaaggaataggagtagggaaagctgggatcagagtgggcaggaagttaaaatagagcagttagggaaagcctcactgaataagtgacatttggacaatgaccatggggagattagggaatgggttatttgaattttctgggaaaatactgttctaggcagaggaaatagcaagtgcacgatctttaaggccagagtgtgctaagcacgttggagaggccgagtccattgtagctgagttacagaagtgagtggaagagaagaaggtgatgagtttagagagggaagggcagggcaagagacaggctgtatggggctttgcaggttactgcaagaattttgcaggagggacagagactgacttggttcttaccaggattcctctggctgctgtgttgagtatagactctaagaggaaagagtggaagcaggcagaacactgaggaggctgttgcagtggtccaggtgggaaatgatggtgctgaccgtggaggtggtaagtggtcagattattctattttatttacactcaacacatctaatactgactcaatattatctaacatacagtccacattgaaattgccccccaaattctttttacataaaaaaatcatcctgaatccaatcaagtctcacctattgcttttggttttcacctctttcatgctgtcatattttaaaagactccaggctagatgttgtgtagaatgtcccacattctgaattcgtttattttttcaagtaagctttttgtgtgtatgtggcaagaatacgacagaggtagcaatatgctttccccactgcatcatattaggagacacataacaacagtcctgacccattattggtggtgctaagttcgatcacttggtaagggggtgcctgccagatctttccattgtaaagcaagctgttctttattgtaagtcataaatacgctgtgggatgatacttcgggactaaatataccctgaatatactgctgcccaacaacatttcacccagtgactttagcagctaaggaacagcctcgtggcttccgaccttgtgcctcagttcgctcatctgaaaaatgaggatgatcatggtccctaccggatgcttgttttgaggatccgtgcttggcataccagaaacgctccacaaatgttaggtattactggacgaaggcaaatatgaaaaaaattaagggcagggctaggactgcattccggttctccggatcccgagggagctcccagtcgatgctgggcgaaagcggccgcacgagcccacgtcgccacgccctccgccgcggaagccagggtgggggtcgctggaaccctaggccggccgcgcaaggccccctgggaccggtagtgctgggcgtggcctcgggactacatatcccagtggcccccgtgcggcgactttagctgctgctgtctcagccgctccacagcgacggcggcggctgcggcttagtcggtggcggccggcggcggctgcgggctgagcggcgagtttccgatttaaagctgagctgcgaggaaaatggcggcgggaggtgagtggagataaaggaggaggcggtggcgggcgagggggtggagtgcgaggcggagggaagaggggcgagttccccaggctgcgagagccagcggcttcagatctgccaaggcactgaggggcgcgccggccgggggacgcgctgaggtagtttcggggtgtcggggccgcgccgcttcccctcagcccggggggcggcccgcggcggtaggagctgagacgaagctgggtggcagtccgcttggggatccgagggggtccccgcgcggaggggtcacccgaggagtttgcggggggactgcaggggcccactttccccttctgtccctaaagttttttcttcctcttgcctccctcagcccttttgaaagctccccgcgtcgtcctcctgctgccccggctccttagcagcttctgggacgcacgggagggaaaagccgcggggacccccccccaccccagcctcccagccgggtgagatttggttgctgtgtttcctcctcacttgggcatttaaaaaatattttaacacgaattgtccgcggaattttcatgttgggctcgggtagcttcttagttttctcggtaaaaaggcgttttactacctctggtgtgaaggctgggaaatggcaagtgggaagttggttgataaaattaggagtttggctgtctttattactacttttttttttttttttgctctccccatctctcattttatgaacatcgacccagttcgtcatggtttaaataaactgcttgtcttgtacctgccttaacaaaactagccatgggtcgttgggagacttagttgcttcctaggcagtttgagggcatctagggtggaaaagttaaccgagagagcgagcatctacctcactggcaggatctgggattcccaaatggaatgacacggaagctatgagattctctcgaagtcgaaacttttttccccctcccgaatgcgaagacttcctttttgcaatatttgagcagggcttcaaaaccaacctgtttttgttattaagcctgtagggtaaagaaacaggaaggagagtaccagctgtcttgctgcagtggttttaaatggagttgaatgagatgcgtgagagtggtagtagtattgagtaagattgctgcatctctttgatttaaatgcctggcctcggatccacctaactgatccctggctgcaaaaaagcttcagtatttgttgcagcaggttgttgagaaggtgattggaggaataaaaatcttaggtcttcagcgaatgctgcacaaacgaaaatgttaatggaaacctgtaagtttgtgaattgtttgttcttgaaaatattttaaatgtatgctcatttagaatatggttctaccgaatgatatccaattggaaaggtacaaacacattgaaaagtgaatctctctttcacgccaaaccctacagtttccccttctcagaggcaaagactgttactggtttttagaatatccttggtctttggaataattattttaagattttcatttgaaaccacttctgttggataccaaaagcagggaaataaaatgaacagaagaaacagaaaatgtgggaatactgtttttgctctcttaaaaaaaatgttgatagctattggaaaaagctcttcagaacttactgcttatgtcaccttatctattaataccgttaaataacaatctgtggggctttaggataaagaactctgccagggttcattgtttgtatgtacaatgaatcctctgcttgtaacatgtaaaatgatattgaacactatagctcctgtcactagaggttgcttcaggttctgcatttcaatgagcagaaatctaaattgcctgtgatcctaaattataggggcattttatgtatagatggaaatgacttaattgtccaatcagcatttgaaataagaggcatataccagcttttggcatatagaagatggggattgtggactaagcgggaggctgtaatatttctagagcagttataggaaatatttctgccataagatatttaattacaaaggctttgaaaatgtacaacttaagcatcaatagcgagatttatatttttatattttagaatggttgttttaacagcttgccaacactaacaatttgctaaggaaattcagtgatattagagctaggttattaaagattatattaaataatttaactgtattttgaaaatgattatgctgtgcatttccttctctgtataaaaattatttctaaaaagtgccacgcacctcccgagcaaataaaatagaattcagtaaggagtgaagtactgttgtacgtgagaccctttttctaggcgatatgcaaataaaaagtagtttaaaaatggttgcttactaatgtcttcttgactggtcttttgaaataagctttcttgcagggacattacattaaagataaaagctaagtgtgtcttttttttttttttttttttttttaacgaattcagttctttctgccgggctgcagtggctcaggcctgtaatcccagcactttgggaagccaaggctggtggatcacgaggtcaggagtttgagaacagcctggcaaagatggtgaaaccccttcactactaaaaatacaaaaaattagccgggcgtggtggcgagcacctgtagttccagctactcaggaggttgaggcagaagaatggcttgaacccgggaggcggaggttgcagtgagccgagattgcaccactgcactccagcctgggcaacagaatgagactctgtttcaaaaaaaaaaaaaattctgtcttgtgcattagcagtatgattctggaataattcattttaacttggagtactgtaattgaaaagtctttaaaagaaaattaaaaaataaattttagtttggacaatagggtaagatttaaaaactctgctattgtcctatcccaaattgatggttaaaataaatggctttgggtttttggttttttttttttttttttttttttttgcgggcaggggcgttttttttttttcttttctttctttttttttttttttgagaaggaaatttgctctgttgcccaggctggagtgcagcggcgcgatcttggctcactgcaacctctgcctcctgggttcaagcaattctcctgtgtcagcctcccaagtagctgggattacaggtgcgcaccaccacgcccggctatttttgtatttttagtagagacaaagtttaccatgttggccaggctggtctcgaactcccaacctcaggtaatccacctgccttggcctcccaaagtgctgggattacaggtgtgagccatcacgccagcctgcattttttaaaaactatataatttcacactttggccagaggaggtagagtacttttgaaaacttttaatttgttgcaagtttagaatgcatattagccgccagtgacttttggtctacaacagcaaatttgtcacaatttaatacagttgttaccctgtaaagctatctaggattagaaaaaaaacaagacttgttgatcatgattgaagagattacctgtagcagtttggttcatatccttggtataaatatttgttttttgcattactgagcggttaaagctctgagagcagaaaattagtattggaaatgtatgttaactttttcttatttttttctcatacttcaaaaaattgaaaaacaaggggactatattggtttggattctcaggaatagctttgagattgagtgctgcagtaaaatgtaggcattttctcctttttttttttttttttttgagacagagtctcactctgttgctcaggctggagtgcagtggcatgatctcggctcactgcaacctctgcctcccaggttcaagcgattctcgtgcttcagcccctgcccgagtagctgggactaccggcgctcgccaccatgcccggctaatttttgtatttttagtagagatggggtttcatcgtgttggccaggctggtctcgaactcctgacctcaagtgatcctcctgctttggccttccaaagtgctggggttacaggcgtgagccaccgctcccggcccattttctcccattttatgagtgcttcttggggttggggaggggttacaaaataaacacttcagaattaaggtggaggaggggctttgtggtaatgaggcatattccatgagtttggtcatgtttttactaggtaaattcattttgtctatcatttttctgagagggtttctgggagaagattattttaggttaaagatgcaatttatccagagcctaactttattttcagccccctaacaaattatggaattgaatttaattgcctttccctttcctaccttctggtggagagtttttaaatgaacaggaaaatggccagaaaatacacagcaggagtaggatgggagacctgcagtgtgtagaaggccgatttatccacaaactggataatcttcttaggctgcatactgccagtaccaaactttgttagcattaactcagtttggtaggtactgccagcctaggtcagtttacagtggggggcagtaatagggtttatttaactaactgtgtagtaaactttgtggcctaaaggcaaaggaaaggagtcggacctgactggcaaacaggttttacccatttaaagtaatattccaagagcaaatggactagtgtctattttgtttggcttttaaaatatttttgttaggaacatctgtgtctttttttttaaattttctgttaatttttttattgatatgttctaggaaagggtgtgacatttttcatctgttattcctatgaaaaggtattctgttgaaatgtttaatttccttggttagaggctatgaatgagggttatgcagcttcactttttggaaaccagggtgactagattactgaatttaactattgattagccacataatgatgaaaagggaatcttggcctgggtatcacacagtaatggataatctgcttcctggggctttgctttggtggctatggcagctgagttggagtggtagatggatagatgggaaaggactgcagaagtcagcataatcctcaattaggataagccttatggttaattgaatgttgagtgtacaggttaaatcccattataacgaactccaggggactggccaaattattttgttgtactgggattagactttattaaatattgtttaaaacagtctttttgttagaggtgttagagattttggaaaaatttccatttattgtaacaatttgacaagttgttcatgaaccttccatctttaatgcttttacctttaaaaagaaaagaaagcatgttgagctgggcagtggcagagcatgtatatcacccctccacaccatgttttgagtagctcttggtttatgtcgacaacctaattagtttgttagtaagtactaccaccatctaagtgtggtcagaagaatgggaaattccccaggtttgcaggtgactggtgctgttaattttttctgtccccaacaacatgtatatatatttttaaatttaaccctgatccttagagcacccaacaactttttgttgttgttgttgttgttgttttgagatggagtttcactcttgttgcccaggctggagtgcaatggcacgatcttggctcactgtaacctttgcctcccaggttcaagtgattctcctgcctcagcctcgtgagtagctaggattacaggcatgtgccactacacctggctaattttgtatttttagtagagatggcggtttctccatgtgggtcaggctggtctcgaattcccagcctcaggtgatctgcccgcgtcggcctcccaaagtgctggaattacaggtgtgagccaccacgcctggccaacaacttttaaaaaataaatgaatatacatcattttagtgtgaaatttaagtcagtaataattgacttagcccctttctcctcagctatcaatgtaggttgagatttttaggtctataaattgtattgttaaaaaaaaagggatagtaatgatgtagtttttaacttcgtgatactatccatataaatatgaaaattttcagaaacaagcttaatttatatacatataagaaaaagactgttcttatgcttggccagaaatatacttctttctgtcctgtacttttattaggttggtgtttgccaagcttcaggcatttacatcccaccttcatatctaaggctagcatttttagtttgtttagagaatttggattgggtgcagcaagacatttttgaagtcattcttttaaatagatgttccatgaaggagggaaaatctgaaagaaggaatttcaaagcaacccaagcagtgttttgaaaattctcaagactgaagaataatgactgactagtaggcaggaagcctgcagttgtattgtggtattgttcctccatctcatgcatttgagaactttagtacaaaagaagagaaagcatggggaggggaagaaagggttttaacaaaaaagggggcacttttggagtaaatattctttgcccttctgtttaaatgaaatctaaagccatattattttactttgaaagaaaatgtgtatcataatagaaatgtcctaaactgacatttttataaatgaaagttaattgctgttggtggaaagagcagcatgatcatatgttcagtttcaaaacagaactttgattaaaaagaaatctacatgtgaaaacctttttttcctttttggtacctgatcaatatattttgttagcttgttactttgaaaagaagacttacctagggcagagttcagaataatttgtaagcatgtgctataagctttggacaaatcaatctctcttggccagtttttaaaattttaaaacaaagggtgctctgtatggttttccaaggttccttattttatacaattctataaacttaaggcattatgtagatatgtacaatgctcttttacttaaattttgttgattgaacataaatgaattaagctctttataccagataaccgtgtgaagttagatgcagctttcagtgctgacttataaagaatttagaggctgggtcccatggctcacacctgtaatcccagcactttgagaggaggatcacttgagcccaggaatttgagaccagcctgggcaacaaagtaagatcctgtctctataaaaaataggaaaaaaaaattagccgggcatggtgatgtgcgcctgtggtcccagccgcatgtgagactgagctgggaggatgacttgagcccaggaggttgagggtgcaatgagctgtgattgtgccattgcacaccagcctgagtgacagagtgagaccctgtctcaaaagggactttaatcgcctgacttcatcacagtatatgctataactgggtaaaagtgtgtgtgtgtgagagagagggattttcagtcccctccttctcgtgtaagaaaagcaagtgttactttctttactctcagtgaaattgctgtcgttgaaatggattatttaagtcatcttgtggagtagctatatcagcttgagtttgtttccagattgaaatttggcaattttggggctgagtgcagtggctcctgcctgtaatcccggcaatttgggaggctgaggccagagacttgcttgagcctaggagttcaagaccagcctgggcaacatagcaagacccccccatctctattaaaaaaatttggcaattttatttgaaaatgttataagagttactcagtactgtttatcaaattgtccctttagtctactacacactctgtgttccatcccagctcatctatttccttttacttgcttggtggtaattgtgttttatgacaatgtgttaatctcaattgaggtagttgtcttcaccgcagttggaacagtagttgactacatataggaaaatctaccagtgaagaaactccaccagtgagaaaaataactctacacatcttgcatcattggagggtcagtgatatctttgtcatataataagacaggactgttaccatattaagtttaaaactactttcatcaggaatcaataaaatggaatccagaaagcgactttaaacgtacacagtcatggccaggcgtggtggttcacgcctgtaatcccagcactttgggaggccaagatgagtggatcacgaagtcaggaattggagaccatcctggccaagatggtgaaactccgtctctactaaaaatataaaaaaattagctgggcatggtggcgggtgcctgtaatcccagctactcaggaggctgaggcaggagaatcgtttgaaccctggaggtagaggttgccgtgagctgagatcgcgccactgcactccagcctgggtgacagagcaagactccatctcaaaaaaaaaaaaaaagtacacgatcatatctagaatggtagaagccttgagtgtatgggttctaagatttggcaaacctgtaagcatgaacttgcccagtaaccttcagtttcccttttctttcccccaaatcacaatatagtcatccacatgggacttttaaaaattaattcaatttttggagagggtcttgctctgtcatctaggatggagtgtagtgtcaccatcacagttcactgcagccttgacctactgggctcaagcggtcctcccagcgcagcctcccagtagctgtgactacaggcacatgtcaccactcctggctgatgtttttaagttttgtatagaaggtgtgtctttggctggtcttgaactcttgggatcaagcgatccttctgccttggtctcccaaagtgctgggattacagatgtgagccatcgtgcccagtatagtgagttttcttaaacttagttttcataccactcttctaagtcttgaggccttaaacttcaatcatctttaatttgctgctgcttggttgttgttgcctactcttccatgcacagacatacttaatcagtgattattatgcctttactatttaaggaactgtgagagttaacaaagtttgtgacctccaagtgtgcacaatcaatcaggtactcatatcacttcagtacaaggcaatcagtgataagtcggttttgcctatagagattgtagagaagttcagaggaggcaagggactactactgatccaggccatcagggtacagcatgttgaagaataagatttaaacattttctttctttctttctttttttttttttgagatgggggtctcactgtgttgcccaggccagagtgcagtggcatgatcatggttcactgcagccttgaccaccagggctcaagcggttttcctgcctctgcctcccaagtagctgggactacacgtgtccaccaccatgcctaattttttttttttttttttttttgagacagagtctctctttgtcacccaggctggagtgcagtggcgtgttcttggctatatagatatatagctgagatatgtatctctctcgagatatatatatatatatatatatatatatatatttctttttttttttgagacggtcttgctctgtcacccaggctagaatgcactggtgctatctcagatcaccgcaacctccacctccccggttcaagtgaatctcctgcctcagccacccgagtagctggggttacaggcagcactaccacgtggacccagctaatttttgtatttttagtagagacggggtttcaccttgttggccaggctgatcttgaactcctggcatcatgatctgcccgtctccaaaataaaataagtgggaactatgctacacatggacatattgtgtggaataatagacaagagactaggaagggtgaggagggggatgatgagagattacttaatgggtacaatgtatgtgatttgagtaaatgatgccctaaaagtcctggcttcaccactaggcaatctatgcatgtaacaaaattacacttgtaccccataaatttatacaaattaaaaaaaatcaggctgggtgcaggggctcatgcccataatatcaatactttgagaggctgaggcaggaggactgcttaaagccggaagttaaagactaggctgggcaatatagtgagaccccatcctatgaaaaaaaaataggaaataataaaataatttttacaaaaaacaaaatataaacacaaaaaaagtttttcttctagaaaaaataactaatttacatctcaataagataaaaacaatccaacttaaaaataggcaaaagagactggaccccgtggctcacacctataattccagcactttgggaggctgaggcgggcggatcgtgaggtcaagagatcgagaccatcctggccaacatggtgagaccccgtctctactgaaaataaaaaattagccgggcatggtggcacatgcctgtagtcccagctactcgggaggttgaggcaggagaattgcttgaacccggcaggcgaaggttgcagtgtgccgacatagcgccactgcactcgaacgtggcaacagagtgagactctgtctcactaaaaaaaaaaaaaaaaacaacacaaaagatatatacagagacttcacagaaaaaaggtacaccagtggcaagtaagtacgaaaaaagatgctcaacatcagccattagggaaactgaaaactacaatgagataccactatacactcactatgaggggtaacattagaaagactgaccataccgtttgttggtaaggatgtggaacaactagaactgtatcatacgtggatacatggctaggagaaatgtgaaatggtacaatcactttgagaaacagtgggcagtttctttaaatttgtaaatattggctgggtgcagtggctcaagcctgtaatcccagcactttggaaggctgaggtgggggatcacttgagatcaggagtttgagaccagcctggccaacatggcaaaacctggtctctactaaaaatacaaaaaattagccagatgtgatggtgtgtgcctgtaaccccagcttctcaggaggctgaggcatgagaatagctgaggcatgagaagagcccagaaggcagaggttgcagtgagccgagatcccaccactgcactccagctggggaaacagagcaagactctgtctcaaaaaaattaaaaaaaataaaataaacttgtaaatattatacacttagcatataacccagccattctacttctgggttccccccaagagaaacacaagcttaggtccacacactaccctatacacaaatacgcagagaagctgcttacttaccatcaaatacatatgaggatatttacttccagttttgtttgaaataatatgaaactgaataaatcatgatataaccatacaatggaatgcagtgtaattattagaaatttctaagcaactattagccgggcgaggcggctcaagcctgtaacctcagcactttgggaggctgaggcaagcagatcattcaaggccaggagtttgagaccagcctggccaacatggcaaaatgcggtttctactaaaaatacaaaaattagctgggcgtggtgacacacacctataatcccagctactcaggaggctgaaacatgagactcacttgaatccaggaggcaaaggttgcagtgagccaagatcgcgccactacactccagcccgacggagcaagactctgtctcaaaaaaaaaaaaaaaaaaaaaattataagcaactgtaaatcaaactgatatgaatccttccccaagatcatttttaaagtatgtacagtgcaaagcagggctcttgagtgccagttacttaggtgtgttcattttataacaatttagcaagctgtacttgtgcccttccataaatatattatacatcaatttaaagtttgccaaaaatataggcgaaatgcttaaacttaaaaactttaaactatatgcatgtatatgtacctagactagggtaacaatggttccagggcagggaaggaggcagctaagaaaggacggccactgtataccctctgataacttttaaattgatctgatgtgtacctgtaatttatttcaaaaagtattttcttaactgagaccatttgcaactctctttaagtcaacattttcttttttttttctagtatcagaagattttatttttttacttttatttttttgaattttttttttaatttatcaacattttcttaatatagaaataaagtagaggcagagatggatttaggtccataacagttcttcataacccaatttcaaattttctacatatcacaacagtctcattctcactacttttataactgaaaaaacagtataaatttcaaaaataaacttgtaacaaatctttttttattttttttgagacggtctctgttgcccaggctgcagtgcagtggtacaatcttgactcactgaaatctccacctcccaggttcaagcgattctcatgtctcagcctctggagtagctgggtgtataggcatgtgccatcattcccacctaattttttttttgtatttttggtagagattgggtttcaccatgttggcctggctggtctcaaattcctgccctcaagtgatctggcccacctcggcctcccaaagtgctgggatcacaggtgtgctgtttttttgtttgtttgttttgttttgttttttgctttttttttttttttttttttgagacagagtcttgctctgtcacccaggctaaagagcagtggtgcaatctcagctcactgcaacctccgcctccagagtagctgggattacaggtgcctgccactatgcctggctaatttttgtatttttagcagagacagagttttgccatgttggccaggctggtcttgaactcgtgactttaggtgatgcacttgcctcagcctcccaaagtgctgggattacaggcgtgagccaccacacccagcctcttgtattttaaatagtgttttgtataagatttcatttgtgttaaaaaaaaaaaattctacagcaaaagaggtttgaaaaaccgggactatgaatgatataatgtatattaagcatttaacactgcccagggacagacacacaaatagtaacttttaatagctatatatatatatttaaaaaaattttttttttttgagatggagtctcgctctgttgcccacctggagtgcagtggcacgatctccgctcaccacaacctccgcctcctgagttcaaacaattctcctgcctcagcctccccagtagctgggactacaggcgcgcaccaccatgcctggttaattttggtatttttagtagagatggggtttcactgtcttagtctcgaactcctgatgtcgtgatccacccccctcggcctcccaaagtccaaagtgctggaaatacaggcatgagccaccacacccgagctttttctttctttcttttttttttttttttttcttttttttaagacaggtcactgggtcactctgttacccaggctggggtacagtggcatgatctcggctcactgcagtctgccttctgggtttaagcgattcttatgcctcagcgtactgagtagctgggactagaggcatgcatcaccactcccagctaattttttattttttagtagagacgggatttcactatgttggctggtcttgaacttctggcctcaagtggtccgcccacctcagcttcccaatgtgttaggattacaggcgtgagccactgccctcagccttaataccaatattatcatcaatcaataagtggtagcttttctgtggtatatccagacaatggcatattattcagtactaaaaagaaatgtgctatcaattcatgaagagatgtgaagaaaactttaagttttcacttagtgaaagaagccaatttggaaaggccacatactgtgtgattctaactatgtgacatcttagaaaaggcaaaattttggaaacactagaaagatcagtggttgccaggagttagtggggaggaaagaatgagtagacagagcacagtactcagggtagtgaaactactctgtatgatagatactataatggtagatacatgttgttataaattgttccaaactcataaaatgcacgataccaggagtaaactctaatgtgaactacacactctggatgataatgatgcctcagtgtaggtacaaatgtatcaagatggtggggggatggtgataggggaggctacacatgggtttgggcaggaggtatatggcaaatctctgtatcttctgttcaatattgctgtgaacctaaaacgcctctaacaaaataaagtgttaaaaaataaatggcagcttttatcttttctacccaggaataggaactgaaatatagatcaggacacagggaagagaattttattggaataagagggtagaagacagagcaagggtctagactatcaagcaactgacatataaataagatacacacatagaattagaaagatggtggttgaaatgaaaattaatagtcagattatgaaaatctttgggagctccatgtgaagtttagtttcgaattttagacaataaaaaacaaaggttccaagcagtcaagcaggctgggtgcagtggctcaagcctgtaatcccagcactttgggaggccgaggcaggcatatcatttgaggtcaggagttcaagactagcctggccaacatggtaaaaccctgtctctacaaaaaagtacaaaaataaaattagccaggcatagtggcacacacctgtagtccaagctgctcgggaggctgaggtgggaaaattgcttgaactgaggaggcagagattgagccaagatcacgccactgccctctagcctgggcaagagtgagaccctgtcttaaaaaaaaaaaaaaaaaaatttgctgggtgcagtgactcacatctataatcccagcactttgagaggcctagacggatgaatcacttgaagttaggagtttgagaccagccagcatggtgaaacctcatctctactaaaaatacaaaaattagccagtcgtggtggcacatgccagtaatcccagctactcgggaggctgaggcaggagaattgcttgaaccttggaggtggaggttgccatgagctgagatagcaccactgcactccagcctgggtgacagcgagactccgtctcctccccaaaaaaattaccttataatattttttactataacgaaacagtacagagtaaaaagagatgagaaagagaagaaactgaagcagcagttaattccctttagatctattccatcttcttcaagtattcgctaataatcccagttgaaaaggacttttcttcctctgaacttgtgaaccacctgcttatgttgatgcaattacattttcttctttttttcttttttctttttctttttttttttttttttgagaaggagtcttgctctgtcgcccaggctggagtgcagtggtacgatcttggctcactacaacctctgccttccgggttcaagtgattctcctgcctcagcctccctagtagctgggattacaggtgctcgctactacacctggctaatttttgtatttttagtagagacgggtttttgccatgttggccaggctgttctcgaactcctaacctcaggtgatctgcctgcctcggcctcccaaagtgctgagattacaggcgtgagccaccacgcctggccaattacatttatttttcaactagattataaactcctagatcacaaagggattctaacagtcacattacttagcacaattctttgaaaaacagtggtactgaataaaaacatttaaatgatgtaaagaaggatcgtccagtcctagggcaatttagaaaacatggaatgtactctaaggctgatatgattttcctgggacaactctgtgagggagacacaggtcccaagcaaatccctaggaatatttaattttaactccatttccaggtagaaaaactgactcgagggttgaattctaaaaactttcacatccaggccagccatgatggctcacacctgtaatcctaatactctgggaggtcgaggtgggagaattgcttgagtccaggagttcattacaagtctgggcaacatagggagaccccgtctctgccaaaaaaaaaaaattagctgggcatggtggtgcgcacctgtaatcccagccactcaggagactgaggtgggaggatcgcttaagtccaggagttccaggctgcaatgagccatgatttcaccactgtactccagcctgagaaacagagggagaccctgcctcaaaataaataaattaaattgggggaaaaaaaaagaaacataattgaaaaaaataatagaggattttctttttctgttttttttttttttttgagacagagtttcgctcttgttgcctgcccaggctgcagtgcaatggcatgatctcggctcactgcaacctccacctcccgggttttcaagagattctcctgcctcagcctcccgagtagctgggattacaggcatgcaccactaagcctggctacttttgtatttttagtagagatggggtttcaccatgttggtcaggctcgtctcgaactcctgacctcaggtgatctacctgcctcggcctcccaaaatgctgggattacaggggtgagccaccatgcctggccaatagaggatttttaaagcttataaaaggattactccttaccttcaagaaatagacaatttgaatccacgctaccaatcaagaagtactgactcacatgcacacgaacaattaagattcatctaagaaatgactggtgcggtggctcacgcctgtaactccagcactttgtgaggccgaggtgggtggatcacttgaggtcaggagtttgcaaccaacctggccaacatggtgaaacctcatctctactaaaaatacaaaaattaggtgggcgtggtgacgggcacctgtaatcccagctactcaggaggccgaggcaggagaatcgcttgaacctgggaagtggaggttgcagtgagccgagattgtgccactgcactccacactgggtgacagagcgagactccatctcaaaaaaaaaaaagaaaaagccaggcacggtgggtcacgcctgtaatctcagcactttgggaggccgaggcgggtggatcacttgaggtcagaagatcaagaccaccctggctaacatggtgaaatgctgtctctactaaaaatatgaaaagccaggcgtggtggcgtgtgcctgtagtcccagttactcaggaggctgaggccggagaattgcttgaacctgggaggccgagactacagtgagtcaagactgcaccattgtactccagcctgggtgacagagcgagactccatctcaaaaaaaaaaaatgatatttttagttttggtgttctggtaatttacctacattagatggtacctgagatgggcccaacaactagactagaaagcagtggagaaacaagggagaagatggagaaaaaacagtatgtctgaaaccaagggaaattagtctgaaagactgataaaaagacggtgattaagaactgaatatcaggttaagaaatttggagccaggcatggtggcacacacctgtaattctagcactttgtgaggcccacttgggaggattgcctgagaccaggagttcaagaccagcttgggcaatgtggcaaaactcttgtctccacagaaaatttttttttttgagagagtctcgctgtgttgctcaagctggagtgcaatggcacaatctcgctcactgcaacctctgcctcccaggttcaagagattctcctgcctcagcctcccaagtagctgggactatatagatgcccaccaccacgcctggctaatatttgtatttttagtagaaccggggtttcaccatgttggtcaggctggtctcgaactcctgaccttgtgatccgccggcttcagcctcccaatgtgctgggattacaggtgtgagcaactgtgcctggccaaaaaaaaaaaaaaaaaaaaaaaaaaaaaggaaggctacaggttgtcagtggcctcagtgctttcgggctacacccttgtttacagtgacaacaaggtggtattggagtgttacagggtcacagagaagaccttcaattatcaattagaggttttaaatttaaatttaccctggcttttaaaggaacagggtacactgttttctctttactgcttctctctctgactctgtctctctctttctctctttgactccctctttgtctctctgcctctctctctttcctctgctggtctttccctgcctctgccagccacttatgccgctgttctcccctctccttgcccttcccctaggggaggaaccggcaggagtggagctactctttcttcccctgagaagaaaggaaaggggagttctgaatattttccttactaccggaggtttgtgtgaggttcaaccccctgaaatttgcggaaggctcaacccctcaaaccagtggtgtcttgtcttggctttcctggaagactcaacctctcaaaccagggatgtcttgccttgcctgccctggaaggctcaaaccctcaaattagggatgtcttgtcttgccttgcctgccctggaaggctcaaaccctcaaactagggagtgtcttgccttgctgccctggaaggctgacctgtttcctccctttccccctctgaaggtcctttgcgctcactgaacttgtgttgtcctctctggctgctcccctgagggagaattaggcccctcttagcgttggtgtgctggtataaatcccacggcaggatctgccctaagccatatgaggtagctatggaacgcagagggcacccactcactctgtccagcagtaggacttgtcatcatctacacgaacaacaccgcaagtacggttgtttgtgatcattcacgcacatacacatttagcccttcagaatttgaccaccaaggaagtactctaccggctcccacggcttctccttccttggtgtgtgcacagagtcgtcgccgcagtatgtgaagatcttttacctaggttgctggccagtttctttccgccttgctgagagctcagcttattcgtcgcactgcgtgggtcctgatttgtcacccctgaggccgccacaagggggcggggtgcacctcctcacaagagagaaccagagaccgcccccggaggggaatgtaatcacaggcaagcccccaaatttgtataaagtttcggtgccacaaaagaaatagcactcgaatataagattttctttttttttttctcagcaaggcaatttactcttatagaaggatgcaccttcacagatggagcaatggtgagcgcacacctggacaagggaggagaaggggttcttattcctgacgcacgtggcctctgctgctgtgtcgttcccctattggctagggttagactgcacaggctaagctaattccgattggctaatttaaagaaagtgttggggtgagtggtttggcgggaaaaatggctgtggcagagcaggaaacaggaatgagtcaagatgaacaatgagtcagggtggagcaggtaatcagaataagtcagagtggaacaggtaatcaaaaaaggttgctctacagggaagttaagtttaaaagtagaaggcaaagaattgaacatactgacatattctttgaagagaaatttagaactcatatccaacactcaggcaccataccatatagattatggaggtcttgaaatcagatagagtaattcttctaactttattccttttcaagttgttttggctattctaggccctttgcatttccatataattgctagaatcagcttatttctgtgaaatttctgttgagattttgattgtgattgcattgaatcggttgatcaatttggagagaatcaacatcttaacagtattgtgcctttgcttccatgaacacattgtatatcttttcatttatttaggtcttatttagtttccgttagcagtgttttgtagttaccattgtacagatctttttttttttttttttttttttgagacggagtcttgctgtctcctaggctggagtgcagtggagcgatctcggttcactgcaagctccgcctcactggttcacgccattctcctgcctcagcctccggagtagccgggactacaggtgcccgccaccacgcccggctaattttttgtatttttagtagagacggggtttcaccatgttagccaggatggtctcgatctcctgacctcgtgatctgcccgcgtcggcaaagtgctgggagtgctgggattacaggcgtgagccacagcgcccggcccttttttttttttttttttgtggttttaaggagagagtttaataggcagaaagaaagggagaagacggaagaagctcccccatacagagacagaaggaggggggctccaaaaccaaaagaggaagtccccacctgccacagataccagccaggtatatatgcagcggctggaggaggcagtgtttgatttgcatagggctcgggattggtttgactcaacaaatcattcgcgtagcccgtgaaaaagctgaccctcccaccctggccttttaatatgcaaatgcaggggcgctatgatgttctacacacgtggggatatgtgggggaggccatgttgccaggaacttgtggggaaagggcaagaaggctgaggcaatctccatgtttgggtggacccattttctaatggcctgcatttgcatatcaaaggttgttggcctggctctaagagctgaggctttacgagaaacttttccagagatgctttaaaaaaaaaaaaaacgagcccggcgcggtggctcacccctgtaatcccagcactttgggaggccgaggtgggcggatcacgaggtcaggagatcgagaccatcctggctaacacagtgaaaccccgtctctactaaaaatacaaaaagccaggcgtggtggcctacacctgtagtcccagctactccggaggctgaggcaggagaatggcataaacccgggaggcggagcttgcagtgagccgagatcgcgccactgcactccaggctgggcgatagagcgagcctccgtctcaaaacaaaacaaaaaaccacgaaaacttcccaaggaccccttttcctataacattatcccctgtggagatgccacactaactgttagggggttttgggcgatgactctttctggctacttcctgctgaaaaggggcgtggaatgggaaacagcagctagggctccttctggggttgatccaagggtcttcggaggaatggctggcctgtccatgtgtggttcagtttatggcaccatttggagtttgattgcttctaggcgagaagaaatatttcgagtgatagtattaactatacggggtccaaatattagtacaagacgtataagcaagagagtgcttagtaaaggggttaaccaattccataaagaagactggaatttattaaagaggggttgtagccacttggagctgaatctggcattttccctgagcctgtcaataattttgatttttaagtacctgtagattttcctctactttactagaggtgttaatcccaaagcagcatgtttcgtttaaaactgctttactaaacccaataaaaagtcctagcggactcagcgatagtgaaactttcatgcttcctttttgtcaactattatccctgctataaggataataattaagcaaaatattacagcagtggaaactctctaatatttcagttagaaggtgctaccatgtataaccctattgcaaatagtagagtgaggacagcaattcccacaagtgtggtattttcatagcccatgctaaagcatttacccatagaagaacggttccggttaacttctgaacttaaaatcgccttactaattaagtaccatcttaataggagccagaatagatggcttaaaggaatgtaggaaccgaatggtcattttcctgtcagtgggacaatattgagacaaaaatttgtctacggaagacattttactcctgttaaaagcagaaacttcctgttcccagaagaggcctacagcctgatttctactaggtggcttaggaataccatgtgtttgccagaatgtagagagagagagacatttattgaattactgcctgccgtgattcacaatcttttctaacatacctgtttccctgaactgtaaagactcctgcatgttagacacacggagagagggtaagagaccgaggatagaaagagaaagaaagtttggcgacagggtagctggaagagagccttgaaattaaaggacagatttaaagttgaaatccattccatacccaccactctgatggttgaatttcctttcctggcccatgcaccaaaatgatacggctctaatgagtgggggaacaccagggttcttggtcctcatgccagtttagataaaatgacttgggcacacgtggagtggttttaaggagcagaaggtttaatagataagaagtgaagggacaagtgaagggagaagacagaaagaggaagctccctggtacagagacagagggagggggctccaaagccaaaagaggaggtccccccagtatacagatcttataaagcttctgtcagatttatcagtaagttccatatatatatattttttgagatggagtcttgctctgttgcccaggctggagtgcagtggcacaatctcggctccctgcaacctctgcctcattctcctgctgcagcctccccagtagctgggattacaggcatgtactaccatgtccagctaatttttgtatttctattttattttatttatttatttatttttttcttttttctttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggacacagcacatgtttcagagagcacagggttgggggtaaggtcaccgatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccaataggggcggccgggcagaggcgcccctcacctcctggacggggcggctggccggacggggggctgaccccccccacctccctcctggacggggcggctggccgggcggggggctgacccccccacctccctcccggacggggcggctggccggacgggggggctgaccccccccacctccctcccggacggggcggctggccgggcggggggctgacccccccacctccatcccggagggggcggctggccgggcggggggctgaccccccccacctccctcccagacggggcggctggccgggcagaggggctcctcacttcccagtaggggcggccgggcagaggtgcccctcacttcccggatggggcggctggccgggcggggggctgacccccccacctccctcccggatggggcggctggccgggcggggggctgacccccccacctccctcccggacaaggtggctgctgggcggagacgctcctcacttcccagacggggtggctgctgggcggaggggctcctcacttctcagacggggcggttgccaggcagagggtctcctcacttctcagacggggtggccgggcagagacgctcctcacatcccggacggggcggcagggcagaggtgctccccacatctcagacgatgggcggccgggcagagactcctcacttcccagatgtgatggcggccgggaagaggcgctcctcacttcctagatggcatggtggccgggcagagacgctcctcactttccagactgggcagccaggcagaggggctcctcacatcccagacgatgggcggccaggcggagatgctcctcacttcccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatccctgcacctcgggaggccgaggctggcggatcacttgtggttaggagctggagactagcccggccaacacagcgaaaccccgtctccaccaaaaaaatacgaaaaccagtcaggcgtggtggcacacgcctgcaatcgcaggcacttggcaagctgaggcaggagaatcaggcagggaggttgcagtaagccgagatggcagcagtaccgtccagcttcggctcggcatcagagggagaccgtggaaagagagggagagggagaccatggggagagaggggagaggggaggggagagggagaatttttgtatttttagtagagatagggctttaccatgttggctaggctggtcttgaactcctgacctcaggtgatccacctgcctcggcctcccaaagtgctgggattacaggcatgaaccaccacatccagccagttccatattttttaatgagattataaatagtattggattttagatttcaatttgaataatttattcttagtatatagcaatacagttgatttttgtatttttgcctaatatattataactttgctaaattaattttagtagcttttatgtagtttgcttaggattgtatatataggtgatcatgtctgtgaataaagacagtttaattccttcccttccagtcagcataccttttttttcttgctctattgttatggcgagtacttctagtacattgttgagtagacatctttgttttgttctcagtgttcggggtgaatattaagatgttatgggtctgctgatctgctttgtattagtatagtattgtttctagaatttcatataaatcccatgtaatcataaagtatgttgtgtcagcttcttttttttctttacgtatattttgttgctgttgttgtgtcatacttcttttgcttagtctaattccctgagattcattcatgttgttgcatatatgagttcttattttgtttctgagtatgtatatagtatatagacaatacatatgggcagtttgtttatttaccagttgagcaacatttcttagctattatgaatagagccgctgtgaacatttgaatacaaaccttagcgtgggcagaaggtttcattttcttggacaaatatctaggaggtggaattgctggatcatatggtaaatgtatgtttaactttataaggaactgtaaaactgtttacctgtctgttccattttgtgttctcaccagcagtatagccaaatttcagttttgtaacctcaccaacacttggtattaatattctcctatgttttagccattctggtagatatgtagtggtatcccattgtgattttaatttgaaatgtcattcagcttctttggtgaagtgtctgttcaaatcttttgcctccttttcctttcctttttcttttctcctcccccttctgttttgaaaatcaggttgcttttctgttactgaattcttagaaaaaactgagttcttaggaaaaaaactcatttttttaaatgttctcgatatccatcttttattagatatggtttgcagatattttctcccaggctttgttggtacaattctaattgatcagctgagtctctgtagtaatgctccatttcttggtcatatgtatattttgaggaataacaagtgttttaaagctcaaaataacagttatgctaacatatactataagctgcattctttaatccatatatagggaaagaaaaacctagattgttaatccggaacatttacattcttaaacatagtaaattgtctactgtacttaactatgttaaatacttttaaatggcctagagcttcatctttttatctaataaaaatgaataaataattccttgtctgtttcattatttattattactaactaaaatgaaaaactatgaatatattggtctggtataaacctaatgaaaagttgccaaaataaaaaaacacttaatcttgcctataagcttttgccattgttccctctctaaccctcactgaaaaacccaatctttatggcttacctctattagtatacaatatattacttttgcatcaagtatatacacatactgtcttgtctttttgttctttctatgcgtaactgttctactgacttgaattaggttttgaatgcttgctgtgtaagctgatgagaaaaaaaaatcagctttacaatgtgatatttgtcacatttagcaattatattaaattattgtaacactatattacctaagtatctacctggacacttttttttctttttctttttgaaacggagtttcgcttttgttgcccaggctgaagtgcaatggtgtgatcttagctcactgcaacctccgcttcctgggttcaagcaattcttgtgcctcagcctcccaagtagctggaattacagccaccacgtccagctaattttgtatttttagtagagaagggggtttctccacgttggtcaggctggtctcgaactcccgacctcgggtgatccacccgccttggcctcccagagtgctgggattacaggcgtgagccactgtgcctggctggacacttttttttcttactcagggtgatactcaactcaatttatttatttatttaaaaaaattttttttctttttttttttttgagatggagtttcactctagtcccccaggctggagtgcatctcagcactgcaacctctaccttttgggttcaagcgattctcctgcttcagcctcccaagtagctgggattgcaggcaccaccatgcccagctaatttttgtatttttagtagagatgaggtttcaccatgttggccaggctggtctctaactcctgatctcaggtgatccacccaccttggcctcccaacgtgctaggattacaggcatgagccgccgtgcccagcatctaaaaaacttttttgagacagagtctttgtcgcccaggctggagtgcagtggtgtgatcttggctcactgcagcctccatctcctgggttcaagtgattcttgcgcctcagcctcccgagtagctgggaccacaagcgcatgccaccacacctggctaatttttgtatttttagtagaggtggagttttgccatgttggctgggctggtctcgaactctgacctcaagtgatccaccggctcaacctctcaaagtgttgtgattacaggcgtgagccactgctcctggccttacctcaatttatttaacagtcccctcacccaaatgtgaagatgataaacaattctttcctgtctgaattattctttctctcatgctggaattttggaacattttacaacttacatttaagaaggctagtttaaaaagaaacagtggaaatttccaccttttaaaaaaacttaatttctggtctattaactgctttgcaggaagaaagaaatatgaagaagaaccgcagacattctggatgtcagcctgtgaaattttccactatttcccataataacatgcaggcacgcttatactgctggattcattgcaactgcagttgcactctgagtggaatttgaagctactcttatcagtgataaaatggcatgtagcttttaatgagcagtgcatatattttcacatctaaggtattgtatgtttgtttcatctctgcctgaatagtgtggccataaacactgaaattgtaaaattatttttaaaacttctgattccaaaattcctgattgtttcaaatggttttgattgttttatttcagtagattatgtatctgagaagatatataatcatgcttttagttacagtgctgcatacataaaattttacagggttttatacatacagaagaatgatgagaaaattaaagttttaaaaggatttgtatagaggagaaaattgagacaaagttttaaaaagatttgcatagctcagtattttggtttgattcaataaatttttaatgatttaactttttttttttttttttttgagacagagtcttactctgtcacccaggctgtagggccgtggcacgatcttggctcattgcaacctccgcctcctgggttcaagcatttcttctgcctcagcctcccaagtagctgggattacaggctcccgccaccatgcctggcgaatttttgtatttttttagtagagacaaggtttcaccatgttggtcaggctggtctcaaactcttgccctcaagtgatccacctgccttggtctctcaaagtgctgggattacaggcgtgggccactgcgcctggccaacaattttaactattttaggttcctgttaatcttttaaaatgtcagtagactttatattaaaattgatgctgtgtttttgtttggctccttgaaatttaaaggcaaacaaggtgttattatccaacttttctaatgatgtaagtccaggtttcctagatctgtaaactggcgtagcagtagggtgaagagtagattacaaatacattgtaattatctaccctgtttcatctttcatctcttccatggctaatgcctaacattggtattaaggaataaaattgaggaatttggctgggtgcggtggctcacacctgtaatcccagtactttgggagactgagggcaggcagatcacttgaggtaaggagttcaagatcagcctggccaacgtggtgaagccctgtctctactaaaaatacaaaaattaaccgggtttggtggtggtcacttgtaatcccagctactcgggaggctgaggcagaagaatcgcttgaactcaggaggcagaggctgcatgcagtgagccgagattgtgccactgtactccagcctgggcgacggagcgagactatctcaaacaaacaaacaaacaaacaaacaaaaaagaaattggggaattcaagatatataaatgaacctttaaactgcacttttgcagagaggaatttaagggttcaaagtgatgaaacagatgtattacagatatctttctgtgtttttacacttgcacatcactgacattttggaagtaaagccatattaatgcagaagtatatctcttctggactgttgggctagatttgagcaagaataatgttgtgacataacagtgttctccatcccttccctgtgatctgctcctcccttgtacagtctcatccttcctcttgacctttcctgtatctataacttttctcttgacctcttcatgcacttccccttctcagctttcctccagtctgcaactgtcttatcccttccctcagcctaaatttccgtctggcttgtaacctttttacctctgtcaactttccatccttcaggtccctcactttttctggtttctcactgttaaccaaggtcttttctttacctttggaagcttctttactgcgtgtgttctctgctcctgtcagattgatttttgtttagtccttgacccctcaaacgtgtacatcctcacaccctccaaaatcctttaactttcatttcttcttccatgctttaatttattctgcaaaaatttattgagtgctagccatgtgttgcctattccttagatgttaggaatataccagtgactagaaaggttacggaaaaaaaataaaactttgtagggggggacttgtgtgtgtgtgtgtgtgtgtgtgtgtgtgtgtgtgttcagggtttacgttttagatatcatggtaagttttgctaagtaagtgatacttaaacaaggacaccaggaagtaagtaagccctgagaatattgggttggggtaaggttgggatggggagctttctgtttagagggaactaccagtggaaaggccctttgttaggagcattcttagtgaatttgaagaacagcaaggtgaccagtgttttggagcacagtgtttggaggacagtgaacaaagacgtaagtagcaagagaaatctgagaggtaacagtgaggccttgcagacagttgtaaggacttcaactttaaaaaaaattcattttttaaaaaatagcataatagcatataaatgcatggtttccattattttctttttgagatgggatctcattatattgcccaggcccaggctggtctagaactgctgggctcccacctcagcctcatgggtagcttggcctacaggtgagtgttaagacgtgcagctaattaaaaaaatttttttttcttgtagagacaggtcttttttgctgcctagtctagtcttgaactcctgacatgaagcaatagtcccacctcagcttcccaaagtattggcattataggtgtgagctatcatacctggcttcctgcagattttttaattgtatttttggttattccaaaaagatcatttggctgggcacggtggctcacacctgtaatcccagcactttgggaggctgaggcgggcggatcacttgaggtcagaagtttgagaccagcctggccaacatggtgaaaccccgtctgtactacaaatacaaaaaaattagccacacgtggtggcgggcgcctgtaatcccagctactcgggaggctgaggcagagaattgcttgaatctgggagacggaggttgcagtgagccaggattgtgccattgcactccagcttgggcaacagagcaagactctgtctcaaaaaaaaaaaaaaaaaaaaaaaaaaaaattaaccgggcgtggtggcaggcacctctgtaatcccagctactcaggaggctgaggcaggagaatcatttgaatttgggaggcggaggttgcagtgagctgagaacacaccactgcattccagtctaggtgacagagccaggttccgtctcaaaaaaaaaaaaaaaaaaaagatcattgatttttttttttctttttccccttcaaattaaagcatttcttttttctttggttgtaaaggtgattaattcatgttcatgtggaaaacatggaaaatccagaaaagtacaaaaaaataaggattactagcaaccgcatcatccattattaatagattttgtatgtatatctttccagtctttttttctttgttcttttacacatacacagtgccttatacagtatatgggtttagcagagattaaatgaactctatcagggtcttcataagaccctccagcagtcatgtgaagagtagcctgtaagagtgcaagggtagaagcagggagagctaggccaggtgcactggctcacacttgtaaccctagcactttgagaggtcgaggagggtggatttcttgagcccaggagtttgagaccagcctgagcaacatagatcctatctctacaaaaaatgcagaaattagcccagcatggtggcaggtgcctgtggtcctagcttactggggaggctgagctgggaggattgcttgaacccaggaggttgaggctgccgtgagctgtggctatgccactgtactccagcctgggcaacagagcaagaccctgtctccaaaaacaaaaacaaacgaaaaaacaaaacacaaaaaacccaggatgacctattagaaggctgttagagtaatccatgttggtttagactatgattatggcaagagaggtgataagaagtggtcagattgtatatatcttcttttgaaggtagagccaacaggattttgtgatggtttcagtggggggggcggggggtgaagagggaagagaagaatcaagcataattcaaaagtttttggcttgaacaactagaattgtttggcttcattttcttgtcaaactacccatccaaggctcttttattgtgtccttcctgtccatttgaacttgggattctttaaaaaaaaaaaaaaaagatttatttgctctatagagaaaccaaagcatgaacttgtgattatttctttcaccaggcttctagtttgtgctgtccaacttggtacttggtacccaccacaagatgctatatataacaagtgtttcactagcattagtctccctaactgggttgtgagcatccttttactggatcatgctgaatttgagtcttttcagggacctgtaactttctgagtacgttgtggacgttcagaaaatgtctatttattgtatgtttttcaggcttaagaataagatatgaaaaaacctcaaagtaactgtctgcttttactttagattactgacatcttttgagaatgtgtttgggccagatgagctggttcacacctgtaaccccagcactttgggaggctgaggcaggcagatcacttgagcttaggagttcaagagcagtctgggcaacgtggcgaaaccccatctctaccaaaaatccaaaaaattgtctgggtgtggtggcgtgcacctgtagtcccagctgttgggtggctgaggtgggaggatcggttgagcctgggaaatggaagttgcagtgagtagagatcatgccattgcactatagcgtgggtgacagagtgagactccatctctctcttttttttttcttaatttataaaaaaaggtgtttggatagttattttccttatatccagtgtaagaatcattacaaggtctggctgtgttgcccaggcttgtttttttttttttctttttaaataattagcgttattattattcttagtttttgagtcagggtcttgctttcttgccagacttgagtgcagtagtgcagtggcacaatcatggctcactgcagcctcaaactcctgggctcaaggaattttcccacctcagcctcctaagtagctaggctcacttcttccgtgcctcgctgcccaaacccctagggggagcatgcagacggacaggtcgtgaggagtgtttttgggctttgactccatagcagcatctagggttgagtgtttccagctcctgaagccccagtggccgtgtgttacagtgtgctctttcagttttgtggtctacaggtggcttgtgccaatcagctgagttacactctctgccttatcgcaaggatagagggctctctgtatcccaggttcttgccctagtgtgctggaaagatcggatcacacacggacttggagaatgagtgcaaggtttttttgctttttttttttgagaccgagtctcactctgttgccaggctggggtgcagtggcgcaatctcggctcactgcagcctcctcctcccaggttcaagtgactctcctgcctcagcctcccgagtagctgggattacaggcatgcaccaccacatctggctaatttttgtatttttaatagagatgaggtttcaccatgttggccaagatggtcttgatctcctgaccttgtgatccgcccatctcagcctcccaaagtgctgggattacaggtatgagccactgcgcccggccgagtgcaaggttttattgaatggtggaagtagctctcagcagatggatggggagccataagagggatggagagggaaggtgatcttcccctggagctgggctgcccagcagctggactctactccgaccaccccctatcaaattctgcatcaacttaaatgtagatggctggctggcgctgctggtgtctgtcagtgtgctgttctgctcctctgttcctctcgatgtccagccgcttgtgtgtgtgtctgcttaaggtcctgggcttatatgagcacaagataggggggcatggcaggccaaaaggcaactttttgggtgcgtaaacagaaatgcttgttctcacttaggtccgtgagcacaggcccgagggtggagcactcaccatgtaccctactcatctctacccagcacttacttccctgcccttctcccatatcaagactacaggtgtgcacctacatgcccagctaatatgataaaatttttttgtagagagtgtcttgccacattgtccacacctcaagtgatcctccttccttggcctcccaaagtgttggaattactggcatgagccccctatccggccagtgaatgttaatgcttacctggtatatgcaaagcatcctaggagatagaaagttttgcaagaaaaggtccctgcccaaaaaggagcttattttttggtgcagacaatatatcctatacacattttgtctcctttacaggaaaataatgtattatcatttactgcaaaacaaattgttgtcatgcctttgtcattctaaagcttgtaggggctctttgcctctttattaagtgatgattgatatctgtgctttgagttcttatttatttgtttttaaaatagagatgagtctcactttgttgcccaggctgatcccaaactcctggtttcaagccatcctcctgcatgggcctcctaaaatgctgggattacaggtatgaagccattgtgcccagcctcactgtttttttcttttttttttttttttttgagacagtcttgctttttcactcaggctggagtgcagtagtgcaatctcggctcactgcaacctccgcctcctggattcaagcaattctcctgcctcagcctcctgagtagctgggattacaggtgtgcgccaccatgcccggctaattttttttttttgtatttttagtagagacggggtttcaccatgttggtcaggctggtctcaaactcctgaccttgtgatccatccacctcggcctcctaaagtgctgggattacaggcgtgagccaccgcgcccggcctgttttgttttaagcaaagaagttcttcatatttatagatgctgtctggtttagaggatatgctatctatccatatacaactgagttctctacatttccttggtctggaagggactaaatcttttagacaaggagaaggaaagttggtaaaagtagtgcttttcagttacgttctttacttgtagcgttgtaaagaacttatctgagaagtaaattgagtgtaatttacttttgcctgtggtcatcacttctacctcttaatggagtgtttttctatagaaaggttatagaatgtaactcaaacttttatttttgtgataatcggcgggggtgggggggggaagtgttgggaaaacaggtgtgagccattgcacctgttctattttatattctgctaggaaagaaaatgtaaaactgccaaattagctagttcaacaaatgaccacctataaaaaccaaggggtttacatagggttttttttttttttgagatggagtcttgctctgtcgcccaagctggagtgcaggtggcacgatctcagctcactggaacctctgcctcccaggttcaagtgatctcctgcctcagcctcctgagtatctgggactacaggtccttgtcaccacacccggctaattttttctacttttagtagagattgggtttcactgtgttagccaggatggtcttgatctcctgacctggttgtgatctgcccgcctcggcctcccaaagtgctaggattacaggcatgagccactgtgcctggctgtttgtttgtttgtttgagacagagctttgctctttctcctaggctggagtgaagtggctcaatcttggcttactgcaacctccacctcctgggttcaagtgattctcctgtctcagcttcctgagtatctgggattacaggtgcctgccaccatgcctggctaatttttgtatttttagtagagacagggtttcactatgttggccaggctggtcttgaactcctgacttcaggtgatccacccaccttggcctcccaaagtgctaggattacaggcatgaaccaccgcgcctggactaataggtttttaagctctaactttgggggaaaaaaacccaagatgattaaaaatgtcccatttagatgatctttagttgacttgacacaagtcttttggtctggactgctatagtaattcacgatgtggtttttttaggcactgcgttagaagcgaagaataatattaatttatttgggttagagagtagtggtgaacctgacttgtaacattctgtttaagagagtctgatgttccagtctgtaactgcaattggaagagctttggaaaaatgatttgtggacacataagatactttttaaaaacataattttctctgcctccttaaagaagtttgtgtttcttaaataaccagcattattactattcttttttttttttcttgagacacctgtcacccaggctagagtgcagtggtgtgacctcagctcactgcaacctctgcctcccgggttcaagtaattctcctgcctcagcctcctgagtagctgggattacaagattacaggcgtgtgccaccatgccagtctaatttttgtaattttagtagagacagggtttccccatgttggccaggctggtctcgaactcctgacctcatgatcctcccaccttggcctcccaaagtgttgggatttcaggcgtaagccactgtgcccagccactattcttctctttcagatgaatctaaaagatgtttagttttcagaaactggagaagatgttatattctcacttttccctgttaagtttcagcatctgttctggctgttttactttttctcaaaccttttatttagaacaaaaacttggatgaattgatttcaagacttcactttgcctttgggtaaggttttccttagtggtttgcctgagttgtgttttagtatctttcttgggttgcttagctttttcagcctttgggacaatctgttgacttagttgtgaattttagcttttcatttcttgtgccatagaatttgtatgtgctgccaggcatggtggcatgttcctgtagtcccagctacttgataaggtggcttgataagctacttgataaggtggtaggaggtagcttgatcccaagagtttgaggctgcagtgagctctggtcataccatcgtactatatgtagcctgggtgacaacgataccctgtctccaggaaaaaataaaataaaagttatgctaatagaacataaactatttgaggactgggaggtatctgttttgtttactgctatatccttagtgctcagaatggtggcagacacatagtaggtactcaaatatttgctgaataaatttagagtagcagtagcaggtttttatttattgagcacacactgaatggcaaagtgctaagctctttgaatggatttggtggtttttccattttatagcttgttttctgttcatatgatagtttatgaatgggtgtgagggaggaaggaggagatgaagccagcgttgttgaggatgctgctagctattaccaaatttcatcaagtttaagataccatcaattatagaacacaacattattttacgtattactaggtctcaaactcctggcctcaagtgatccgcctgccttggccccccaaagtgttgggattacaggtgtgagccaccgcacccggcctattttatgtactactgggaaagaaaatgtaaaactttcaaataaataattggatactgccaataacatgacatattctgattttaaagatgtaaaaatatgaacaaaccccaaaatatttaagggatactagttttacataaactctcatttaacaatcatgaaaccttctagagttggatattactatcttcatttgagagaggaggaaattgaagctcatgggttaattacataagctctccagtagaggatccagattgaggtctctcagatttcggaggccatgccctttttaccaccctacattgccttaggagtcaaggaaataaaatagtacattggcctgtctgtcaactttggcttgaagatagtcaactttggcttggagatacttagttggcatggctttaaacattttctttgaaatggatttttcctatttttccttaaaatcaaatatcttggctggggcgcggtggcttacacttgtaatcccagcactttgggaggccgatgagggtggatcatctgaggtcaggagttcgagaccagcctggctaacatagtgaaacccccctctactaaaaatacaaaaattagctgggcatggtggtgggtgcctgtaatccggctacttgagaggctgaggaaggagaatcggttgaacctaggaggtggagtttgcagtgagctgagaccgcaggattgtactgcagcctgggcaacaagagtgaaactcttgtctcaaaaaaaaaaaaaaattcaaatatctttgtatttactctgtgctagctactctgtgggtctgtgtgtatacaaaacaatataaggtcttatctcttcttctcaaggaatttatagtctgtttggggagatgagaactaaacatgaaagataactagagaagatttaaataacatttcagagaataatgcaagaggtttaacaaggcagtgaaggattaattgccaaataaattgtacaaataattgcttttggagttcagaggaagaaatgattgtttggggctggggtaatctagggaaggatgtaaatgaattcctgggagatattttcagttagtgagattatttactttacctttaaaatcatattaatgtttgttacaaatggaactgcaaactgtttgaacatgaactattgtatcttaatttttttaaatctccatatgagagtgcaggagctactaccccagagaaaagtagatcatgctttctacatgtatttgcttctattgtatcaagtagatggagaaagtactcagttttagaagaaaaatctttgggtgaaaaaaaagaggaactccctgtccctaaattccttcaatgtcactcttgccacgttttcaatcagttgtactttgtgagtcattgccgaggtcactttttgtgacttgtagcattcatgattaacttctaaagggtggaaacaagcattaatcccctttacatcactaatgttctctctgtcccccctccccctcctttccccactctcccctcccccctcccctcccctcccctcccctcccctcccctcccctcccctcccctcccctcccctcccccctcccctcccctctcccctcccctcctttctcctcccttcccctctctctcctcaggctcaaaggatcctcccacctcagtctcctgagtagttgggaccacaggtgtgtgtcactgtgcccgtttaatttttaaatttttttgtagagatggggcctttctatgttgttgctcaggctggtctcgaactcctggcctcaagttaccctcctgccctcaagttaccctcctgccttgcaaggcctcccaaagtactgggattccaggcaatactccttcataccgttttgaagcaaatactagacattatataatttccttaagtatctataaaagatacaactgtctttcataaaaagcaaactctacattattacatctagaaaacctgcattaatttcttagtagcatcaaatacacagtcacttcagttttctagttctcctcattttttaatttgttggaatcagattcaaacaagatgcagacattgcaatttggtttttatgcgacctaagtttctgttaatataggttttctcttcatctcttttttccttccaatttatcaaattattttttgccctgtagagtttttttgttttttttttttttttttttttttttttgttgttgttgttgttggagggacagagacttattctgtcacccaggctggagtgcaatgctgtgatcatagcttattgtagtctcaaactcgttggctcaagcgatcctcccacctcagcctcccaagtagctgggattaaaggtgcacaccaccatgccagctacattaaaatttttttttttttttggtggaaaaggggctcttgctatgttactcaggctggtctggaactcctggcctcaagtgattgtcctgtcttggcctcctaaagtgctgggattacaggcacaagtaaccgtgcccggcttcctgtagagtttcttattgtctggattttgcaaagtatgtctttgtggtggtttttcagtgtgtcctctgtcctctctctctctatttttaaaatggtagttagctttcaagtcttgatcagtttctggttcagttattttttacaagcatattcattatctgttgctgtgtaacaaattatctccaaacttgacatcttaaaccagcatttattggtcccagcacctcaggaaactgaggtgggaggactgcttaagcctggaagtttgaggctgcagtgagctgtgattgcacctgtgaataggcaattcctaggcaagaccctctctctaaaaattggccaggcatggtggctcatgcctatagtcccagcgctttgggaagcccaggcgggtggatcatttgagccccggagtttgagaccagcctgggcaacatggcgaaaccccatctatacaaacaatacaaaaattatccgggcatggtggcacatacctgttgtcccagctacttgggaggctgaggcaggagggaggatgtcttgagctgggacgtggaggttgcagttggctgagaacacaccactgtactccagtctgggtgacagcaagactctgtttcaaaacaaagcaaaataaacctcccaaactccttagtatttattatcttccacagtttctgaaggttaggactctgggagtagcctagctggggagttgtggttttagtactcttaatgggttgcagtcatctgaaggtttaacaaaggctggaggatttgcttccgaggtggcttactcagtgaccattggtgggaggtctcagtttctgcctgagtgtcctaaagctactgccagagctagtgatcagagagaaggagaaaaggaggagggaatttgaaatgcctttgtgacctcagaagtgacagcttgtcacttttcttttggtcacatagaccaactttgatacagtatgggaggggactgcttaagttcatgaatacctagagatgggtgtcactggggatgtcatcttggtgctggctactacagtgagactacttcccagggagtgtggtttatcagaagacacatgacgtctgtttttctttgagttgttaatattagcagatactataaagaaaaactttttctttctttcttcttcttcttttttttttttcctttggagagagtcttgctctgttgcccaggctggagtgcaatggtgtgatctcggctcaccgcaacctccacctcctgggttcaagtgattctcctgcctcagcctcccgagtagctgggactactggtgcgcaccaccacgcctggctcagttttgtgcttttagtgtagacggggtttcaccatgttggccaggctggtctcgaattcctgacctcaggtgatccacctgccttgtcctcccagggagctgggattacaggcgtgagccactgtgcccagccaagaaaagctttttctaatcaagtatttggtcacctggtgtgggtacagtttacataggaaagatgtgatatatgttagactctatttactagtatttaaaataacaagttggtttactagtattctcctgtggtaaaaaacattttttttctcaaagtttaaaaaaaaactattttgaaataattttagacttttgggaatgttgcaaaaatagtagagttttcctgtgtactccaccccgattcccccaatttaataacttgcatagccatgttatagtgatcaaaactaaggctaacactggtataatactgttaactaagtagcagatattgtcaaatttccactcttgtgtttttttctgttccaggatccaatcctattctttattaatctctcccttttgtttttttggggtttattttgttcaagtttttttttttcagttaggtgtaggatggatgttcatgataatgtatctttatttgtcttttatttaatactactttttttttttttttttttttcccttaaacgcagggtctcactgtcacccaggctggaatgcagttgtgctgacatggttcactgcagcctcaacctcctgggtttaagcggtccttctgtgtagctgggaccacaggcatgtgtcagcatgcctgactaattgttgtgggtatttaaaaaaatttatgaagtttgtattttgttttagatgttgcctttatattaaaatccttatgtaatagacttagtgcccccccaattttttggttattttctgttggtttcttactttgaatactattgaaattacctagtaacttctttttcttcccaagcatttgatttaaagtaatatctttttctttcagttgatatcaggtaatcagccagttttttttccagtttttatctcttcatacttcagtttatggatagttgtgctctagctacaatgttggaacatatagtcattatgtagtataaagtgtcacttagaaccctcattcaggtttttacagataaatatatatttaatgcccactaccatttttatgttgatatggactttccagttatttgggtcatctggaattcattttctctaataaattcctcaggaagagcttatgggaacagtattccttgtgttcccctatgtttgagaagtttgtctgcagctttaatagttaaaagctggcttggtgatgataaaattctgttccacagtatctgaaatatgtcattccactgtcttctggcacagagcatagctgttacagtatgatgatgtcgacctgtttttctttgagcaatgtagctttttttttttttttgtaattgtttagatatccataggattttttttttttttttttgagaaagagtctcactttgttgcccaggctagagtgcagtgacaggatctcggctcactgcaacctctgtcttccgggttcaagggattctcctgcctcagcctccctagtagctggaactacaggcatgtactaccacgcccagctaatttttgtatttttagtagagatagggttttgccatgttgtctaggctgatctcgaattcctgacctcaggtgatccacctgctttggcctcccaaagtgctgggattactggcgtgagccactgcgcctggcctttgtaatcttattggtgttggttggtctgacacatttttccttgggcattcagtgagtcttttcaatatgtattaatagtttcaagcttccttcccctcttctttttttgtctctgtttttctcaatatcatgaaggttttcttagtgctgttttttttttatttgctttttgttttttttgtcttactgccttggttttcttctttgggattcctactatacatatattggatcatctttgtgatatatatatggagacacggtctcggtctgtcgcctaggctgaagtgcagtggtgtgatcatggctcattgcaacctccacctcctgggctcaagcgatcctcctgcctcagcatcctgaatagctaggactataggggcatgccatcatgcctggttaatttttgtattttttatagtgatggggttttgccatgttgcccaggctggtctagaactcctgagctcaagtgatcctcccacctcaaccttccaaagtgttgggattacaggcatgagccactgtgccaggcctgtatattgtttatgtgagataaacctctcttttgtttcctcacttgtatatccaactgtcctctgaaccttttcatttagatttctaatggacaactgaaactcaacatgtcccaaaccaatctcatcattttccctgtaagatcttcactaaagccttttctttctcattgttggtaattcattcttgctgttgcttaggcttaaaaaccttgactactcttttatctccttgctatttttaagatatatgtagtgtctggccacatctcagtaattccattgaaccaacattttctgtgagttattgtaataacatcctaataagtcttcctgcattttactcttgtttccttgtatcctgttagtaacgtaacagctggagggatcttttacaatcctaaaccggtttgtcattcctctcttctagactatgtagaggtttcttatttcacccggagtagaaatgaaagttcttactttgtttcaatgagactctgtgacttgcctctgtttttttttttttttttttttaagaccgaatttccctcttgttgcctaggctgaagtgcagtggcgcagtcttggctcactgcaacctccgcctcccgcattcaagtgattcttctgcctcagcctctcgagttgctgggattacaggcatgtgctaccacgcccagctaattttgtatttttagtagagatggggtttctccatgttggtcaggctggtcttgaactccctaactcaggtgatcttcccgccctggcctcccaaagtgctgaggttacaggcatgagccaccgctaccggcctgcctctgttacatctctgatctcacctatcattcctgtcttccttgttcattcttgatccagtaccgttcttcatccagtgcaggcacattcttgcctttgggtatgccctttcttggaatgtttctgtcatatgtctgattaagttcctcatctctttaaagtctcaattcttacactcttaatgaggcccacccttaccaccctatttaataccggaacctctgaccttatagcactaatgctctaatatattaatactttacttatttattgtgtttaattataaagcatatgctccacaagaacaagaatcctagtccccattgctcactgacatatctcaaacacttaggtaagtgtctggcatatggtagatgttcatcattcatttgtcgagtgaataaacacactctgtatttccttgaaagggtgacgtcctaaagcccttctcttaccccatctgtggcgttaagatgtttttctgggtcacagcatatcgtttctctttaaaccctgtggtgggagtactttaggaaagttcctagtttttgttgattttattttatttttatattattattattattattattattttagacggagtctcgctctgccacccaggctagagtgcagtggtgcgatctcggcttactgcaagctccacctcccgggttcacaccattctcctgcctcagcctcctgagtagctgggactacaggcgcccatcaccatgcccgactaattttttgtgtgtgtgtttttagtagagacagggtttcaccacattagccaggatagtctcgatctcctgacctcgtgatccacccgcctcggcctcccaaagtgctgggattacaggcatgagccaccgcgcccggcccgttttattattttttgagatggagtgtcgctctgtcacccagactgaagtgcagtggcatgatctcagctcactgcaacctccacctcctgggttcaagcgattgtcgtgccttagcctcccgagtagctaggattacaggcgcctgccaccaccccctgctaattattttattttattttatttttatttttaataaagatggggtttaccaagttggccaggctggtcttgaactcctgacctcaggttatccacctgcctcgacctcccaaagtgctgggattataggtgtgagccaccatgctcagcctttgttggttttattttagcttcccgtctctttaggctggaactgtttctagaaatccatttaagatggaagttgactctgaaattggttaaataaagttagggtgatttgttaatatagaggaattgtgagttaccacctgtcatatatataagagaatttcttatttgttttcttactctctaagcctaataaaaaaaggttcctttaaaaaaaaaaaattcattctaggccaggtgcggtggcccacacctgtaatcccagcactttgggaggttgaggcaggcagatcacctgaggtcaggagttccagaccagccagcccaacatggcgaaaccccgtctctactaaaaatacaaaaaattagctgggcatggtggcaggcgcctgtaatctcagctactcgggaggctgaggcaggagaatcacttgaacctgggaggcagaggttggagtgagctgagatcatgccactgcactccagcctgggtggcaagagtgaaactccatctcaaaaaataaaataaaataaaaataaaaattaaaaaaaaatcttttttactgcattttcagtggcagtttgagaagaaggggtggtacatgtcgatagacattaacatgcaattgagaaatgcttttaaaaaagtgtgcatgtatattatgccttctcaatgtttttattctgtttcagcaaatcagtagagttgcagtaatctagaaaggattaattatgtcatgatggtttactgtgtagtctccccaagaagggccactctgttctgcgtactgctgttaggcacaagatgtgaaataatatctgtgaggtcttcatttggtgaatatgataaaatcaatagcattttaaagggtctcctaaaaataccatttaatgaattttaaaaattaatagtgaattattattattgagaacatttgttaaattagtgttttcttggtttggattggatgtaatgcataaacttcaaagatgtaaaaactgtatttaaaacattttttaaattttttgtagagatgggggtctcaccacgttgcctagggtggtctcgagctcttgggctcaagtgatcctcccacctcagcctccaaaagtgttagattacagtcctgagccatcatggacttaactatccttaattttgtatcacctatggagaacatgtattaactttgtaataaaaaagtttttaggcctggtgcagcagctcttgcctgtaatgccagcacattgggaggctgaggtgagaggatcacttaagcccaggagtttgaggccagcctgggcaacatgacaagaccccagattgacaaaaaattaaaaaaaaaaattagctgggcatgatgtggttaaaaaaaaatttatctgggcacaggatgacaggtacctgcggtcccagctacccggaaggctgagacatggcaatcacttgagaccaggaggttgaggctacagcaaactatgatctgtctgctgcactccatcctgggcaacagagcgaagactctgtctcaaaaaaaaaaaaaaaaaaaaagtcttctgtattttgtataaattggtggtggttggatctagaggcttgagcacagatgatttaatgagatcagtttccaggtttgcagattcacaaacctttgttctcttaaattcttcttctttcttctcttttttggagacagagtcttcctctgtcaccaggctggagtgtagtggcacaatcaaggcttattgcagcctctacctcccaggctcaagaaatcctcccaccttagcttcttaaatagctgggactacaggcgcacgccaccaccatgcctggctaatttttgtaattttttgtagagacatgatttcaccatgttgcttaggctggtctcaaactcctgagctcaagcagtctgcctacctgggcctcccagagtgctgggattacaggcgtgagccactgtgctggctgttcttttaactttttaagttggcctgagaaagcttgcagagccttattctccagatgtctctttttacaattattcttctaactgccaaaagaagtaagaagtctcccgttttactgtgttgtatttcaatttttttttttttttaaaagggtttgaagtccaggcgcggtggctcacacctgtaatcccggcactttgggaggccgaggtgggcagatgacctgaggttgggagtttgagaccaacctgaccaacatggagaaaccccatctctactaaaaatacaaaattagtcgggcatggaggcacatgcctgtaatctcagctactcgggaggctgaggcaggagaattgcttgaatccgggaggcagaggttgctgtgagctgagatcgtgccattgcactccagcctgggcaacaagagcaaaactccgtctcagaaaaaaaaaaaaaaaaaaaggtgggggggtttgaaacacatgggcaattagaaatactggtgtcagagtttaacaagtgaatgactctcaatgactgattaacaaacgacctattagttggtttctaagtgtgttttcatcagaattgaggtggaagttaatcaaattgctctctgagagatcatgaaaacataatttttgatggtagttcactgagactcttatcatgtaattaagattatactgaaagaattgaatgacatcgctttcacataactccttccatgtatttaatctacttatgtcagcacattttaatcttacaaaaaatgagtgcatgtcagtggtgggagaaggacaaaacatcttgctcattgtagcgaacagattcactgacagtgaaaagtgtatttttatgtatatattacccaaatttgtaatatgtttatgttttgaacaattacatcctaataatgatcatagtaactcagaataagatgtttttcaatacttagaccttatgatcagatggaatttaattatttcagtttatatatcttttttcagatataggataataaaatacattcaagcataaaatggcatttcctcatgattaaattctggggaagaagaacggaaattttatatttcaggagaaaggaagagttgtagaatttctgacttggagatgatctaggttcttttcaatatgtaagagtgatataacaccttattaaaatgctaatgctcataatatcttgcaagtgactacttcgtaactaaattgatgaaaaatttaaatgtcaacttgcaaatgttctggggcccatagtttttcaagaatcttctggtaggtacttgagcaaaaacattcaagtcctttggtacctgtttgttgtcaggctccgtgctggctgtgttggtgatgtaatgacacgttccctgaattgacacattcccatctttcaagcagtagactttctacaacaaccaacttaatttatgtctgaagcaaagacgtataactgtacacactaaagatctttacatttcgtgtttttataaacagaattacaaatgcatattttgtatttgaaattttaagacccctcacctccaggatgtgtgtgtgtttctttatgaaagtgcaggctggaagataaattttcttactaagatgaatgtttctttttgacagtgattaaaagatgattaaaatagtggtgattctgttgaaaaattttaaacatgtattttttaaaaatggaaaaacattatttgtgtatgccatagcaatttattttgcccacgtaggaaacagaaagggaaaagaagaatttttatatggttcaatattttactgttaagataacttaatacgtatgtatccttccatgaggaataaataggaaggctaaaatagaaaggttaatgtaaacattttttaaaagtaaattgttaggttttaaaaaaactttaattttactgttgttttttgggctttaaggaagctctgtatctctaggtttttaaatcctaatgtaccaggttggcccttttgctgaggatgaggcacttctgtggcagtgttgccatggtgactgcttgccaagtgctgtctcaaggtcactcatcactcatagccctgaatacttggattttgttaagggaaaatatcaacactcagttgataaaatgaagttaattatcatatcacattactgaagcatatctagcaaagttatacttataaacagcattttgtgttagtattgatgaactgtatgtttttgaatattgagttttaacctgccagattagaaggccaatggaaaatctataaattagccatagcccatattgtaatactttaattttattccatttctgactttaaaaaatgcagcagcgtaattttactgtggttatgtttgaagatatctaaacatatttccctcaatatttgctttttgatatgaggcaagagcaaagatttcttagcatttattttatattttggtaaacttagcttgaagttgccagttgctgaagcccttgtccatataagaacaggatgatcattatattttccccaaaccagattgcaggtagatagtagatctatctacctaggttctatttcatatattctttgtctcatactgctgttaattttccttgtccttactttgtaggttttaattttttttgttatatacgaacattatacaagaaaagctgttcattaaaggtttttgttgtttttatcaaaccagttttcaataaaggaatatatgaaaagaaattcccctttgcattagcctatatttcatctgggtcttgttctagagagaaaatcagagctatgtgtcttcattaggatgaaaggtgactttgaaatcagagatgagaagcattactgtaaaagggaaaaatgtgattgaaacaaacaaaaacatgcttttcaaaatacatggttagatttttttttttttttttaagacagggttttgctctgtcacccaggctggatggagtacagtggtacgatcttggttcactgtaaagtctgcctccagggctcaagggatcctcccacctcagcctcccgggtagctgggactacaagcacacaccaccatgtccagctaattttcgtatttttatgtagagacggggtttcgccatgttgctcagtctggtcttgaattcctgggcttaagggatttgctcgctttggcctcctgaagtgttaggattacaggcgtgagccaccgtgcctggcctgaaaatctggtcttttggctaattagaatctaactagttcctctgctttcaagggaattggatgaattggttctcctaaagcattttcatctctgcttctgtagagcagacacctttgcagtgtccgatcaagatacttttacactcttgaaaattttttttttaaattattattattatactttaagttttagggtacatgtgcacaatgtgcaggtttgttacatatgtatacatgtgccatgctggtgtgctgcacccattaacttgtcatttagcattaggtatatcacctaatgctatccctccccccctccccccacccacaacagtccccggtgtgtgatgttccccttcctgtgtccatgtgttctcattgttcaattcccacctatgagtgagaacatgcggtgtttggttttttgtccttgcgatagtttgttgagaatgatggtttccagcttcattcatgtccctacaaaggacatgaactcatcattttttatggctgcatagtattccatggtgtatatgtgccatgttttcttaatccagtctgtcactgttggacatttgggttggttccaagtctttgctattgtgaatagtgccgcaataaacatatgtgtgcatgtgtctttatagcagcatgatttataatcctttgggtatatgcccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcgtgactttttaatgactgccattctaactggtgtgagatggtatctcattgtggttttgatttgcatttctctgatggccagtgatgacgagcattttttcatgtgttttttggctgcataaatgtcttcttttgagaagtgtctgtttatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtggtttcttttgctgtgcagaagctctttagtttaattagatctcatttgtcaattttggcttttgttgccattgcttttggtgtttagacatgaagtccttgcccaaaatctccttaagctgataagcacttcagcaaagtctcaggatacaaaatcaatgtgcaaaaatcacaagcattcttatacaccaataacagacaaacaaagagccaaatcatgagtgaactcccattcataattgcttcaaagagaataaaatacctaggaatccaacttacaagggatgtgaaagacctcttcaaggagagctacaaaccactgctcaatgaaataaaagaggatacaaacaaatggaagaacgttccatgctcgtgggtaggaagaatcaatatcgtgaaaaaggccatactgcccaaggtaatttatagattcaatgccatccccatcgagctaccaatgactttcttcacagaattggaaaaaactactttaaagttcatatggaaccaaaaaggagcccacattgccaagtcaatcctaagccaaaagaacaaagctggaggcatcacgctacctgacttcaaactatactacaaggctacagtaaccaaaacagcatggtactggtaccaaaacagagatacagaccaatggaacagaacagagccctcagaaataatgctgcatatctacaagtatctgatctttgacaaagctgacaaaaacaagcaatggggaaaggattccctatttacactcttgaaatttcaatgaatgcaaagctctatagatattgttgcaaatatgccaggtagtatatatatgccagctaacgtttgtttcatttttgcatatttatgaagccaagtatattatctgatgctatatttgctaatttatttggaaaaaggtgttaatataaaactctgtaagctatgatgttaggcaacatgatctagaaaaaagaatattggagtgggaggccagggccctgcactgatcttccatctttcttttactgtgtgaacttggttaagtcacttgttgtggttcgtgtttctcatttgtaaatcaaggtatttccatttctgttgtgaccatccataattccattgtcagtattctgtgtagtaaaatttggattatcttcaataatggggagaattgtagttcataccaatctaaagtgctgaagctttcaaactgattcctttgattttggatgcagatttattttgtttttccttagatactattaaagtgttttttttttttttttttttttttgggacagagtctcgccctgtcgcccaggctggagtgcagttgcactatctcggttcactgcaagctccgcctcccaggttcatgccattctcctgcctcagcctcccgagtagctgggactataggcgcctgccaccatgcccggctgattttttttttgtatttttagtagagatggggtttcaccatgttagccaggatggtctcgatctcctgacctcatgatccgccagcctcggcctcccaaagtgctgggattacaggcgtgagccactgcacccagcctttttttttttttttttctgaggcagagtcttcctctgttgtccaggcaatggtgtgatcttggctcactgcaatctctgcctcccggattcaagcaattctcctgcctcagccccctgggtagctgggactacaggcatgtgccaccatgcctggctaattttcgtatttttattggagacagggtttcaccatgttggccaggctggtctcgaactcttgagctcaagcattccacccgccttggcctcccaaagtgctgggattagaggcatgagccactgtgccaagcctattaaagttattttgtattccacatgtatatttaaccaggttgttttggaacaagaaggggaagagtttttatgatggaactgtttatgtggcaagtaattagcagtttttaaaatgttttgtgactaactccacaaggttagaattgactgtagaaatagctgctgaaagaatatagagtagaaattgattttgcaatattttgaacctgggcttcaagtagactctggactttttcagtgagaaggaagggttaatgtgcaaaatattttgctttgaagttttcttttcccctttttttgtttgagatggggtctcactctgtcacccaggctgtagtacagtggtgtgatctcagctcactgcaacctccgcctcctgggtgcaagtgattctcccgtctcagcctgctgagaaactgggatcacaggcgcctgccaccatgcctgactaattttttgtatttttaatagagatggggtttcatcatgttggccaggctggtgaagctttctttaacatgtcccattctatagcccaggaaagcattacagtctcaaaagatggtggacatcaatgtttattaaaacattgtttttaaaagtttacaaagtagaatatatgtgaaaagtgaaagctttagaattaaatcctttcatacccatttccgtgcatatataaacacacagtttttactttgttggctcaccttgtacttactctgccattgccatctttttgtcagtatatagagatctttttcatttaaaaaataatggcaaatatgaatctgtggatagtctaataataaaccagctatttgctgttaaaacagtgccacaaagaacatcctttttctcccatctttacccactcctgcagaaatttccatagaacggattcctgaaagtcaaattttttgggtctgtggatgtccaagggatatctttcatatttggctggatttcaaaattgcttttcagaaagctttaatagcttacagtcctgtcaacagtaacacctacttttttcatgcctattttcttgggatgatgatcttatagcagccatttattgagtgcccaccatgtgttaggaattgtgtcaggtgcttaacttggctttctctaatcctgataatcctgtaagatattattttcatccccatttacagttgaggaatttgagggtcagagaggtgaaataacttgcttaaggccgcataactagtaaatggtaacacactggggtttaaaccgccacctgtctgattccaaagtctgtgttcctcttaatcacaaactgtttctaatattgagaggaccatctgtaaataggtgcatatatacaaattgagaatgtacatattttccttcaaattaagtaatatagtcagataatacatagaaagttaatagtccttcaaatcagccatagcccaaacaatatagataattcagtttattgacaaagatatatatgagatataatttctgactctggctttagatgtttaggttttggacttttcaaatgagtataatccttagtggtttcaaatttaacttgaggaaccaatgattacaactaaaaatatactgctagtctacaaacccagtctagttaaggatgccataacaaagtgccacagaccgagtggctaaacaaatttattttcttagagttctggaggctagcattccaaaatcagaagtcagcagggttgcttccttctgaagcctctttctttgacttgtagatggctgacatctccctgtgtcttcacatggttttctctctgttctctttgtctaaatttctttctttttttttttttttgagatggagtctgtctcttgttgcccaggctcgagtgcaacggcgcaatctcggctcactgcaacctccccctgctaggttcaaacgatttctcctgcctcagcctcccgagtagctaggattataggcatgcacctccacgcccagctaattttgtatttttttttttttttttttttttttttttagtagagatggggtttctccatgttggtcaggctggtctcaaactcttgacctcaggtgatctgcctgcctcggcgtcccaaagtgctgggattacagacgtgagccaccgcgccggcctaaatttcctcttacaagggcgccagtcatattggattagggccaccctagtgacctcattttgaataggatcacctctttaaagttctgtctctaaatatagtcacattgtgagaggtgaggattaaaacatgaaatttggcagggtgcaaagaactctaccagttcttccactgtttgcatcagtttcagtgtccctatcagtaaaagaagtcacaagccgtcttgaataattggaacccttctgccagattgtctaatgtcagtctcttttttttggatgctgcttcttctaagtcatcttcctcattgtttggcattggttcagaatccctcatctccatcaagttctcttaattcctctggtgtgtgttgtcttttagctcttacatttctctaagatccatatcttaaaacccttcactccctacttttttcactttttttttttttttttttttggccatatccacaacctccatgatttccttgataggctctgttttaaatcctctgaagttatgcacgacatctggacacagttttctccagcaggaatttattgttttggacttgatgcctttcacagctttttccgtaacagtgatggcatcttcaatggtgtaatctttccagattttcatgatgttttctctattagggttcttttccatagcatccataatccttcccatagagcactatgtgtaatgagccttaaaggtccttatgacctcctgatcttcagactgaattagagttatcatgtttgggggcaggtaaaccaactcgatgccttcattgttgaacttataggcttctgggtggtcagggcattgtccaatagtaaaagaactttaaaaggcagtcccttactggcaaggcacttcctgacttcagggacaaagcattgatggattcaatccagaaaaaggcttcttgttctccaggccttcttatacaaccaaaagactggcagctggtgtttatcttttcccttcaagatttggagcaggggagggaggtggtggctagcagcttcttagatgagggcagtcctgatcataaaccctactgcatttgtacaaaacagtagagttagcctgtcccttcctgccttatatcctgatgcttgcttctctttcttactaaatgtcctttgcagtctttttttcttccccagaatagggcactttcatctgcattaaaaatcttttcaggctctgcgtggtggctcacctctgtaatcccagcactttgggaggccgaggtgggcggatcacttgaggtcaggagttcgagaccagtctggccaacatggtgaaaccccgtctctactaaaaatacaaaaaaattagcctcccaggttccagtgattctcctgcctcagcctcccaggtagctgggactacaggcacaccctaccacacctggctaattttttgtatttttagcagagacagggtctcactgtgttgcccaggctggtctcaaactcttcaactaaggcagtcttctcaccttggcctcccaaagtgctaggattacaggcgtgagccactgcactggccaatttttgtatttttaatagagatgggctttcatcacattggccaaactggtctcgaactgctggcctcaatcagtccacccaccttggcctcccaaagtgttggaattacaggagtgagccaccacacctggccttaatttttttttggagacagtttcgctctgttgcccaggctagagtgctgtggcacaatcttggctcactgcaacctttgtctcctggtttcaagcaattctcctgcctcagccacccgagtagctgggattataggtgtgcgctatcatggccggctttttgtatttttagtagagagagggtttcaccatgttggccagactggtctcaaactcctgacctgaagtgatttgcccgccttgtcttcccaaattgctgggattacagatgtgagccatcgtgcccggccatgaggacgtgctttcaagtcaattggataaatacctggaagtgtgattgctggatcatatggttaagttaggttttagctttgtgaaaaactgccaaactgtcttctgaagtggctgtatcatttgtatgctcaccagcaatgaattagagttcctgttactctgcatgctcacaacatttggtattgtcagtttttttagattttagccattccaataggtatgtcgtagtatctcattgttttaattagcagtcctgtaataacagatgatgttcagcatcttcatatgcttatttgctatatgtgtatcttcagtgaggtgtctttagtccatcttttaactagtttcttgtgttactattttgtcattgaagagctctttatatattttggaatgtaaattctcgatgtgttaaacatttttctcacgatctggcttgctttgatttaaaaattttttttatttcaataattttgagttataggtggttttggttacattaatgagttcttttgtggtgatttctgagtttttaggtgtacctgagcagtgtacactgtgcccaatatgtagtcttatccctcattctttttttttttttttttttttgagatagggtctctgtcacccaggctggagtatagtggtatgattttggctcactgcagcttgacttctggggctcaggcgatcctcctaccgcagcctccagcctcctgagtagctgatatcacagatgcatgccaccatactcagctacttttttgtattttttgtagagacagggtttcgccatgttgcccaagctggtctcgaactcctgaggtcaaaggatctgcttgcttcagcctcctaaagtgctgggattatgggcatgagctactgggactggccaattttttttttttttcaagttgacttttttttttttttttaaagctacacggtctcgatctgttgcccagactgcagtgcagtggcatgttcatagctcactgcagcttcaaattcctgggctcaagtgatcctcttgcttcagcttccccaagaagctaggactataggcctgtgccagcacacccagctaattttttttctttttctttttttttttatttcatagagacaggatcttgctatgttgcctgggcttttctccaactctaagcctcaagtgatcctcttgcctcagcttcccaaagtgctgggattacaggcatgagccactgcacctcgcttaggctatttttttaaagagcagtttaaggttataggaaaatggagaggagggtacagagatttcccatatgtgcatgtcttcctccattatcagcaactccctgccagagtggtggatttgttatagttgatgaatttatgctgacacatcatcacctagagttcatagcttacattagggttaattcatagaatgttgtatattctgtgagtttaggcaaatttacaatgatctaccattaaaatatcatacagagtagtttcactaccctaaaaaatctatgccccacctattcatcccctccttccccgtaatctcaggcaaccattgatcattttattgtccccatagttttgcttttttttttgacatgtcatatagttggaaccataaagtatgtagccttttcagactagcttcttttgcttagtaatatgcatttaagtttcctccctgtctttttatgacttgatagcgtatttctttacagtgctgaatgagattccatgtgccacaatttatccactcacctattgaaggacatcttggttgcttccatgctttagcaattatgaataaagctgccataagcacctgtgtataggtttttgtgtgtaggatgtaagttttcaactttgggtaaaacaccaaggagcatgattgctggttagaatatgtttagttttttaagaaattgcccaactgtcttccaaaatggcttttgcattcctaccagcaatgaatgagaattcctgttgcttcacatactttccagtgtttggtgttgtcagtgttctagattttggccattccaacaggtgtgtattagtatcatcatttcagtttgcatttccctgatgacgtgtgatgtggatcatcttttcatatacttgtttgtcatctgtccatctgtcttgatttttttttttttaatttgtgttggcaaatgagggtcaggaattggatttgggatctagctttaaggaattagttagggtttggtattttgaatgtaaaacggcctaggaatgtatataaatcacaactgtaccatataccttttattattttgtgattataaaagcatagcaatcactttggaaaatttgggatactttcaaagcaggaaaaagtactactagtaattgtggggattaacattttgttatattttctaaattcttctttttcttctcctatatattctccatatatctctgtatccttcttttacatgtaattatgcagaacttttaataatattttagaggctacttttatgattattaaaagtaattttttaaaaataatgatgaggtcttgctatgttggccggattggtcttgaactcttggcctcaagcagtcctctccactgggcctcccaaagtgctaggattacaggcgtgagccaacacgcctggctaaaagtaatgtttatgtgagcatcaggtgccacaagctttgtctacatttctcatacttctttgtttagagtactggaagtagattctggatcgaagactactgctggatgttacgaattattttcctaatctatcctttttatattacattaaggagtttaacattttgtagagcttaaaaagttttttggtggcatcatttttgttttatttaaaaattacaacaaaattatttgtcattttaccacttaaaagtcagtgattttgggtgatgataatgtgtcagtgtagtttcaccagttgtaacaaactcaccactctgataggggatgtttatgatggggggaggagatgcatatgtagaaggaatagataggctatctctgtacttggtctcaattttggtgtgaacctaaaactgctctaagaaatcaaaaagggaaaaaaatggtacagtaattaaaccatgccctcaattcagttgcatattaaatttgagtgcaggctgggcatgatggcttatgcctgtaatcccagcagtttaagtggctgaggcatggctgggcacagtagctcatgcctgtaatcctagcactttgggaggctgaggcaggcagatcacctgaggtcaggaattcgagaccagcctgaccaacgtggtgaaatgccatctctactaaaaatataaaaaaattagctgggcgtggtggcaggcgcctgtagacccagctactcaggaagctgaggcacgagaatctcttgaacctgggaggcggagcttgcagtgagccaagatggtgccactgcactgtagcctgggctacagagcgagattctgtctcaaaaaaaaaaaaaaaaaaaagaaaaaagaaaaaggctgaggtgggaggatcacttgaactcaggagtttgagaccagcctgagcagcatgaggaaatcttgtctctacaaaaactacacaaattagccaggtgtggtggcatgcgcatgtggtcctagctacttgggaggttgaggcaagaggattgcttgagtctgcctgagggtgaggctgcagtgagccatgtactccatcctggggaaagagcgagaccctgtctcaaaaaacgaaaaaaaaaaaatttatgcacctttctccgtttttttccccaagtatgagcagatacatctatataaacattgttctcacacattaaaacaatcatgttattttgcttgcattttttttttcaattattgtagcatgggcatccttttaggtaattgtatatggacatctactgcattattttcaatggctatgtaatatactgttgttggatgtcctttatttagtcattcatctgttaattcagcaaagaactattgagtacctgtcatgtgcaagttactggggatatattcaacaaacagaacaaactgaaatctctcacctcaaggagcttgcatcaagttggagtttatattcccctattgatggtcattatttatttctcctcttttttttttttttaggtagaatattgtagtgaatatccttgttatatttttcatctttgttaaaaccccaattggtatctacatcttttgtatcttgatgtacttgtgctgtatttctagccatggacttgttgagtctaaaggatatatgcatttaaagtttttaatttttgccacaataccattttctttattttacatttcctgaatgcttggaagggttgtgcacgttttcatgtgtttgctggtcatttgtactactgtgaattgcctactctggttcttagtccatttttcttagtagattgtcttttcttgtctgtttttcttagtagattgtcttttctaatttgtaaagctcctatgtatcctaaactttaattccttgtttgtttatacaccagagatgttttctttctgttacttaactatagggtggtggttttttttttagaaggagttttacacttgttgcccaggctgaagtgcagtggcacgatctcgactcactgcaacctctgcctcgtgggttcaagcaattctcctgcctcagcctccagagtagctgggattacaggcatgtgccaccatgcctggctaattttgtatttttagtagagacgaggtttctccacgttggccaggctggtcttgaactcctgacctcaagtcacacgcctgcctcggcctcccaatgtgctaggattacaggcatgagccacggtgcctggccccagatgtctctcttaatgagtggctgagctgtatgttttttttactctcagagacatggctttcccttatccagaggcagtgtcactggtagggaggatctcgattatttagtctttgtaactgccctgctgttttagataggtagggcagggctgggcacagtgactcacacctgtaatcccagcactttgggaaactgaggtgggcagatcgcgtgagcccaggaagttggagatcagcctgggtgacatggtgaaactctgtctctactaaaaccacaaaaattagctgggcatagtgtcatgcacctgtagtcccagctacttggaaagctgaggcaggaggatcacttcaccctgggaggcagaggttgccttgagctctggtcatgccactgcactccagcctcagcctgggtgacagactgaaaccctgttccaaaaaaggaagaaactgaggagggaggtggggtaacatagctagtaattaggacagctgggatttgaatctttttttcctccttccagatccattggaacaagcattatttttgataatactcccatgaccatccactaacttcttatacttcctaaaagtgatgttgtatactagctttgtatggttctttcattgacaccattaaacctaagtttaaaaatgaagcatgtcattccctctcccaccatttaaaaatttttttttatttgatgctgagtttctctctgttgcccaggctggagtgcagtcgcacgatcttggctcactgcaacctctgcctcccgggttcaagcgatttctggctaatttttgtattttcagtagagatgggctttcatcatgttggccaggctggtctcgaactccagacctcaagtgatccacctgcctcggcctcccaaagtgctaggattacaggcgtgagccactgtggctgacttctcccacccctccctttttgttcccagttctcattggtctacagtgtgagtcccaagctggaatttggaagaagcttggggctattggacataatgataataaaatagttaattgattaactataattaacatgaataatgaaatccaccattatatagcgctatctgtctggaacagtcgtgtggttggttccttttagctcttggattaaatgttgtatcttaggagagcccttcccagacctgaaattactttcttctccctcttcttcccccttatctatatcaccttatttatttatttttgagatagggtcttgctctgtctcccaggctggagtgcagtggtgccatttcagctcaccgcaccctcaacctcctgggctcaagcgatcctttcacctcagcctccagaatagctgggaccacaggcacgtgctaccatgcccagctaatttttgtattttttgcagagacaggttttgccgtgtgcccaggctggtcttgaaatcctgagctcatgcagttaacccaccttggccacccacagtgttgagattacaggcatgagccactgcgcctagccctaatgtgctttttaaagagtaagcatagctgggtagagtggcgtgtacctgtagtcctgagtacttgggagactgaggcaggaagattgcttgagcccaggagttggaagccagcctgggcaacatagcaagactgtcaaaaaagaaaaagaagaaatttaaaaaagtactattagtactaacagtttacatggtatagtactatgtatgtatgtatgtatgtatgtatgtatgtatgtatgtatgtatgtattttgagacggagtcttgctctgtcaccaggctggagtgcagtgatgtgatcttagctcactgcaacctctgcctcctgggttcaagcgattctcctgcctcagcctcccgagtagctgggactacaggtgtgcaccaccacacccagctaatttttgtatttttagtagagatggagtttcgccatgttggtcaggatggtcttgatctcttgaccttgtgatccccccgcctcggcctcccaaagtgctaggattacaggtgtgagccactgcactcggttgtactttgttttgtttgatgtaacataaaatatttgagtacttttctttctttcttttttttttttaaagagctaggatgttatactattggcccaggctagagtgcagtgcagtggtgcaatcacagctcactcaacctcgaactcctgggctcaagtgatcctctcacctcaacctcccaagtagttgggagtaaaggttcatgtcatcacacctggctaattcttttctttcttttttgagactgagtttcattgttgttgcccagactggagtgcagtggcatgatcttggctcactgcaacctctgcctcctgggttcaagtgattctcttgcctcagcctcacaagtagctgggattacaggtacatgctaccgtgcccggccaatattttgtatttttagtagagacggggtttcaccatgttggccaggctggtctccaactcctgacctcaggtgatccacccaccttggcctcccaaagtgctgggattacaggtgtgagccaccgtgccaggccaattattttactttctttttgtagagatggggtctttctgtgttgcccaggctggtcttgaactcctgtcctcaagtgttcctccagcctcacaaaggattgggattacagtcatgagccaccatacctggtggcttttaagtcttttgttaaaaacaactctggcagagcaagaagacatacaggccactattttgtttgcttttgttttatagtcagtatttcctttcaagttctatttttggcacagaagctgcattggtcctggaagaagaccaggcaacaagctgctgtggctccagttgagtttactttccttgacaagtgaggaatgcattgggtacttgaataaaaccagggaggaatgatggcacttccgttgtgccagaccgtggcaagaagctaggcagctactgtaagtctgtactttttttctgttatctttggaatagttcacatggtagaagaaaaaaaaatacaggcatacctcagaccattgtgataaaatgaatattgtgataaaatgagtcactaattttttggtttcccagtagataaaaagttatgtttacactccattctgttaagtgtgcagtagcattatgtctaaagaaacaatgtatataccttaattaaaaaaatactttattgtggcctggtgggtagctccatcccagcacttggggaagctaaggcaggtggatccctttagctccatgagaccagcgtgggcaacatggcaagattccatctctaccaaaacgatgtaagaattaaccaggcgtggtggtggtgtgtgccggtaatcccagccatttgggaggctgaggtgggaggatcacttgaacctgggaggcagaagctgcagtgagccaatattgtgccaccacactccagcttcggtgacagagccagactctgtctcaaaaaaaaaaaaattattgctaaaaaatgctgattgatcatcttaacatttagtaagctgtaaatcttgctgggtgaaggtcttgcctcagtattgatggatgctgactgatcagggtggtggttaatgaaggctggggtggctgggacaaattaaaacagttttttttttttttgaggcagagttttgctctgttgcccaggctggagtgcagggtgtgatcacagctaactataacctctgccttccgggttcaagcagttcttctgccacagcctctcatgctgaggcaggaggatcacttgagcccaggagttcaagaccaggatcacttgagcccacgagtttgagaccaagctgggcaacatagcaagaccccatctctataaaatattacaaaaattagctgggcatggtggcatgcgcctgtagtcccagctactcgggaggctgaggtgggaggactgcttgggcctgggaggcagatgttgcagtgagccaagattgtgcctctgcactccagcctgggcaacagagccagaccctatctccccaccccataccgtcccccaataaaaaataaataattttgtttttttaaaggctggatgcggtggctcatgcctgtaatcccagcacttggggaggctgaggtgggtgaatcacctgaggtcaggaatttgagaccagcctggctaacatggtgaaaccctgcctgtctctattaaaaatacaaaaatgagccagacatggtggaggcgcctgtaatcccagctacttgggaggctgaggcacaagaattgcttgaactcgggaggcggaggttgtagcgagctgagattgtgccactgcactccagcctgggtgacggagagaccctgtctcaacaacagcaacaacaaaagtcaatcctctcaaaaccctgctgctcatggctgggcgcagtggctcacgcctgtaatctcagcactttgggaggccgaggagggcggatcacaaggtcaggagatcaagaccatcctggctaacacggtgaaaccccgtctctactaaaaatacaaaaaattagctggacgtggcggcgggtgcctgtagtcccagctactcgggaggctgaggcaggagaatggcacgaacccgggaggcagaggttgcagtgagctgagatcacgccactgcgctccagcctggttgacagagtgagactccgtctcaaaaaaaacaacaaaaaaaaaaccctgcggctcctttaagaactatgtttatgtgatattctaagtctttttttatgatttcgacaatgttcacagaatcttcactggggtagatgccatctcatgaaaccactttatttggtcatctataagaagcaactccttaaggctgggtgtggtggctcacacctgtaatcccagcaggcggattgcttgagcccaggactttgagactagcctgggcaacatggtgaaaccccatctctacaaaaaatacaaaaattagccaggtgtggtggcacatgcctgtagtcccagctcctcaggaagctgaggcaggaggattgcttgagcgtgggtggttgaggcctcagtgagctgtggtacgccactgcatttcagcctaggtaacagagtaagaccctgtctccaaaaaagcagggagcaactcctcaaactcctcatctgttgaagtttcatcgtgaggttacagtaattcagtcacatcttcagattccatgtcttttcctatttccaccacacttccagttacttcctccactgaaatcctgaacccttcaaagtcatccattagagttggaatcaacgtctttcagactcctatttgtgttgatattttgacctcctcccgtgaatcagaaatgttcttaatggcatctagaatggtaaatctttaccagaaagattcactttgcccatatccatcacagaaatcattatctatggcagctgtaactttatgaaatatgtcttaaatagtaatacttgaaagttaaaattgctccataatccatgggatgcagaacagatgttgtgttaatgggcgtgaaaacaacattaatctctttgtaccttgctatcagagctcttgggtgaccacgtgcaccgttaatgagcagtaatatatatacacacacacacacacacacacacacacacaagtatatacatatatgtgtgtgtgtgtgtgtgtatatacattttttttttcccatacagagtcttgctctgtcatccaggttggagtgcggtggcatgatctcagctcactgcaacctctgcctcccaggttcaagcaattctcctacctcagtctcccaagtagctgggattacaggtgtgtgccaccacgcctggctaatttttgtatttttagtagagacagggtttcaccatgttggctaggcaggtctagaactcctgacctcaggtgatccactcacttcagcctcccaaagtacggggattacaggtatgagccaccgtgcccggctaattttcttttctttctttttttttttttttgagacagattctcgctctgttgcccaggctggagtgcagttgcgtgatcttggctcactgcaaccttcacctcctgtgttcaagcgattcttgtgcttcagcctccagagtagctgggactactggcacacaccaccacacccggctaatttttgtgtttttattagagatgaggtttcactatgttgcccaggctggtctcgaactcctggcctcaagcaatccacctgccagcagtaatattttgaatttttttttggtgagcagtaggtctcaacagtggacctaaaatattcagtaaatcatgctgtaaacagatgtcattcaggctttattgttccatttataatgcacaggcagaatagattcagtgtaattctttttttctttttttttgagacagggtctgcctctgtcacccaggctgcagtctgcaggctgcagtgctgtggtgcaatctcagcttaatgcaacctctgcctccaggctcaagcaatcccttccacctcagcctcctgagtagctgggactacaggcacatgccaccatgctcgactaatttttttgttctttatggagacagggtttcaccatgttgcccaggctggtctctaattcctggactcaagtgatctgcctgccttggcctcccaaagtgttgggattgcaggtgtgagccactacacctggccctttcatttttatgttatgtagatgggttctttccttaaacctcatgaagcaacctcttctaacttttcttcagcttcctcaactgtctcagccctcatagaattgaagagagttatggtcttgctttggcttatggaatattgtggttggtttgatctttccagtccatgaaaacattcttcttaccagcaataaggctgtttcactttcttgttattcctgtgtttattggagtagcacttttaatttccttttaataactttctctgaggctgaggtagggggatcgcttgaacagccagcagttcaaggctgcagtgagatgtgattgcaccactgcaccccagtctgggccatatgaacgagacccagtatctagtaaaagaaaaaaaaacagtacttgtctcttcgcattcacaacttggctgtttggtgcaagagtcctagctttcagcctcagctttttgacatgccttcctcactaagcttaatcatttctagccccccccacctgccttttttttttatgagacagtctcactctgttgcccaggctggagtgcagtggaacaatctcagctcactgcgacttccacctcccgggttcaagtgattctcctgccttagcccaccaagtagctgggattgtaggtgtgcgccaccagacccagcaaatttttatatttttggtagagatggggtttcaccatgtttgtcaggctgctcttgggctcctgacttcaagtcatctgcccggctcagcctcccaaagtgctggaattacaggggtgcgccaccatgcctggcccatttctagcttttgacttaaagtgagagatgtgcatttcttccttttacttacttgaacacttagagaccactatagggttattatttggacttatttcaatattgctgtgtctcagggaataaggaggcctgaagagaagggagagagatggggaatagctattggagcagtgagaatatacacagcatttactgattaagtttaccatcttatatgagcacagtgcatggtgccccaaaacaattaacaatagtaacattgaagaacactgatcgcaggctgggcatggtggttcacacctgtaatcctagcactttaggaggctgaggtgggtagatcacctgagatcaggaattcaagaccagcctgaccaacatggtgaaaccctgtctctactacaaaaattagccaggtctgctggcaggcgcctataaccccagctactcagtaggctgaggcaggagaattgcttgaacccgggaggcggaggttgcagtgagccgagagctgagatcctgccactgcattccagcctgggtgacagggcaagactattgtctccaaaaaacaaacaaacaaacaaaaaaacactgattacacatcaccataagagataaaataataatgaaaaagcttcttgagataataggagcatcaccaaaatgtaagggaggcatacaaagtgagcaaatgctgttggaaaattggcaccagtagacttacctgaagcagggctgccacaaacctcaatttgtaaaaagcgcaatatctgtaaagcacaataaaatgaggtatgcctgtagggccaggaaaaattgaggaaaaattcattcctcttcactgccccacaggtgtcttggggagagggagtatgaaaaactaatttaattttaccctttgtctttcaggtttgtcctatttcaaaggcacgtgatgggatctttttgaagtgcctttcttagccacacctagggattaggttctctgaattcagggacttctcacagtatgtttttacttggttgccttccttttcctaaaatgatttaagaagtcctttgcacatacagaatgctccgtggccattaaataacaacccttttcctgccagtcattgacctccaaaaattcaaggggtcagtttgtttgaacttgagatctaacaccatttgttcagtttttttgttgaaattactgaatcaaacttcagaaaaagggtggggagcacaacagagtgacaaaattatgctattaagttgtgtagaaaatagaaaacacttttgaacatatagacaagataaaaaggccacgttttgcgttcgtcatacaaccgctaaaaatacagcagtgccttgctgctgctctgtctctgtggaatatcatggttaaagtataacccccatttggtgcataggaaaaaggcacacaaaattaatttaatttttctaagattacatatataaaattacaaggaacgtgtagatttcctgactatacctggtattttatcaatgaattgaaatgtgtaaagaacctcagagtacaacagagtaattactatggtttcctagcatgcattgtaactacttaatacattattaattattcagggaggtggttttttctagttgctactatgtatattttgattttttttttttttagcacagaggcatagtaatatttgtattaatgttggtgaaatgaaaatttaaaattttatgtaaaatgaaaatttaaattgaatttcagaacaaaactttatcaaatattttccaaaataggcttttgtgttttaagtttctaccttaattaacttttaggccacccttggtttttgaaatttgaatctgattctgttttcttcaagggcctgtatcttcctttgtatacgctttgcatagcaagtacaggtcatgcttagcattgtgttgaatgttgagtttatttcagtgtaaactgaatgctttagcgtaaactcagcattcaacacaatgtctggcattaaatgatttgcatagtattatgtaaaatgttcttgtacattgtagcagtgaggatatctgatataattttgacatcagcattatatatgtaattacatttctatttttaagtattaaggaatggaaatattttaatcttaatatacttaggaactctgggatcttccccaacctccccacttcccccaatagctgctgctggagatggaatcctatctgagggttaataataatgccatcacccattcccttcccccagccttatgctagagcctagtttgcctgcagctgcagtgctaggcatctttcaggaagtgaccttggcttgtattaatcaaattcagaacacacaaaaaagcttcttgctaacatgctgacttgatgtaaaattttatcgcatccattttgtttcaaaatgaggccattttgtaaaaagaagatatacagaagacccctaatttattatatatctatatatacgtatatgtaaagcttttgcaaaccatgttgaaaaaacaactaggtctattttaaagtagactttttattgccaaatatgcataaacttaaatcatgaaggcttgggaattgttactagaaaattacttcttttaatgtcgaattaagaaaaaactatcagcatcgagtttatttactatcttaactgacattatattgctatataaactttaaacactgaagttattttggaacccttcagcagttatattaagtcacacacttctgtatatttgcttactttcacgttttcagaaataactggtatcttactttgctggtttggataagagctaatatcctacatgaaatcgttttcttaggcaatggtggtgcctacagggtattctaaacgtaaaggtaaatttaagtcaatgagtctgttaaaattcaactacctattgtgtcaaagagagaaatattgctaactacaaatttacagtgtgttcatttaggatttgactaatcattttaatagtagagcagttaatacagcgatttcacttttatcctgtggtgcttcaaaggcatctagtttttaaatgtagtccagttaaggtgtatgtagtagaggttttcattttagacttgctcaatgttaaatatagaatgttgaaaatattatttaatggattagtttattggtttctgcatttgaagaaatttacataaattagttagggagcagttgtacctactgccaaatggttcactcctgagtttattgtacagttactcccaggtactgaaatataagaaaagaaaaatttaaaccttagctaagagctctgcctgcatttctgtggatccacattatgaaaaggatagaggaacattacctgtgtatagtaatggtttgaggagagggtagggaaactatgcaaataaaaaaattggggtataggcaaatccttcagttagatgtctttattatctgagttacttttaaagcatttactggatacacaaccagtattatctttttaccatcctataaattgttcatagaattgcaacctcatggaggaaaatccatctcctttacctgcctaaatttattctttgtcttgatactagcattaataattggtttgttagatactacaggctaaagaaactcagatttcaagaagaaagaagataattactcgatcatttctcccctcaaacacctgtttaaaatatattgtcttgaataaaattgtcaccttgaacttattgtgttctttgccttctccactcccctgtccttaaaaaaaataaaaagaagggaaagccttataagaaaaggaaaatgtgcaatcctggtagccaatgagttaatgttcatttgcagcccgaggggtcagcatgcagcctgtgtttcctgattggctgctaaaaggtgaaattgaaaccactgtaaacttttgaccctgtagcaattcttgtggaacgccttccactggtggagcccagagctttgctcacttccccacccaactctcccaccctctttcctgtatttattttgtgtgatcctgcagcactgcatgcagtttttccaaagtggcagggagagagaggcagaacaagcgcaagcaagcggcttgcttgaatgcctgttttggtaaccattggataagagctaatattcaactcagccaaagatatcaggccttttatactaatctgccaaccagatttttaagttttctccttaatctaaagctaatttaaaaaaatttaggctagtttagttccattgttcatcagtggatagtatcgttgtataagcaaaaatgtatggcataatttcctggatgtcttgaattaaaaataagttttaagttttagctacctttaccccatttatgtttcctgtatccctatgtaatttttacacaaatggccatttcatagaaggttttttgtcttttgcctttattatgaagaaactcaaatggcattttggttatgacaactctggacataattgcagaaattgtacaattaatgcctccccctttggctgagataaatggttttggatttgtcttgctttcacatgtaaatagtgttgaacagttaacaaccccatgaaaaaggcagggtagtttttctctattctttccttatactctcatgggactctggtctttttaattcttccttttatccatggtgtctagcacaatgtggcacatggatgcttagcagatgcttactgaatgaacatagctttcattttaggaactttaggtctgtttatacctgcttcccttttcctaattaattgatggcagcaactgtgatttgcttatttccaagtgccagtgcagtgcctgattctaatagatacacagcaagcatttaattgaaatcgaattaaaatctaacacaagatcatttcaagaagcaggactttacaaaatctaggttttcagaagccaaggcgtctgttttcactgcgttattatgaattttcaggctgattccgtatagaactaaatgtttaatttattaaatatgtagaatacattataagtcagcttgattctttctagtatatatcacaagatatgtggtaatacctgtctttattttactagacatgcatatgctgtaatttgaaataattccttgtcccccactcccttatcaagaagattatagcatttaaaaaagattgttataaatgtcttaccaatgttctcctgggaagcaaatacatttttacttaattgaacatacaataatggactaagtaatgggaaaaaaaaattcttaaactgagttaagtttatatagctcaaaaaaagtggtaccattttatataactttattattattattttttaagacagagtcttgctctgttgcccaggctggagtgcagtggcgcgatctcagctcactgcaacctctgcctacggggttcaagcgattctcctgcctcggcctcccgagtagctggaactacaggcgcccaccaccacacccagctactttttgtatttttagtagagatggggtttagccatgttggccaggctggtctcgaactcctgacctcaggtgatctgcccacctcggcctcccaaaatgctaggattacaggcatgagccactgcacccagccccattttatataacttgaaatgttcatatgattttcaacttgcatttggtcttctcctttcattatagctacagattagctgtagttgattgttgcaagtgaaacctgtggttagagttttgatcaaagatacttatcacttgataaataatcccaactgcaaaagtgttggattttgacgttaaatttaacactaatattttgcagcctttaacctgaaattcatttggtgacctagtctactctgtagtactttgaagattattgagcaacagctagcttttcccagtgacagtggctccccttttctgtgattttagggaagtgaggaaggagatcctgggagcagtgccagtgggagcttggaaagaacaatgggtttaatatgattaattgtagaatccttgccccttttcatgttcaacagtaaaagaaaaacatgtttataatattcagtggctgctttttgccctgttggtgtttccaagcattatatattatatagtttggattttcctgtgtatcaactcctctccccaattttattctttgttctggctttgaggcatatcttctcagactagctattaacaaggcttaatttgatgtttgatttcccctcacgtccttttaggtctctggtgatgaaggcttaaaataaaaacctaaaactaaaacaggggccatgttgtccaagatggactcagattcctgagctcaagcaatcttcctgcctcagcctcctgagtagctggcgttacaggtgtgcgctgccatgcctggcctggtgatgcaggttttggtaatgtagatgtcatcagtaaaccattaattctactagaaaatttaatgtccctgttaccttctcagatgtctaatgtttctggaacttctcacatttagttttatgtcagtatgatttggtttttgtatgtgtgattgatgaaaatctgaattgtgaaaagggataatcttgtttttgataaagaaaaaaaatactgtcctaagaaatctgctaggattgttgcctttgcagaatcttttttccagacaagtttaactcaccagcaaatttactaacagttctatacttacaggatcctggtatatagtagtactcctttccaggttcctggtaggcaagccaatcattgttctgtgactatttgcgaatctctctggtttaattatacacttccttggaggggagaattttgtacctggcttgtctttgtgttactgaactgaactgggtctatttttctgtgtatgcaatggaaagctgaacactaagcaccaagtttttgtaggaagaaaagtttattgcaaggctgctgtgtaaggagacaggagttgggctcaaatctgcctctctgaactagagtttgggtgcaggttttatatttggagagtaatgaggtgtgatctgagtggatcctgccatgggatgatgtcaaggcttgatttggttgcatcttctgtcctgccatgtggtgtctgctcttattcattcgctgttcctcagtttgatcatttagattccacccatggttgcattctttgttcatctgggcatgctgactttacatgatcttccacctgggggtccagcagttaacatttgggtccaagggtgcagattggcagggtcagcattcctttgagaagtacgaagaccagcactataacactggagtattaatctaggccctctcaccaccttctacacgaggcagcagtaattgtttcctaggtccattatgctactagatactttctgactcaaattcctttcctggccgggcacggtggctcatgcctgtaatcccagcactttgggaggccgaggtgggcagatttcttgaggtcaagagttcgataccagcctggccaatgtagtgaaaccctgtctctacaaaaattagctgggcatggtggcatgcacctgtaatcccagctactcgggaggctgaggcaggagaatcgctttaacccgggaggcagaggttgcaatgagccgagatcatgccccactgcactctagcctgtgcaacagagtgaaactccatcccccacccccatccccccaaaaaatcctttccttatcccacctcttttgttccttaggtgctaaccccaccccatgaccctccttcgtctttcctaataaaggaaaaaacataagagaaccattttagaagtcaaacctgatttaaaacagggccagaagatcttagaggttctttacagaagttctgcctaccttttctcccttcatcttacacgaattaaattggatagcataaaaattcaagttaaaaaacataacattcggtccggtatggtggctcacacctgtaatcccaacactttgggaggccgaggcagacagatcacttgagctcaggagttcaaggccagcctgggcaacatggtgaaaccctgtctctacaaaaaatataaaaattagctgggtatgatggtgtgtgcctgtagtcccagctccttgggtagttgatgtgggagtattgtttgagcctcggaggtcgaggctgaggtgagccatgaccataccaccacactccagccagtctgggcacagagtgagatcctgtctcaaaaagaaaaagaaaaaagctacaactttggtgcacaaaattattaaaaatattatataaaattaccttcaggctgtgtgtataagtaacataaatgaattttatgtttggacttgggtttcttcccctagatatctcagtatgcatatgcaaatatttaaaaaatctgaaaaaaattcgagacacttatgcttctaagcattttgcataagggatagtcacccggcactacctagagttttctttttcctttgttgtgagccacatgtaatgtgcctcccattccctgctcactgattttctcccctctaattttagtttcagaaacacaacagacctttccataatgcagctagattgtggttggctctccctatatactgtctgcagactacactacgtggaatgtccatggctataatatgtttgttacttgtaacttgtgaatatatcatttttcctttcccccataccaacagatctaccaattccagcatgaaagctattaactttagggcgtaattatggttgttatcttggttcgataccattggaattagtggcaatcatattgttgctttattgttaaatttggaaattcataaggtaaagtgaatgttcttactggttcacttatttattgcagcagaacctgcacgccatttcttcaagtgcaaaagcctgctgtttatatgttcatgtgttttattgtagattattttgaagaacggtctctcatttccttgctaatattttgttttggtggtcaaaatgcatccttttatagaaggcaagaaaacatctgagcctttcctctggcctttgcttgttggctttatccatccctccctcatctgataatttttggactagggcatttaagcatttgattctgccagggtattaatgttgtctttattctctgttgagcactgattttggacaaatgaatacccccacaagttcagagtacccatctgttttgatcacttttcaagattcagaactggtctccaccacctccactttgcattatccatttttacaaactgtgacagagtacatattatatatgctatgcctgacttttattttaattaattaattaattaatttacttatttttgagatggagttttgcttttgttgcccaggctagagcgcaatggcatggtcttgggtcactgtaacctctgcttccctaattcaggtgattctcctgcctcagcctcctgagtagctggactacaggcgcatgccatcacaccaaactaattttttgtatttttagtagatatggggtttcaccatgttgaccaggctggtctcaaactcctgacctcatgtgatccacccacctcggcctcccaaagtgctgggattcgaggcatgagccactgcgcctggccctgacttttgttttttaatttttatttttttgtgtgtggagatggtgtcttgctatgttgctcaggctgatcttgaactcctggcctcaagcggtcctcctacctcagcctttcaaagttctgggattataggcatgagccactgcgcctggccctatgcttgacttttcaaacagaagtagtgattatatggtacaataagacatctactcaaattcctaggaagaggtggtgtacttgatagcttttgtttgtttcatatatccagggaagggaaaaatgggaagacttaatttttttgagagagaatctcgctctgtcaccctggctggagtgcagtggcatagtctcgggtcactgcaacctctgcctcccaggttcaagtgattctcctgcttcaacctcctgagtagttgggattacaggcggatgccatgtcgcccggctaatttctgtatttttagtagagttggggttttgccatgttggccaggccagccttgaactcctgacctcaagtgatttgcccgccttgcctcccaaagtgctgggattacaggcgtgagccaccacgcccggctggaagacttaatttgtgggtgactaatcataatgcttaaatgaagaaaagacaataaaattcaatccctcctcttctttttgtcctcaggatcaaaatacttgctggatggtggactcagagaccaataaaaataaactgcttgaacatcctttgactggttagccaggtaattcagctttagtttgatttgatcctttgtaattttttgtcttcaaccttctgaagatattaccctcctctttaatttatgatttaattaaaactatttatgcttcatgtttttctctttaatgattattaaatgaatgtgcttagagtacttgagtgaatacgtatgtgtatgtacagttggcccttgaacaactgaggactggggacactgaccccttgttcagtaaaaaatgtgcagaactttcgactccccccaaacttaactactaataacctcctcttgcctagaagcctcactgttaatataaacagctgattaacacatattttgtatgttacatatattatatcctgtattcttacaataaagtaagctagagaaaataaaatgttattaagaaaattatggccaagtgcagtgactcatgtttataatcctagcactttgagaggctgaggtggttagatcacctgagtccaggagtttgagaacagtctgggcaacagagcgaaaccccatctctacagagaatgcaaaaactagccagacatagtggcctgtgccttagtccctagcactagagacactgaggtgggaggattgcctgtgcccatgaggttgaggctgcgcctcagctgtgattgtgccactgcactctagcctgggcaacagaatgaaaccctgtctccaaaaagaaaaaaaagaaatagaaaaaaggagaaaattttaaggaggctggacatggtggctcactcatatgctcacaactatgatcctagcactttggggattggaggtgggaggatcacttgaggccaggagttggagaccagcctaaacaacacagtaacacccccagttctacaaaacacacaaaaaattagctagcaaggtggtgtgcgcttgtagtcctagctgcttgggaggctgaggtgggagattgcttgatctcaggagtttgaagctgcagtgagctatgactgcaccactacacttcagcatgggcaacagtatgaaaccttgtctctagaaaataagtaaataaataaataattaaaaaggaaagacatggccggatgcggtggcgcatgcctgtaatcccagcactttgggaggccaaggtgggtggatcacctgaggttaggagtttgagaccagcctggccaatgtggtgaagctccgtctctactaaaaatacaaaaattagccgggcatagtggcgtgtgcctgtaatcccagctactcgaaaagctgaggcaggaaaatcacttgaaccttggaggtggaggttgtagtgagctgagatcatgctacagcactccagcctgggcaacagagtgagacttcatctcaaaaaaaaaaaaaaaaagtcataaggaagagaaaatatacatattattcattaagtggatcatcataaaggtcttcattcttttcgtgaggttgagtaggcttgaggaggagaaagaagaggaaatgttggtcctactgtcttaggcatggcagaaatagagaaaaatctgcgtataacagaacaaatgcagttcaaatgtgttgtacaaggggttatggtattcgtatatatgtatatacatacaaatacaaacataattttgggggaagagaagaaattccccctccttatgtgtgaatattttaatggcatttagtcaaacatctgaattagcctaacttacatttgctgtttcaccttgtgaagacaaatttccccagattgcttgtgctggcaaataacatttcatctaacccctttcttaactttttttttttttttttttttttttgagacagactccctctgtcacccaggctggagtgcagtggtgtgatctcggcttactgcagcttctgcctcctggattcaagcaattctcatgcctcagcctcccaagtagctgggattacaggcgtgcacggccacatccggctaagttttgtatttttggtagagatgggatttcaccatgttggccaggctgaaactcctggcctcaagtgacgtgcctgccttggcctaaagtgctgggattataggcgtgagccactacgcctggccccttttcttaacttttaatattacatcagaataggaaaaatgagaatagaaaaagctgtctagttgccgagaaaacaatcatgctttgcttagctaaatttcttttggtaatcccatcattctcttggttagctaggtttgaaatctgagttgtctttgaatcccaccgtactctgattcatttggtaagcaggctttatctggctttctattttcatgtgtcctgtatttgttccactttctgttcctaattttagcttccgaggccaagaccccataatttcatgagggtgtttttccttgtctctactgcttccttgtccactcacttaaaatttagctagattttcctaaatgtatacttttagccaagcttatgttgtgctctaagttttgtgctacctttccttggcttacagaaagaaaaagtacaaactcccttctctgacatttcaaatggtactttatctgagaatctatccaagttaccagccttaggtcttgcaatttccctgtaaaatccctcagttaattgtgatatatacccattcttctgaacatggcagagaactatctccacaggttttttttttttttttttgagacagagtttgttacccagcttggagtgcaatggcgcgatcttgtttcactgcaacctccacttccagggtcaagtgattctcctccctcagcctcctgagtagctgggattacaggcacgcgccaccctgcccggctaattttgtatttttagtagagacggggtttcaccatgttggccaggctggtcttgaactcctgaccttaggtgatctacctgcctcggcctcccaaagtgctggggttacaggtgtgaaccactgtgctcggccaattttttcttttttaaataccttttatttggaagtatacatttacaaaagttacaaaaatatagtataaagaacatctggatatccgttatccagacttacccacttgcttatttgtatttgtgctgtcctactctcttttctctttttctacccacgtaaacacacacacaatttttttttttaaccatttgagggtgagttacatatgttatgcttctttcccctaatacttctgttgtattcctacagatagggtcattctcttatataaccatggtacagttaataacttcataaatggacatcgatgaaatctatcgcccatattccagttttgtcagttgacctaagaaagtctcttgtagcattttctatgcttcctgtatagactacagtctggggtcaggttctgcattcagttattatttctctttggcctcctttttcctgggatattttcacagcctgtctttatctcttatgacattggcatttttgagaacacaacccttccctaacccctttactctgttcagtggagatgttcttcattttatgttggtctgaaatttccttgtgattagattaagatgttatggattcttggcaggaatactgcatccgcaatgtgatactctgagatggagtcatatgacgtccgtctgtcccttattgtgatgcaaattttgatcccttggccaaggtgttgccagatttctccaccatttggtttttttgccctctcttttgccaagcaataagcagcttgtggggaaacaatgcagatattctgattcttttcacggtttcttctagatttagcatccattgactcttgtctgatccagctttttattgtgatgattgcaaaatggtcatttttttctttccagcattcctttcccattacccgtcggatcttggctgtattccataatcaatagccctatgtattggtgatggattcatgaattcctattttttgaatggtttacaattcacttaccctgcttaattattttagtgctcaaattgtcctagaagtttggctagtgaaactcctgtaagtgggccgctgtgtccttgtggggaataaaagttttagagaccaagatctctctgagtgctaggtgtcctcactacttctgggctgttttctcatcttggcctttttagtggatagagctaggaaataatatgcatgcttatacacatacatgtacatatacatactcatacagtcatcccttcgtacctgagggtgattgggtctaagaccctttgtgtgcaccaaaatctgctgatgcttaagttctttaaactataaagtagcaattgtatttgcatataacccatgttcaatttcttgtatgctttaagtcatctctagattacttataagaatctaacacagtgtaaatactgtgtaggttgttgttaaactgtattttttaatttgtattttattgctgtattgtttttttaaatttattttttgagtatttttgatccatggatgcagaatccacgatacagagggctgacttcgcatgtgttcattgaaacatacatatacatattttagaaatcatgagcttatatcagtatgtacgtctttattccatgtctacagggttctttgtacttcattttttatttttatgtcccttattattatgtgggaatcctgactctcaaccttagtacatttactcatttgcctaatcctctaatacatctaaaataatttcagaattggttttttcatttcactgcaataaacaaactgaaaatgagtggagcatttgtctataattcttctccacctcccaattttacccaagaccgagagtaaacagttaaaatttaaattgcttggattagccctccataccctttctccaccccacttttttttttttttttttttttttttttgaggcagtcttggttgctcaggctggagtgcagtggtgcgaccttggctcactgcaacctctgccttctgggttcatgggattcttctgcctcagcctcctgagtagctgcaactacaggtgcgtgccaccatgcccagctaatttttgtatctttaatagagacagggtctcaccacgttgcccaagctggtctccaactcctgaggtcaggcgatccgcccgcctctgcctcccaaggtgctgggattacaggagtgagccaccacgcccgacctccaccccacttttacttcccaccttactttctgtataaactagttagggtattcatttgaaacaaaattaagtttatttacttgtttgcttatgctgcctcccattctgatttttatttttgtaatatgtagaataataacatgctttcaaaagtcaaaattatacaaaaggcatacattgcttttgtatcccttccatgccatttttcttcagttttcttaggtaaccaacttaaatgttttctgtcttatccttcccatttcttttttttgatggtatctgtatgttttatttatttatttatacaaaagatagcgtactatatatactcttgcactttgctttttttcctacttaactgatatctcctggaaataatgccctatcatgccaaagagatctttcccattcatttattttaattgtagtaaaatttacagaatataaaatacaacttttttttcttttaaagactgaatttggctcttgtctctcaggctggagtacagtggtgcaatctcagctcactgcaacctctgcctcccaggttcaagagattctcctgcctcagcctcccaagtatctgggactacaaatgcccaacagcatgcccgtctaatttttgtatttttttttagtagagacaggttttcaccatgttgaccaggctggtttcaaactcctgacctcaggtgatccacccgcctcagcttcccaaagtgcttgggagtaagctacaggtgtaagccattgtgcccggccagaggaccaacttttgattaaattatagatatccagttccagggctatttgtagaaaagatgttccttttttcttggtttgctttggtaacttgattaattgattatatttgccaaagtctctttctggcctctattcagtgccatcctcatgcccatatacattgtctgattataggactttatttatttttttgagatagagtctcgctctgtcactcaggctgacgtgcagtggcgcaccctcagctcactgcaacctctgcctccctggttcaagtgattctcctgccccagcctcctgagtagctgggattacaggtgcccactactaagcccagctaattttttttttttaagtagtgacggggttttgccatgttgtccaggttgatctcgagctcctgactcaggtgatacaccctccttgacctcccaaagttctgggattataggcatgagccactgcacctggctgacttgaacttttaaagtctcttttatttgttcttttatcctgaaactaggaaacaaatacaataccctctccaccagatttcacttggaatacttataaatttggatgaagtcatctcttgttcaggttccctaaatttactgagtcattggctgccactaagtgaccttccatctgtgaagctagtccctgtaaaccaagaacaggtaccaggcccataaacattgacttcttgtataatgtaaaatctttgttttctttttaaaaaaattttttaatttataagatgtttatttaaaatgttttgtggaagtgaggtatcactatattgcctaggctagtcttgaactcctgggctcaaataatccccctgcattggtttccccaagtgttggtgctgggattacaggtgtgagccactgtgtcctgccctactatctttgttatagtggtggacttgtcatacgattatattataattatatgacattatatcattatattgttcttaattataagaaatagtatatgacctagattgtacaatgatttgtccagttatcctggtaaattttatttacctttgtcttgacggaatttgattaagcctatgcaaataacgttattaacatgaaaaagtagacttagtttttactttattttgaggtggggtctcactctcttgacctacctggagtgcagtggtatgattgtggctcattgcaatcttgaattcctggactcaagcagtcctgcctcagcctcctgagtagctgggactacaggcatgcgccaccgctctcaaatgccatttaaaaattttcctacaaaagcataatatattaaattgtgagctagaggtagatgaagaagaaaggaaaagggcttcctcatatagccatcagaaaacagaatattaaaaaataacaccagcctgggcaatatggtaagaccccgtctctacaaaaataaaaaataaaaacattaactgggcattgtgtgtcacatgcctgtggtcccagctgctggggaggctgaggtaggaggatcgcttgacgctgggaggctgatgcctcagtgagccgtgatcgcaccatcgcaccccatcctgggcaagagaccaagaccctgcctcaaaacaaaacaaaaaacggctgggcatggtggctcatacctgtagtcccagcactttgggaggctgaggcaggttgatcacctgaggtcaggagttcaagaccagcctgaccaacgtggtgaaacctctctctactaaaaacgtaaaaattagctgggggtggtgatgggtgcctgtaatcccagctactcgggaggctgaggcataagaatcacttgaaccccagggggcagaggctgcagtgagccgagatcgcaccattgcattccagcctgggaaacagagtaagattgtgtctcaagacaaaaaacaaaagacaaaagaaaaaacaaaagaaaaaaccatagtctgaaacaactggttaaatttctgtcactagttcatttagtcctatgcagttaattctgtttctcttaggcttattctgtagtcacttttaagttgtctgcttagatgtttaagatacctagacattttggcctttagtatagttttaaaatttaaaaatgttagctcagtagttcattgcccagagtatttcataaattatcaagatttaaaggtactttgtacagtcttttgcatgagaatcttcaactgtcctttgaagacaaattatagcatatgagtcctcaagggaagcatcggagagtagcagaagccatcacccatttgacagtaagacatttctggtactcttcattcatctttatagatgtgcattttcatctgatgcccctttctctttggcctgaaggatataatttcatttccagaattgtttatcactgattgtctcaacttttatttatctgaaaatgtctttatttcaccctatttttgaaggtttggttcactggatagaaaattctgggttgttgatttttttatttcagcactttaaagttgttctgtggtgttgtaacctcctcccctttttttttttgaagagttgatttttaatcttgttctcagtatgtgtggtctttttttcttgtggatacttttaagattttctttttacgtttggtttaaaatagtttgactatgtatttaggtctagttttctttgtatttatcctgcatggtattctttgagcttcttggatttgtaaatttgtgttttcatcaaatatggaaagttttggccattcttcaagtactttttctgcatctctgcttcaatttaattctccttcctctgggactccaatcatacttgctaggccatttgattttcttttgttttgaggtggagtttcgttcttgtaccccaggctggagtgcagtggtgctcttttggctcactgcaacctccgcctcctgggttcaagcaattctcctgcctcagctcctgagtagctgggattacaggtgcttgccaccacacctggctaattttttttgtatttttagtagagatggggttttgccatgttggccaggctggtcttgaactcctgacctcaggtgatccatctgccccagcctcccaaagtgctgggattacaggtgtgagccaccaggcccagccgaccatttgatatgtttataagtcattaaggttctaaccatttttcttcagtcttcttcctttctcttcttcaaattggataattcttttgatatcccttcaagttcagtgactttttctgccaactcaatttctaagcactattcaacaatgaaatacttttacctcttatttcattcctacagccctgtgttggggttgatagaggcttcagaaaaggtaacaggtttatcaaagttatatacctagtttgtggcagaactgaaattagaacctaacttgattgtttacaaactacagaccattttctttccataatgccatgatctttatcttctaataagttgctgtcagttaaaatgttcatactgtaactggtgtgagtggtggtcctggtagcggatgctacttaattaacaacattgtcaaattgcagaaaattgaagttcttctcatttaaaaaacggttttcagttgaagaatttaagtatcctgaagtcagtaataccttgaactaatctttttagatgacattcctccagcagtgaaagtatgtctgtggttactcaacagaaaaatttaattctaatgacagactgtttttttgagacagagttttgctcttgttgcccaggctggagtgcagtagtgtgatctcctctcactacaacctctgcctcccaggttcaagcgattttcctgcctcagcctctcaagtagctcgggttacaggcatccgccaccacaccctgctaatgttttgtattttgtagagatggagtttcaccatgttggccaggctggtcttgacctcctgacctcaggtgatccacctgcctcggcctcccaaagtgctgggactacaggcctgagccactgcacccggccaccacatacgttttaaaatcaagactttggaatcccagactgcggtatcattcattgtctcggaaattaactctttggagtacctcctcttgagttgatggattttttttttttttttttttttttttttgagacagtctcgctctgttgcccaggctggagtgcagtggtgcgtcgcggctcactgcaagctccacctcccgggttcactccattctcctgcctcagcctccggagtagctgcgactacaggcgcccgccaccacgcccggctaattttttttgtatttttagtagagatggggtttcaccatgttagccaggatggtctcgatctcctgacctcgtgatccgcctgcctcggcctcccaaagcgctaggattacagacgtgagccactgcgcctggccaagttgatggatttaacttcatgaaaatttttaaaccagtttttgtgtcatcttagttaaaataagaacattataaagtttggtaaaggaatgaaagcattactaagccaggataattatcaagtgcctttatataaacattttcctaaaattctagtttctaaagttctgttagaaccttataagataattagtagtatgggaaaagaattactggcataagaatgacattcttagttgtagtaaccgtatatttatatttctccttcagtttattttgaaattaaatttctaaagtttaaaggtaaacattttaattataaattctgcattcatgccttctaattaaaatatgaaccaaattcatagaaatcctataaggcaacgattacttaaaaaccaaacaacttaagtgaattgtttttaggtttgtattgccttatgtataaaaatcaacatttgttgattttgccttggatataacacctctcatatttaaagccagaaaacacatgttgccagatgggaactaggaagagtagtagtctcatcttggcatcattttcttcataatgaccagttcacttgttttacacataatctcaggttctttccagctttaattttctatgattgacggatcagattctacattacggaaccttttagttacctgctaactgctgttacaccactcaagatgcgtgataaccagtcagattagaagatgaaagtcttggccaggtgcagtggctcatgcctgtaatcctagcactttgggaggcctaggtgggcagatcacttgaggtcaggagttcgaaaccagcctggccaacatgatgagatctcgtctctactaaaaatacaaaacaattagcctggcgtgttggcaggcacctgtaatcccagctactcaggaggctgaggcaggagaatcccttgaacctgggaggtggaggttgcagtgagtggagattgtgccactgcactccaggctgggcgacagagcgagactctgtctcaaaaaaaaaaaaaaaaaaaaaaaaaaaaaaagagaagatgaaagtcttcatgatattgctgggcacggtggctcacgcctgtaatcccagcactttggaaggctgaggtgggcagaatacctgatttttttttttttttttttttggagacagttttgctgttgccgcccagtctggagcgcagtaccgcgatctcagctcactgcaacctctgccttccgagttcaagtaattctcctgcctcagcctcctgagtagctgggattacaggcacccgccaccacgactggctaatttttgtatttttagtagagatggaattttgccacgctggccaggctggtctcgatcccctgacctcaggcaatccgcctgcctttgcctcccaaagtgatgggattacaggtgtgagccaccacgcccagcctttaaaatgaccttttttttttttttaaagacactctcactctgtcaccctagttggagtgcagcggcgccatctcggctcactgcaacctctgcctgttgggttcaagcgattctgctgcctcagctccctgagtagctgggactacaggcacgtaccaccatgcccagctaattttttatttttagtagagatggggtttcaccatgttggccaggctggtctcaaacttctgacctcaggtgatccgcccgccttggcctaccaaagtgtgctgggattacaggagtgagccaccacgcctggccttaaaataattttttacaggagatatctatagggataggtcaagaatctacagtccttggctggcgcttaacttgcaaaggaccgtgatttataactggttttaaattttttagactggtgggatcttccacttggtgtggctggaaaagagtgatttattattggaagtccagtaaggccagttctatctaaactgttagaatagctgtaagtgatgtggctttactgagattccatgaaaaaaataaaatatttgatgccatgacataaggctttttttttttttaattttttggtgggattggttaaaagcttggctctgaagttagaatgacttggatttaatttctagctccaccacttactggatgtatgactttgggttgagtttacctttcgatgtctcagtgttttcaagtgaagtagggataatattgaactgtactttcatctagctcactattctgtgtttcatagggctgtcaggaggattaaatgggagtaataagtggaatgcatttatcacaatacctcactcagatgttagagcaagtatttgttcacatagtgattttttactttaaacactaaaattacacattatttttatataaataaagagtatatattatttgaattatgaagtatactttgaaggctattcttgaacccactccttgaactgaagaacgggacggtcagttcgtatagtgtacctgctccctgaatctttcttcccgaagtcatcctgcttctatccttgaagtcacagctatctttgagttaataattaacttcatttaaaaaactttgaaaaagtctcatttggatgtgtccttgaacaatgtttagttttcttgttttttttagctttccaaaaatataatggatgtaatgtggtggctttctaaattgtaagatccaaccatgttgtgtataattcatttttaccatccctgtattgtattcttttgcatggcttcattagaattcatttttcaaatctgcaattgataaacattagagtttcttctagcttttgaagtgtgaacaacgttgcaatgatcattttttgtatctcgtttaaaatatttttattgctctaaagttttaaacaaacttgattttaactgctaatatatttgctttcaatgtggtggtactactttagaaaaagtaaattttctttctttttttaaattttagacagggtctcacactgttgcccaggctgaactgcagtgccatgatcttggcttactgcagcctctgccgcccagtctcaagcgatactcccacctcagcctcttgagtagctgggactacaggcgcttgccaccacacttgactaattaatatttttacatttttggtagagatggggatttcaacatgttgcccagggtggtctcgaactgagctcaagcgatccacctgcctcggcctcctgaagtgctgggattacaggtgtgaggcaccatactaagccaaaagtaaattttcttactgaaatgttttatacattgtttcttgttttattagctaagttatttcatatcactttttatttatcataggattagcaataagcactgtaattttccttaagtacttgatttcaaaaaaccaactttattaaagcataatatacatacaaaatatttaccaaccttacatttacaatttaatgagttttgacaaatgtgaccatcaccacagtcatgatataaaacatttctaccattccctaaagttctttgtgcctctgtgcaatcagtcatctccactggtccctagcaaccagaagaaacctccaactggtctgctttatgtcactactgttttaccttttctaaaatttcatgtgaatagtattcccattttgtgtgtgttacaccttttataattgtcccaccattcttggatattcttttctttttcattttctctttctttttcagttttggggagtttgtattgatcttaaggctctctggtctcccactcctatgtttggtctactgatgagcccatcaaaggcattttgcatttctgttagtcttttttgattctaacctgtgcttttttttttttttttgggagggggagatggagtttcgctctgtcgcctaggctggagtgcagtggtgcgatctcggctaactgtaacctctgcctcccgggttcatgccattctcctgcctcagcctcccgagtagctgggattacaggtactcgccaccaagcccagctactttttgtgtttttagtagagatagggtctctccatattgtccaggctggtcttgaactcctgacctcaggtgatccaccggcctcggcctcccaaagtgctgggattacaggtgtgagccaccgcacctggcctaacctttccttttgattcctccttagagtttttatctctctgcttacattacccatctcttcttgcatgttgtctgctttccccattagagcccgttaacatattaatcatagttaagattccatgattggtttttagatttttagaataaatgtttttaaagaaccaggcttctgccgggcgtggtggctcacgcctgtaatcccagcactttaggaggccgaggtgggcggatcatgaggtcaggagattgagaccatcctggctaacgcaatgaaaccccatctccactaaaaaatacaaaaaaattagccaggcgtggtggcgggcgcctgtagtcccagctactctggaggctgaggcaggagaatggcgtgaatgtgggaggcggagcttgcagtgagccaagatcacgccactgcactccagcctgggcgatagggcgagactctgtctcaaaaaaaaaaaaaaaaaaaagaacctggcttctttactgtttactagcgaactttggaagcatcatttacatgtattatcaaacctgtttttattttattttattttgagatggagtttcgctctgtcgctcaggttggagtgccgtggcacaatctctgctcactgcaacctccacctcctgggttcacgcggttctcctgcctcagcctcctgagtagctgggattacaggtgcgtgccaccatgcctggctaatttttgttatttttagtagagacagggtttcaccatgttggccaagctggtctcgaactcctgacctcaagtgatcctcctgccttggcctcccaaagtgctgggattacaggcatgagccaccacacctggctgaaacctatttttattattagtgctcatgatttctcatttaagaatatacataatcacacagcttacacacaaatattcatagcaacagtattcatagtagcagaacaacaacttaaatttccatcagctgataggtgcataaataaaatgtggtgtatccatacagtgaagtattagccagaaataaaaagcaatgaagtacagtcatgtagcatataacaatgtttcagtcaatgaaggaataggaccacatatatgacagtggttccataagattatactgtatttttactgtaccttttctatgtttagatatgcttagatacacaaataccattgtattacacttgcctgcgctattcaatatattaacatgcagtataggtataggtttgttgcgtaggagctgtaggctataccatatagcctagatttaggctgtattatctaggtttgttaagggacactctgtgatgtttgcacaatgatgaaatggaatgaaggcacatttctcgtaatgtatccctgtcattaagctaggcatgactgaaccgatatgtgctacaatgttgatgtatttgaaaacactatgctaagtaaaagaagccagtcacaaagaactagatattgtgtgatgccatttatattaaatgtcctgaataggtaaatccataaagacgcaaatacgtaagtggttgtcaagggcaggggtgaataggtggaaggttgggttatatgaggttgagggggtgggaatgggagcaggggggaataacagctaagggattttgagttctttttgggataatgaaaatgttctaaaattgattacagtgagagttacacaactctgaaatatactaaaagccagtcgtgcactttaagcatataatatgtgaattaatatctcagtaaagctgttaaagaatctagctgatgtatgcaaaactgctaagaacactatgatgtcatacagaaattttatggaaaaatattactttcctcatgacactgatctcaaaaggtttcctatctcaaacattgttagatttcaaaaataagatgttaattgcactcacttcaaattttaaaaaaccttattcagtctttttatagaggtcatcctgtaattatatggtcaatatgaattccagcagcatatctttttcatgtgtcaagaaagtttacattgaaaagattgcattcttaaaaagaccatacccagatccatctccacttcctgtttgtccactaaacatttgtgagatatttatggctatcttgcgcaatgcctccagaaatcaatgtttgctctcaagtttataactacagtttaaaaaaaattcaccaaaaaattcataatcctggtggatctgctgtttaggactagttagttaagtgcagtatatacaagtagaaaagctccaattattttacttgagatgatctgatggctaattctctcacttcctttgtgtgtgtgtgtgtgtgtgtgtgtgtgtgtgtgtattttatatattttatatatatatatttttttatttttattttttttgagatggagtcttgctgtgttgcccaggctggagtgcagtggcacgatcttggctcactgcaagctccacctcccgggttcacgccattctcctgccttagcctcccaagtagctgggactacaggcgcccaccaccacgcccagctaattttttgtatttttagtagagacaggatttcatcatgttggccagactggtctcgaactcgtgacctcagacaatctgcccgcctcggcctcccaaagtggtgggatttcaggcgtgagccaccgcgcatggccgcatttataattttaaaagcttaaatgtgttttttttttttggcgggcgtgtgggttgggggagatggagtctcagtctgtcacccaggctctagtgcagtggtgtgatctcggctcacttcagcctccgccttccaagctcagtcctgccacctaagccacccaagtagctgggactacaggcgtacactagcacacccagctaacgttttgtatttttggtagagatggggttttgccatgttgcccagtctggtttcgaactcctgggctcaagctatctgccctccttggcctcccaaagtgttgggattacgggcatgagccactgtccctggcaaaaaaaaaaaaaaaaaaagatagaattcaaaaattgtatcttgaatttagtgttgctcatatgacaacttactgtaaaaggtaatttattttaagtataggtcacatactatacaggggatgctttcaaaagacaattcctattgataattgtattttattattaaagtcaaagaatgtcttagtctgctttctggtgttctgttctagtgttctggtcttctagggttagaaactaggtagtttataaaagaaaggtttatttagcacatgattctggaagctgggaagtctgagatctggtcagcttctggtgagggccttgtgccatgtcgtaacaccacggtggagaagaggaaggggaagcaggcatgtgcaaagttaccaacacaagaggtggtctcactttgtaacaacccactctttagtccaaacctgtgggagcaagaactcaagggagtgagaaaggcattaatccatcttaacgacttacttgcctcttaaaggcaccacttccgaataccacatcgcggaccaagcctcaacatgagttttgtggagataaactatattcaaaccatagcaaagaccaaaggttatggcggtttactttctgctaagctttcagatatagacatgaaaatcgttagatcggtaataatatagctttatagtacttaattttgtaacttaattaagaaatagaattagcctaaatatcagctcaataatctaataaaaggtgaactgctgtacaaatagtccagtttgtatcactgttataaatgagcctatctcatgtgccaaacttttagagtaattgccttcttacgattttgtctgtttccaaaaacttctaattggagtatgcttttgaatctgtgtaatatttaacatataaagcctgcattatttagaagttgatattgaaaacctttaaacttctgacctcaaatagaatttgcttatgtataaccattacatgcagctggtgggttcaaaattgcgttttctgggtctctgctctgtgaaaaatagtatgtattggacatgagtacatgacagctgacatttatcaaggataacagggggagccatattcattttcacattttaaagcaactttgaaagctttgcatgtgcacacatgctcaacatatgttcctaagctttaaatatattttccatcatgtattgcttatcattaatataagaaactaagtgtaaatctttaatgagctcaatatattaaacttatatgagtacacaagcatttggaagatcagcaatgcaggctacttcattcatttacatggaatttatcttttatagtttctgtgctattacaaataatgtaacacattccagatagcccttttgttatatagtgtttgatttggcccttctttaatttcattaccataaaattttgtcctgttgtagaagactaaatggtagaaattaacttttttctaaaccaactattgttatattgctgttctctttgccaagctatttatagggctattttactggagggtgacataaatagaattggaatggcataattgttagtctgagttcttagcctttaaaaattttctttaaattgtgataattcaaaaagaattctagaataaaactgtaaagctcataatgttgccaacttgttaattaaaataacaccttttgtggttggtataggtttcagatactgtgaccatttaatatatttatatgcagatcacattgacttgctgcaaggtaacaggagaaatgctttgacttcagaagataaattggccatgcacagctgtaatcctactgtcttttcatttccagacatgattcagtagtttaaggctttgattcctaggcgctgagaagaaagttgaaatttatttttgtgtatgagaatttttacttaggtttttgataagtctagtttgtggtgtgaaggtaccatctaaactgttggtgtttccatacttaaatagctctctcttaattttatttgaaatatgagaagcctgagtttctttccattttccttttggcagttggaaaggaagccatcttattaagagtgatgaatagtgaagggttttttttaggctaaattgccagtgtctttagattaaaaaaaattgcagagcgataagttatgaacgttaacatgatttttcaaggaagaagtaatccttagtcacttgtaacccaaatgcctttcctaataagagttccgtttctacaaattcttttgacagagaagtgtatgatatcagagaggtttttagaaaacattttaagtgccataagaacaattcaagaccactaccaaaacttcatttgaagatcttagcatctttgagaatttagtatttctcaagagacatctcttaaattctcctgtaggcaccaagatttagacaatttgcttaatttattcagctaattaaatgggagagttccctgacccccctcacaggacgtgcgacagggctgtggctcatctgttccgtgctctcaaaccccttttgggaggaggagcatgcgtgcaggcaggtgcaggatctggggcgagtgcccctgggctctgttctcatgggagtgtccaggggtgggagtctgcaactccccaagcccaagtaggcatgtgttacagtatgctctttttgctttgccgaccatggacggcttaagtgttaaacagctcagggccttcttggtattcaggtccttgtccagcatcgaggaagaatcaggtcacacacggacttgaggatggtgaatgtggggattttattgagtgatggagttggctgtcagttggatggatgaggagctggaaaggggatggagtgggaaaatgatcttcccctggaatttggccatccagtggcccatctcctctctgaccgtcctcagccgaactcctcttggtgttcagatgttccttctcttctttctctgccgtgccattctgccattcttctgctcttctgtttgtctccttgtggagccgggggcttggggtttatatgggtacaggatatgggggcgtggtgggtcaaaaggcaacttttaggcatgaaaacaggaatgtttgttctcatttagggtcatgggttttcaggcttgagtggggcctttgccagggaactgccttcttctacccagtatttccctgtctcctgtctgtatcagtaatataggaattagaaaacacaaatatctttttttgtaaactaggttgtagatctgtttgtagttaagaggccaaattccatttttcttaattaccttgattctgtctgtaaatggtacagttcttgagggagccatttttcgagagcctaccatttgccagacatcactgaggttttgttttacctgtggtttttaatcctctcaacaactttgtaaaggtgatggatgtgcattttagagaagatgaaattgagcttcagagatgtaaatttggtaaggtcatgctgagctcaaatcagctgttaagtctgtgttcttttcccctcttcactatgcttcatttaagttggattcgttgttttcttgttcactaatgatgtgtgcttgtgtgtccagtttaggaattaaccttgtctattgattcttggtttcagacaagtatcccatgtctgtctagagtttggctgtggataattgatgatactatcttttcaaattatttataattcgtgaaagcttatagttcttttaacatccatttattcttctgtttctttttatcattcgtaatggctttcaattattattttaaaaatcgagatgggagcttgctatgttgcccaggctggtctcaaactcctgggctcaagtgagcctcccacctcagctttccaaagtgctggcaatgtaggcttgagccactgtgcctggccaattctttatctcattaaggatcataaacatttattttaaacgaatttcaagatttttattaagcattgaattcatcttttgatattgatgaatttcttgactatcttccttagttcagttattttttatttttatttattttttttgaggtggggtcttgctctgtcactcaggctggagtgcagtggcgagatctcggctcactgcaaccttcacctccaaggttcaagtgattctcctgccctcagcctcctgagtagctgggactacaggcgcatgccactacccccggccaatctttgtatttttagtagagacagtgtttcaccatgttggccaggatggtctcgatctcttgacctcgtgatccgcccgccttggcctcccaaagtgctgggataataggcgtgagccaccacgcctggcccattagttcactttttaaatacactttaggattttagtttatggtttatatgctgagtgggaaataatttttttccctttattttggtgttcttttctgtatgtctccctgccacctatacctctgtttttgttgccttcatacatttacaccatgctttcagtctagatctaggattctaattctgagatattattgcaatgttggtgatatgcattacttaggttttgtttgtgtgtgtgtgtgtatgagacatatatatattattattatgtatatattaccttttatttatttagagtaccttttatttcctctacaactgcctgtggcagtttgaaataataactttagctattgataataccttttttcaccttcctttcatgagttttttgtttggtttctacctatgagattttttcgttttacctgtgagccttgcttttggttttcttatcttgtgcatgatttcatttcctgactgcctttgcttgtttcttgtcctggagctcagttgggttcatggagttattaatttattgctttatatttcccctctgtcatggtccacaaatatatttgtcatgtttgagcgtaactgtgtcttttgaagttaatacaaaattcgtattttatctgtcattattatatttggagcaatgggataaggtggtgttgattgatagcagcatttctctgttatcctttcaggaagtctccatgttcttttgatctcacaacatggcttgtttatataggcctgcagatagtagatactaaagcatctgtttatttacttacttatctgcttacttgctttatttacttaccaccacccctgactaatttttttgtattttgtagagacagtgtcctgccacattgcccaggctggtcttgaacttctggcaagtgaccctctactgtagcctcccaaagtattgggattataggcatgagccactgctcctggccctaaaacatttattacatgaacgtggggtatcttggagaagccagacccagtttcaggctctcagccccaaccttaatctaatatagtggctctcaacgtgtggtgcgtggactcccggtagtctctgagaaccttttaagggttctacatggttaagactattctcataataatgctaatgtgttatttgctattttcatcccgttggtgtttgcaccgatggtggaaatgcggtgatgcataaaattgctgacaccttaccatgaattaaggcagtggcgccagactccgctcctaggtagacattgcattcttcactgccaggagctcataaagaaaaaaaaaaatcagttttccactgaggattgtccatgatgaagcagcaacactacacctggccctcattcccttttttccttaagtacctttcactgtacccttaagtactgtcgttttaatgttctgtgtgatgagaatggaaaatgtgcacaaagacttctgcctgccaaagtatgatggctgtctccgggaaaagcacttgcgcagtttgcgttgtgaactgaagtacccacttttttcatggaacaccatttttacttggatgagtgacaaaccatggctattgagtcttggttatttggagactgtcttcaaattgagtgaggtgaacctgtcactacagggaaaacatctgactgtattggttgacagtgataaaatttgagcttcaagtgaaattataagtaagtaaacttgaatcggccaccatgagcataacagccttttattactttcctgatgagatgggtggtgacattaatgaatgtgggttaaaaaaattgtgtaatgaaatgtaccagcatttgaaagatctactttaactcagtgaaccagtattatctaaatgacccggtgtttgattatacagtgatgcatgggttaaagatctgttcagagtgcaagttagatccaatgcattttaatgagacagcatgaaaattcatttatatggtttcagattccactttgcaactgtaggagactagaatataccaccctaaaatatgcctgtttggtgtaaggattattttgagaagcagacacaggagaagttctgaaaacagagtagaagttacccttttgtaagggaaaatttatatctataaaggaaatctcccttgtaagggtgtcttcctcattaccaggaaaaggatgactcaatcactagaaacttactaatggagaaggcatagacttaaatctgtataacaagccttactgttgtttaccatgcttttcttggtcgcctctccataactattgctccctagcccctgtgcccttctttatttgtttcagctgaagatgatatttaagtctgaattctaagccacctcttagaaatgaaaagatttactcatttctctgggtatctctcatggatacatgagatatatttattatatttctgattttctcttgttaatttgtcttttgttaaggggtctgacccaacttagaactcagatagggtagaggaaaaattatttttttctctcctataaaactcacctttaagaaattaccagttgttttagtgtaatatcaagaaatatccataattatttataaaagtttattaaaatagtccttccttttacaagtacatgtctttgtgaggccagattttctttatatccttaaatcaagataacattgcaccggattgaatgcagaagtaaataactgttttctattaagtcaggtaattatatgcaaatatatgtttttaattattttataattctcattgtttcagaagttttgttttttgcaaaaattgttatttatgttaatatatgatgggctttaaaaagtgaatgagggccaggtatagtggctcatgcctgtaatcccagcactttaggaggccaggcaggtatatcacctgaggtcaggagtttgagactagcctggccaacatggtgaaaccctgtctctactaaaaatacaaaaattagccgggcatggtggcgggcacctgtaatcccaactacttgggaggctggggcaggagaatcgctcgaactggggaggtggaggttgcagtgagtcaagattgcggcattgcactccagcccagcctgggtgacaagagcaaaactccatctcaaaaaacaaaacaaaacaaataaaccaaaaaagtgaatgagtccggcttggtggctcatgcctgtaattccaacactttgtgaggccgaggtgggagaattgcttgagcctaggagttggagaccagcctgggaaacatagcaagacctggtctgtactaaaaattaaaaaaatcagctgggcatggtggcacatgcgtgtggttccagctactcgggaggctgaggtgggaggatcacttcagaccagcagatcgaggctacagtgagccgtgatcacaccattgcactccagcctgggtgacagagctgagaccctgtctccaaaaaaaaaaaaaaaaaaaaggtgaatgtttcttaagttttaatttctaatatggtgaatactgacataacccacatagcagaagttattacaggtttccagtttttaagaggtaaaggaatcctgagatcaaaaggcttgaaatctagtgaatttggttggaactctagaagcatttgacttaaacctttcaccttgttgtatttggtatcttgtagcacacccagttcctgctacagctgcctctattctgtgctgcttaaatacggaggaggtctgagctaaccaatctgaagtttggccaatttcaggggcatttagttgttaacctgaatctacttcttttattagtaagaaacatatctactatagagatttaggactttgaacagctgtataacattataggatatgtctggtactcagttgtttctgtttctgaatcacaaatcggccattaattttaaataaagacgttttgtagcatataatacaatttctgatgatctacttactagtttgttaattcctcacaccgagtcatcagctccttgaaggcaaaaaaattcctgttttgatcaacaattcatctaccccaagcacttagcataggggatactatttcctttttctatgtggatgacacccgatatgttgaacagtgaccactcttaagatacttggtgaagtaggttttggttttaaccagtttaggtgtatggatgattttacagaagttcgtaataaaattttcttgcctcagatattctctaataataatgaggtgcccccagcttcatttactagacatggataggcaggttttgtgaagtacagaaaaaaagttctttaaagttatggatcatgtcacgaggtcaggagtttgagaccatcctggccaacatggtgaaaccccatctctactaaaatacaaaaaaattagctggttgtggtggtgcacacctgtagtcccagctactcaggaggccgaggcaggggaattccttgaactcgggaggcagagattgtggtgagccgagattgcaccactgcactccagcccgggtgacagggcgagactccgtctcaaaaaaaaaaaaaaagttatggatcatgaaactaacatttgaatagcaacaaagaaaaaaccaagctatgttgtattttattttttatttttattttttaatgttgtattttaaattgaatgatgtacttctcctcctctttgcagtattttatatttttgcttactgcacatttcttccctgaagcaatcttgacctaatggtataaatgtttagctccacataagacggtagctattttttggagaggaatggagagggtcaagggttttattgagttttcagttctgataccttttaacctttttaccagtgctaccccaccctccagaaagcaaataatgttgaaagctttttttattttttaactttttgatatatattttcttattcattatttgtattgttgtcatcagatgaataatggctttagagatttatttgaaaagacaaattctattatcagacacataacttctagggatatggaaactattattattgttactgttttgagacgggatcttgctctgtcccccaggccagagtgcggtgatcatggttcactgcagacttgacctcctgggctcaagtgatcctcttacctgagcttcctaaatagctgggaccacaggcacatgctgccatgcccagctaatttttgtgttttttgcagagacagaatctcactatgttgcccaggctggtctcaaactgctgggctcaagcaatcctcttgccccagcctcccaaagcgttgggattacaggtgtgagctactgaaactggcccggaaacatttttaaaaaaggattcttttgaatttaaagttatttaatgattactgaagagtaataagctgtgaggtcaggaaaaaaaggactgagccacagactaagcagcagtacagatgatgacctattcaggaagtcttgtgagtcagacttgccgtgtcgtgttgctagagttacagatctgctccaacctctttgctttataagaaggacatctctctgttctaccttcaatatcttttctttgaaaaatcaacccaaaagtcttttattagctttacatttatttctacagtcttaatttttgtaacatcagtgttgcaggtgaacaaactcattgtagcctctatttttgatattgctggacagggctaactttagtactatagtgggaagtttgttattttgttttttactctacaggcactctggtttaggaatatttatctgtcttgcatttgaccatggttaccattccccctcttcattgtttacttagtgtaccatggtacactttatgtaccatccttgctgctctcagctgtttggttaccaggtggctaatgttgtcatctcttaagctttaacatttacttctcaatactgtcttttcctctgtgaggtagatggaaagaatagattagaagagaatggggcatatgctgtgatcatctctcctttacatctttattgcttattaatttaatttatatcagatttcatttctgctctgtgcacatacccactgtccctcctcaccactcttctttatccagttctttctcacttaccttagcatggctaaaacccttggtttttatttatctctttcttcctctgctgtttttattttcattatatgccacagggacaaacttaggtataagtactacttttgatgtagagatacttatgtctgtcaaaggaaaattaaactacaaaccccagaggtaaaaaatggtacacaatactggggtttaaaaaatctcctcctcggccgggctcatgcctgtaatcccaggactttgggaggctggggtaggttggtcacctgaggtcaggagttcgagaccagcctggccaacatggcgaaaccccgactctactaataatacagaaatgaggtgggtatggtggcagctgcctgtaatcccggctacttgggaggctgaggcaggagaatcgcttgaatctgggaggcggaagttttagtaagccgagattgcgccactgcactccagcctgggtgacagagcgagactccatctcaaaaacaaaacaaaacaaaataaaaaagccccactccttctgcccctccagaccagggtctcactcccttcacccaggctggagtgcagtggcgcgaaccttagctcactgtaacctctgcctcctgggctcaggtgatacccccacctcagcctcccgagtagctgcgactacaggtgtgcgtcaccacgcttggctaagtgttttgtattttttgtagagacggcgttttgccactttgcccaggctggtcttgaagtcccgggttcaagctgtcctctcatcttggcctcccaaagtgttgagattacaagtgtgagccaccacacccagccaaattatttctttttacctctgtaaaaggagaaccttctctgtattttaagaagatgtggagttggtcaaaagtacagctgatgggaaagcaaaggagaactggagtttgaaaagagaagaggaatggtggtagttaaaaaaaaattttgtaaaaaatagagttacatacaagtttacacaatggtttagagcttacaaggtaggaagcagagacagaaatagtgtaatatgtaaaatgttatagtaaaaatatggaaaatgcttaggataaagaagggaaaacttttgtctaattgggagagtcggggatggttttaccagaggtgacaaattaatcttgaagggcaggaatattctagatggaaaagcgatgtgggaaagattaaaaaaaaattagtgacttaaggttaaaaataaaggaaatgtttcagttacctttattaaaaacttttagtataaagatcattttggggttgctggtggtgattgatgaggaagaagtatgactggtaacaggttgtttaaactgaagccaaattcaggtttatgaagctcagacttaagtctgttcttatatatgagatagattcagtgtattaaattgtagaagtcaatgtaacctttaaaacaaaagagttacccggctagttagtatgctgtcaggagagggtaacttgatttggatatggatggaattggctcccttaactccctctgtacagtgtattatctgtgaacttcaactctgttgctcatgtagaggttgagaagtctcttggcagcaagtttccagttgcaactaacacctgagttggctaattggtatgcccagttctagcactctagtctctggggagtttatgtttaaattcaacttcatcaggtttaaactggaacataaatgtgcaagaaggaagagagaatggaaccttgcgcataaaataatttacattcagatgcttttctgttcaatttatatattaaaaataggatgttttactttattgtttcttgctagcccttcactcaatatgctggcattataaagcaaagatagtggagaagaaattaccaagaactgaagttgtactgttttcttgtatacatctccaccaaggtagtttcttgtagataccatgtgtatgttttgtttctaaaaactgtaggctcctagctttgctattcattgtgttcaaacgattccttctttttttttttttttaacacttaccaaatttaattgtttttctgttttcctgttctgctagcctgagagttctagtaattggtagtgacatttatccctgttttctggggctaaaatgattctgggcatgcaaaacgtttgagctgaaatggaattaaattgaaaaaaaaaaaaaggattgtgttatactttatcctacaaaacataatagcaaattatcagccacaaaacaaaaggatataaaaaatttccctctctgacagaggatgaggaagcaaaagaaaaataaataagtaggccaggcgcggcggctcacgcctgtaatcccagcactttgggaggctgaggccggtggatcatgaggtcaggagttcaagaccagcctttccaagatggtgaaaccccgtctctactaaaaatataaaaattagctgggcgtggtggtgggtgcctgtaatcccagctactcgggaggctgaggcaggagaatcgcttgaacctgggaggcggaggttgcactgagattgcgctactgcactctagcctgggcgacagagcaagactctgtcttaaaaaaaaaaaaaaattaaaaaaaattttcttttctttcccctcctacttatctcctcacagctcttaacttccttaccagcattgaaagaaacaaaggtaggaggagatactaactggaagagtcatccacttgaggaggaagcttttataacagttccacgttataaaagctcttccctgccttcccctgtcctttacacacgttatatttgtcttcagtcctttctccgtggtaccagttctcttggagctcctcttattttattagtaagggtatgaatgacggattgaaagaaagaagattaagaaactttttgatatttttagggtagagaaaaaaaccttgtaagattaagcccttgtgttaactagtagtggttattttctaagttgtctgattaggaatttgagaatttggaatttcagttttgggtagaacttttatgtatgactgtctcattcttcccaagaacttgttttttctgattgacttgagcagtctctgcttttgcatagtgcttgaagcagtttttaataaaccagttcagatccatagctctttgaaaaaatttccataagttactgtgattctcaagaaatacaccaaacctctctctaattagtgtatttaatcataccttgtataagttagggaaacaagcctgacagataaactaaattgctgctgggatagtcaagtggctccaccatttaatgatagcaaaccaaagaataacaatacttgactgaccattttaaggtatagtttgtatatgtcgatctcaaattttccttttgctgtgtgagccattgaccatctcaagtggaagtaagggttatgggtaatattagaccaccacgaagggcagtttagtgacatcggtgggtaatggttaggtaaggtacttgaggggagcattagtatctgctgagcttgagcaactccttgcctctgtccctaatactgcatgcccctaaactatggctgtcataacctctcagtgttcttactgataagctgagaaattttctggctaactggttggctatagtgtgattcagtagtacaaatggcttgttttggtggtggtggggaataaaatgcccaagaaacatttgatacatattttgttggttatgaagtctgaaaaaatattgtagttccagctctgccatccagaatctgtgtgtgctctagtggaaagttagccatttccttatctgtaaaatgggactattatagtaatacatactctggagggtcatggtaaataaattacagtatatatgagatgtctagtattgtactaccacaaaattatctccttatttctcccttattaatttaggaaaagtaaaatattttagttggtttctatgtcaatttagatttactggataacccatctgctattttggcacactatagctttttttaggtccctcaaaataacttcttgcttgcctaatgaacactggtagtgttgattgatatcttttccttttggacagggcgtagttcctgtatccttgtccatttagctaatttgctgtgtataatcaaactttttccctcctgtcttaatcccaaataaccaaaaggaaagctgattagtgctgctaagccatataccaaaattttcatggtttttgagctagcaggtataattctttgctgcttttcagctttaattagttagttattccatgaaagttcattttctaacaatttattatatattctgttgatgtctaagcttcaacatgttccatagcttgaatgttacgtatagaaaggcctatagtatttataggaaacattctatccagttgttgtaagatacttgttcattttaaatcttatcatggatatactttggacttttccatataatatagaaatagcgttagattttgatagcattgaaaggtattctcattgttactattctacattaaagtaattgtgacgagacgtggtggctcacgcctgtaattccagctctttgggaggctgaggcgggtggatcacttgaggtcaggtgtttgagaccagcctgaccaatatggtgaaaccccatctctactaaaaatagaaaaactaggccagggtggtggcaggcgcctgtagtcccagctactcaggaggctgaggcaggagaattgcttgaatctgggaggtggaggttgcagtgagccgagattgcaccactgcactccacccgccccccgcccccaccccccgccccgccaaaaaaaagtaattgcatggaatatattgcttaaatgcaggtttttttttttggacggagtttcattcttgttgcccaggctggagtacaatggcacaatcccggctcactgcaacctccacctcctgggttcaagcaatcctcctgcctcagtcccccaagtagctgggattacaggcatgtgtcaccacgcccggctaattttgtacttttagtagagatggggtttcaccatgttggtcaggctggtctcgaactcctgacctcaggtgatccgcccacctcggcctcccaaagtgctaggattacaggcgtgagccaccccgcccagccttttaaaaatgcagtcttaaagtgtgcattgccatatttaatacatttaagtagtgtagcatacaactttttttagtggaaacattttagataaggaaaataattgtaaaaatggctcatggatctggatgatagagtttatattgaaagattgacttggttttagcctttgaattctgataaaatgagaagttcttccttccagttcttttctgtactttggtgccaggggcttgaaaaggcttctgagactggattgtgtatcttcttggaagtgcattagaggtgcagtggaaacttcaaaatatggatgcatctcacaattggatgtatgatgtaacttcaggaggacagattacttggtagcaagtataggtcctaatttcttttctattcaactataagtgataatatctaattgtagggagtcagaattaagaagggactctatgttaatagactgttcttttttttcttttttagacggagtctcactctgtcatccaggctggagtgcagtggcgcggtcttggctcactggcaacttctgcctctcgggtttaagcttttctcctgcctcagcttcctgagtagctgggactacatgtgcatgccaccatgcccagctaatttttgtatttttagtagagatagggtttcaccatgttggccaggctggtcttgaactcctgacctcaggtgatccacccgcctcggcctcccaaagtgctgggattacaggcgtgagccaccgcgcctggcctagactgttcttacaatcaaacttagtgtgagactgttgtgctatattatttgccctttgaagatggcttttatcaactacatatattctccaaactagatgggttgtaatttaagatgtaaaaatgtaagctagtctcaggtagttactgttccatgtttcttaccggttaagaacttcatggtcttggtacctgccttattcccctctctcatcttcattcttgactgttgactgaaagtgatctagatctattgtgtctgtgctaggcatttaccttttatatcttaatctaccaaaatagcatatcctcccagtgagaaggagataacaggcgtggcaactaaaacaaatgccatttttgattttttgtttatagctaagattaataccaaatagaaaactgtacctgaagggttagtcatagtcatttgtgctcaggaattattgtatatattgaaattattattttggggaccagaaatgcttttttatttctcatgttgaacattttctttagtttaatgaaattcaggagatgtttgctctactttgctttttgttataaaacaatttgtcatttactcttagacattgtggtatcttatacagttgtacagtaaatgtacctaagttttgtccatgtctaattaagaactacaaatctgtccaacctgttcctaaaaaacccaagatagagactggacatggtggctcatgcctgtgattgcagcgctttgggaggctgacgtgggcagatcagttgaggtcaggagttcgagaccagcctggccatcatggtgaaaccctgtctctattgaaaatacaaaaattagccaggcgtggtggcacacacctataatctcagctactcgggaggctgagacgagaatcatttgaacccgggaggcggaggttgcagtgaactgagatcatgccactgcactccagcctgggtgacagagtgagactcttgtctcaaaagcaaaacaaaacaaaaaataagatagaaatattttatatcttaaacaattatacctttatgttcgggtaaacacctttttcatgattttaagttattattttcccttagttttttttttttttttttttttatagacagaattcactcttgctgcctaggctggagtgccaatggcccaatcttggcttactgcaacctccatctcccaggttcaagcaattctcctgtctcagcctcctgagtagctggaattacagacatgcaccaccacgtttggctaattttgtatttttagtagagatggagtttctccatgttggtcaggctggtctcgaactcccgacctcaggtgattcgcccatcttggcctcccaaagtgctgggattacatgcatgaggcaccacacccggccttcccttagtacctttttggataattaggttggactctgaaggagtaagtttggtagcaggaagattgcacaggcttatgtgtacagtgtagcttgttttgtgagatcaagagaaaaagctgcatgtgtctatggacatagctcgacatatttaggtttcattatatgcacataaacattggcttaacacaaatgatctgcatttctggtttaaactgatatttgtgcttattaatttttttgcatattaagagattgtcatgacttagtttttctattgatttaatttatgctgtcagaatttattgtaacactatatcaactgtagaagtaaacatttaaaaagtttaatgcagtaggattgcattgaatgattgttatagatcagaataaaggaaatttctaaactatgatttagtaggttgaatgttgcttttatatttattcaatatttattcaagacatatattgaccacctattacatggtaggccccttactccttactgagtattcaacttatatttaataacaaaggaaataatattgagaatataggcaaaattttatctttcaaattaaagaagtgctgttatccatggaatagtttctccatttgtttcagggattcagcttataaacaaaagccaaagtaaggaaataatatctagaatgtggaataaattacatatttaaaataaagaaatgtaggctgggtgtggtgggtcatgcctgtaatcccagcactttgggaggctgaggcaggcggataacttgaacccaggagttcaagaccagcctgggcaacatagtgagaccctgtctctccaaaaaatacaaaaattagctgggtgtggtggtgctcacctgttgtcccagctacttgggatactgaggcaggaggattgcttgagcctgggaagccgaggttacagtgagctgagattgtgccactgcacttcagcctgggtgacacagtaagaccctgtctttaaaaaaaaaaaaaaaaaaaagttattactcaatggatagtttgccattcaatttaaaaatcacctttgaatgaaacaaatataaaaccaattatagagacataacaagaattattctatttttgtacttaaggaatggaatcactattctttttatttttattttttgagatggagtcacactctgttacccaggcctggagtgcagtggcgggatctcagctcactgcaacctccgccttccgggttcatgcgattctcctgcctcagcctcccaagtagctgggactacaggcgcctgccaccacgcccagctaatttttgtatttttagtagagacagggtttcaccatattggccaggctggtctcgatctcctgaccttgtgattcacccgcctcggcctcccaaagtggtgggattacaggcgtgagccactgcacctggctctttaattattcaatttattattattattgtttttaagagacagagtctcactcggtcacccagtctggagtgcattggcgtgatcataactcactgcagcctcaaactcctcaaacaagcagtcttcctgttttattcctaagtagttaatgctataggtgtgcaccatgatgcctggcttatttttaaaaaaattttgtagagacagggtgttactgtgttgcacagattggtctcaaactcaagtgcctcaaactcaaactgcctgagcctcccaaagcactgggattacttgagctactctttttaaatatgaaaattggaaaatcaaaaccgaacatacctttaagtttaaaactcttttatttgaggataattttaaacttaaagcaaggttgcaagaaaatagtacaaagagtttttacgtttatctcccccccgggtcaggattcacctagtgtcaactcccttcctcatccttgctctgcctgtccccattcccaggtttattcactcactcattatatatgcaatttttcttaaccatctgaggataatttgcatatgtaatagcctgttaccccaaatattatactaagaatattggtctcttaaataaccgtcgttcatttatcaacttaagtgtattaatattgacaacatacttttatgtctattgtccatattctaattttgtcagttgatccaataatattctttatagcattttcttaccctctagcacaggattcagtctaggatcaaatattgcatttagttgtcattttcttatagcttcctttaaaatctggactgtttacagactttctttgtcttttgtgacattgacacgtttgaaaatacaatacccctgagattgtgtgatctgactgtgccactactaataatagtgagccactactaataaaggttattttaagtctttttctgtccttcatttaaacttgtcatggggaaaaaacaaatacttaaatcatctcagctttttagcctttccattttacaaccaaagttatagaatgaattttcttggtaatttaatacatatttagtgcatctgtaaagacaatgttgcaatctagattttctgatttatattatgatcatgtgattttttaaatttttattttttttgtttttttgcttttgattttttttttaaagctacacatttgaagtttgatcagcatcttgagtgaattttttcatttttataaatctgtcttccttcctggtagcattctgccacctagtggaaatttatgtcctccagcatacgtctcagagtttagttggaatgcaagatgcattttaatatataaaaattagtttagaatcgttgaacttctttggttgacatgtaattctttacaacagtgatcgtcttgttttaaacaagagtttagtacagataaaattcttagcaaatgagggcttagtagatgtcttaaatcatctttctcaacaagaagtactctacatttatcttcttcatcaatgaaattttaaccaaagcatactatttttccatcagtcaaatttttttttttttttttgagacggagtctagctcttgtcacccaggctggagtgcagtggtgccatctcggctcactgcaacgtctacccctcggttcaagtgattctcctgcctcagcctcccaaataactaggattacaggcacctgccaccatggctggctaattttttatttttagtagagacggggtttcaccatgttggccagacgggatttcaccatgttggtcaggctggtctcaaactcctgacctcaggtgatccacctgcctcgacctcccaaagtgctgggactacaggcatgagctaccgcaccctgcaagatacacatttttagtaggacttgaggaacatttctgtcttggagtacatacgttctgcataattcatattagaatatgaaatctgaggttgtcttcagtatagtcatttatgaaaaagaatattgagaattatctgtttagagaaagtagttctgaattaaaagttgcagtcattcagtcatataacaccttcatagagtcatgtatattttttaatgtacttatcttatttctcattattctctcttagttgctgatgtatattcaagatgagtggattaggagaaaacttggatccactggccagtgattcacgaaaacgcaaattgccatgtgatactccaggacaagggtaggtgacttatttcctggtgctttaccacacttgttgtgcctttgtttaaggataacattttaacttcttgccatttacattctctggttagattttttggtggtttcacttcgtggtaagtagagtgttactgatgagatggacatctttttgatgtaatagaagttttttttttattgctgattcatatagaaggtagaatattaacaattcgcggtactataagaatttctgaatggaaggaggggtaggagttacgaatagatgaccaaggttatgtcacgtgcgtccgtgtgaagagaccaccagactttgtgtgagcaacaaggctgtttatttcacctgggtacaggcaggctgagtccaaaaagagagtcagcaaagggtggtgggattatcattagttcttataggttttgggataggcagtgagttaggagcaatgttttgcgggcggggttagatctcacaaagtacattctcaagggtagggagaattacaaagaaccttcttaagggtgggggagattacaaagtacattgatcaagttagggtggggcagaaacatcacaatggtggaatgtcatcagttaaggctattttcacttcttttgtggatcttcagttgcttcagaccatctggatgtatatgtgcaggcttggtctcagaggcctgacagttataagtaagaatctttgctatcttttaagaatgggttataagttgatattttgtcatttgtgaggttgcatccttttttttaccaagtgaaatgagaagcttaaaaattagaaacaaaataatgtaatctatataacactactctatagcttttaaagtatttgccaaagtcagtgtcaattgaagtttaatgtgctagttgaaaaatatcaatctacaatgaataaaacttcatcattaataagtagctaccactgtttttgttcttatttgttagttgttttattatctctaagaagtaaagatgatttattcgtattttctagatgaagtaactgaggctaactctgcccaaggccacctagctaacaaagatggaactgaatttaggtttacatgaatctctattatgttgtactacttctccaagacagcatttttgatagtttatattggctgagtttagtttgtttacatatgaaaataataggccgggtgtggtggctcatgcctgtaatcccagcactctgggaggccagggtgggtggattacctgaggtcaggagttcaagaccagcctgaccaacatggtgaaacatcgtctcaactaaaaatgcaaaaataagccaggcgtggtggcgcatgcctgtaatcccagctactggggaggctgagtcaggagaattgcctgaatcctggaggtggaggttgcattgagccaaagtcgcaccgttgtactccagcctgggcaacaagagcgaaaactctgtctcgaggaaaaaaaaaaaaaagtaatcatgtaatagtgttgtataggggctgattctgctaacagctcttttgtgatatatatattatgtctcctttcccccctttctacgccttttcccttagtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggtaataaaaacactcatgtctttttgaacagtggtggttcccaacctttttggcaccagggactggttttgtggaagccagtttttccatggacctggtagaggggatggtttcaggatgattcaagcacattacgtttgtggtgcactttatttctattatggttacattgtaacatataatgaaataattatacaactcaccataatatagaaatcagtaggagccctgagcttgttttcctgcagctagatggatccatctgggggtaatgggagaaactgtgacagatcattaggcattagagaatcataaggagcacacaacctagattcctcgcatgtggagttcacattaagatttgcacacctgtgagaatctaatgctacttctgagctgacaggatgtagaactcaggtggtaatgtgagtgatggggaggggctgttgttaatacagatgaaactttgctcacttgcccactgctgacctcctgctgtgcagccccattcctaacaggccacagactgatacttgtctgtggtctgggggttggggacccctgttttagaaggaacttgttgctatatttgcctttttgctcctttgtttgggtagagactacaactgatggaggctagcaagtatgggaatagacaaatgtgttgaccagctgtgctttttgttatttatgtatttatttattttgagatggtgtctcgctttgtctctcgggctggagtgcagtggtgtgatctcagctcaccacaacctccacctcttgggttcaagagattctcctgcctcagcctcccgagtagctaggattacaggcacctgccaccacgcccagctaagttttgtatttttagtagagatggggttttgccatgttggccaggctggtctcaaactcctgacctcaggtgatccacccgcctcagcctcccagagtgctgggattacaggtgtgagccaccgcgctgggcctccagcttatgctctttagagacggttaacagacaattgcctgttatttggtagttccttttcaggaagctgtgggatagtacatttagtagtgaaatgatttaggtatcttctggcttcctgggcaactatgaagtttagttttgatgttataatattgtagcatcattctcttatgaggaaatgttttgtatgtatgtatgggcatgtgcatgtgtatctttatgtctcttctggggactattcgaaggtgatttaatctataactgatagtgtgttattcgttataccaccttctgtcttttcaggaaaaactatttccaatgatgatgatgttcaaaaagccgatgtatcttctacagggcagggagttattgataaagactccttaggaccgcttttacttcaggcaagtataaagattttaactgtccagtaggctgtattgccctttggtttattataaagttataaaaaatcgatgaaattttggttaggaaatgagaacaaaaagaaaacatttttttctttgagacagttcagtattctgaatatgatggtaaaatgctcttataattacaatatacataattcaggaagccttgcccccctagtaaaaatatagttgcaaactgaggaaccacacatatacaaacataaaaatataagcaagcaggaaaggaaaggtagcctgtaatttcacagagatatttgggtacaaatggcccttcatatccatgggttttgcaccacagatttggaggctgaggaagaaataaaaaataatgttaaaacaataaaaaacacctcagtgtgatgactatatagcacttacattgtattaggtattataactaatctagagatgatttaaagtatattggaatatatgcataggctataggcaaatacaccattttatattggagacttgagcatcctcagattttgctatctttgggaggtcttggaaccaaccttacacagatactggggtatgatgactgtacgtttcggctcagacatttttggtgaatttttgcgtgattgatcacatggcacgctatggttttatattcttgaggaattgttaagacttaaacatgtgctttgtatttgtttaggggctgaagcccttcataaagttaacttgtcaacttctttttgtttcaggtagtttgttccaactacttttagttgatcagttttgaaattcctctttgtaaattctcattaaggaatagtagagcagtttctgtagcttgacttggcatcaaatggaaaaatgggaagagctaaggatgcttttctcatttttaaaagctcctttaaagatataattctttaaaaattaggttagacattaattcagatttcatgctgaacatatttatgtacacactcccccacccccaattattcttctttttttttccccccagtaaggcctgtagtaatggtgctaatgttagtagtaatggtggcttatagttgtttgcagtaattaagtcagcagtagtttttacacattctacttactactgtggttgctgtttgctgatactaccataacaaaataccacagacttggtaggtgaaaccaaataaatttatttcttacagtgttggtggctggaagtccaggatcaaggtgtcagcaggattggcttctccttggcttgtcactgtgttctcccatggcctttttctctgcgtgcacattcctggtgtctttctctccccttataggataccagtcatattggattagggtccccaccgttatgacctcatttatctttaattacctccttgaaggtcttgtttccaaatacagttacactgatggttagagtttcaatttaagaattagagggaggaggatacaattcagtccataacagcctgtattaacatatcctattttaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacaggtaggcttttaatgtgtattttctaaataggttaaatttttttccttgaccatttcttagaaaattgaatgtatcttttaggaagtcaagcgatcaaatgagggtagaaaggcatgtgatttaatagcagaattttcacatatggagtcagtgaattaaaaatttggtatacattttaagaggcatatagttacaaaatatgcagtgagatttctgttaaagttgaaattattcacatgttttgtatattgccagcctgaaatgttagtatagatataactatggaaaacatgcataatgagaaaatgcagcttgaattcttgatgatggtcatagaatgagttaccagctttttaaaatgtcatttcaatttgttttccaaagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaaggtaagagctattatatgtttgtgatgttcatgaaacaaatagtggccatacttggagttttgaaacttgtgttgtaacccttcttactgaattccatgtctttgcttgcctattgaacatatatatccaaaagttaagtataatccttaccagggtgaattttttattgtagatttgcaatcttgtatgatctgtgtggcacgccgcattactacaggagaaagaacatttccatcaaaccctgagagctttattaccagacatgatctttcaggtaaaaactctttttttgtctctctctctctctgtgtatacgtacatttttattttggaaatttttgtaaatgttactatttttaatctgtactatcatagaaatgtatacctactgtaatgagtgctttatgtgtatcttttttcatgttgcttatgcaaccttaaaagaatttcactaaaattcttggcatttgaattgggtatgtttggcattttaaatcccccagataaattaaaaaaaaaatttaggggcacctggttttctctccaaattgcattttgcgtcagaatttagtatttctttaacttcaagcccatttgtcataaagaaacatgttttaaaaaattataagtaatttaatgagaattattgggagtaattcctttttttttttttttttgttgagacggagtcttgctctgttgcccaggctggagtgcaatggtgcgatctcggctcactgcaacctccacttcttgggttcaagtgattttcctgccatggcctcccaaacagtttggactacaggcacgtgccaccatgcccggctaatttttgtatttttagtagagatggggtttcaccatgttgtccaggctggtctcgaactcttgacctcaagtgagtcgcctgcctcagcctcccaaaatgctgggattacagttgtgagccactgtgcttggccgggagtaattcttgacgtcaacctgagtttcaatcttggtctgccattttttaatcatagaaataaaaaattaaagacatcgtggttgataagatgcattaatgaaattaaacactgtggcaatattatttttatttaccttcagggttactcttatggtcacctaagtgtaaatggggatgccaagggtttgtcatatatgccccatctcagagataaagaaacagaagcttggtgacagagattgggttattgtccaagatcatggctaataagaaaatttatagctgagtctgcctgacttagcctgtattctttgctttgtgtaacactaattttacaatgtggacttttaacaagtgatataaaaatggagtaggtatacataaaacatagctatcactattacatatgtatgtgtgtgtttgtaatatgtatatataatatacataatgcagaatatttttaaagaaatattgctatttttgcagtcattcaatcattttatgccatcagtaacctatcttcaggatttttgagattaattttcacaattaaaagtagcaaaggattattttgacaattcacagtataatcttgtttacgctgatggatgttacttttttttttttttgagacggagttttgctctgtcgtgcccaggctggagtgcaatggcatgatctcagctcactgcaacctctgcctcctgggttcaagtgattctcctgcctcagcctcccgagtagctgaaattacaggcgcccatcaccacgcctggctaattttttacatttttagtagagacagggtttcacaatgttggtcaggctggtctcaaagtcctgacctcaggtaatccgcctgcctcggcctcccaaagtgttgggattacaggcatgagccaccatgcccggctgtatgttactttatatttgaacattttctctgtattaactcccctcagataaacatagtgacagcaattgttatatattattttatccttttagagtgagtctttctctgcacctcttatgatttggcagtgttaattttctacttgaatagccatgttttacatttgctactgaagatactaaataaaatatctttaagcagtttagcaagtagcatctttgaaaattatctcatcagtatataaaagtgatacatgtttattataaaagttagaaattaccaagcatgaaagaaaacaggacatgatggagaaaaaaattgccaagcaagaaagatcaaatgctttgtgtgattaacatcatttaaaactgagatcctacttacttttgacctctggggatattttatcttctgtccctgatgtgtttcatttaataaactttttatggacatctgttttgtatttgtcatgtggcccagggctaaactcaggagaggtggttgaggacaaatcatgtctattttgggcacgagtgcacaggtatttactctttcccagaatgcgtttatcccttttccctagtctccccctgctactaataagatttttggtcaccattaaaattctgaattttaaacagattattggactggtggtttatttctgtcagcttattcaatattagtgccttttaaatctccagtagcttttgcagaattacctttcactatgaagccccatgagttttcccaaaccaaacttggttttcttcagtatgttttctaatgaatatgtcatagaaaggataaatatatgggcaagactttttttttttttttttttttttgagacggagtctcgctctgttgcccaggctggagtgcagtggcgagatctcggctcactgcaacctctgcctcccgggttcaaaccattctcctgcctcagcctcccgagttgctgggactacaggtatgtgccaccacactcagctaattttttgtatttttagtagagatggggtttcaccatgttagccaggatggtctcgaactcctgacctcatgatccacccacctcggcctcccaaagtgttgggattacaggcacgagccaccgcgcctggcctgggcaagccttttcaatgtctttcctaatttgtctggagtcagtttattgcccacttctttcaagttatttgtctgtaccttttgggtcacaacttccatcatcattgggatttggcatatctgttggtgctgagcataagagattgcccaagtctgattattgcatttcttagtaaaacctatacaaaacagataactattggcaatcttgacatcagcaggagcttcctatgaagtctgccatgtttaaccatggagcatattttgtcacagaaaagattactgaggatgtccaggtcaaaaactgtgtgaccagttattatggcttggatcattctgtctgcattcaaagacatagaaaaggcctgaaagctgatccaagaccagccatggaagctggtcacatagtttttgacctggatgtcctcagtaattagtctgaattttctaagggcagtttcatcattatgcagatcagcaaggttcatttcaaaaacacagttcttgaggccatcagatgcagttttggttccttgagcccttttgactagtttgttaccaattaaacacagctggtgctttcacatcatatcagtcttttttaggaaatggattaaccactttcttctttgctcccattctgccactttttgtaaggcacttgcttttgccaaccaccctagtgctgcttagagtgaaaaggcctagacagtttttaaggaccatctattgtcatgaaaccttctttaatttcatagtatttttgagtatgtatatttggtgtctccattgtatttgatattaagcaaaagttgtcagaagcttccagcattgtagaaatgagtatttggttaaccctccaagtttaggtattaagtgtacaaaaatgtgatcatctctcagatgcaaataattgtccctgctggcttactttaagtaggtattttctcttgcttatagttgtagggacagaatctcttcggacaaacaactttcctcataggcgttattttttccctttacacgaaaatgaacttaaggttatctggacatgtatattcagtacattcagacagtaaaaggagtttgtgtgatatatattctgtacagcatttgggaaaacactgtttttctacactgccacaccacttctgaccccagatgtatttttttctacactaaccagcgctctgtctgacataagctgggtgccctacaattttagtttggacagtttctacctgggtttagcattagatcttacaaggttaagggttcagtcccacaagactgcctgtactttacttcagatgccagttgcaagtcctggccttctgtacttctgactgactggctataaattgggcttctgatcctctccttaggtttgatgatttgctagaatggctcaagaaatccggaaatgctttactcaggtttactggtttcttatgaagggtacaactcaggaatatctcaatgggagaaatgtataggagaaggtattagggggtggggatgaggtttggaggttccatgccctctctgggcttatagccttcccagcaccttaatgtactcatcctttggaagctcatcaaatctcttgttcaagaggttttttttttttttttttaattggagatggagtcttgctctgttgcctaggctggagtgcagtggcacgatctcagctcactgtaacctctgcctcccgggttcaagcaattctcctgcctcagcctcccaagtagctgggattacaggtacgcaccaccacgcccagctaagttttgtattcttaatagagatggggtttcaccatgttgaccaggctggtctcgaactcttgaccttgtgatctgcttgccttggcctcccaaagtgctgggattacagatgtgagccactgttgctggcccgagttttttttttttgagatggagtctcattctattgccaggccggagtgcggtggcatgatctcggctcactgcaacctccgcctgccaggttccagcgattctcctgcctcaccctcccgagtagctgggactacaggcgcacactcccatgcccagctaatttttgtatttttactagagatggggtttcaccatgttggccaggatggtcttgatatcttgacctcgtgatctgcctgccttggcctcccaaagtgttgggattacaggcgtgaggcaccgtgctaggccaagagttttttatagaatttaatcaccaggctctccttcctccctcatgccccattcctggaggttagtagatggaactactaacagaaagttccaatcctttaattacttggtctttctgattatcagctccatcctgaggtgatctagagaccccaccctaagtctcctcatcagcataaattgaggtgtgttccaaaggggctctttatgaataacttgaaaatacttttattactcaggaaattctgaggattttggataggggctctgtgctagaaatctgacaaagaccaaatgtattattatactccttagcagaacatgtagggagaatcctgtggtgctatgtcttaaggagaaaagctgtggatatagtagaaatttggatcagagaaggtggagcaaagatttaatatcttttattttattctccagtgctaagccatgtgtaggcagccagtaaatacttgtgggctggatataagtctttttttcctttttttgtttaataggaaaggttgtcaatatagatacaaattcactgagatcctccatgaggcctggctttgaagatataatccgaaggtgtattcagagattttttagtctaaatgatgggcagtcatggtcccagaaacgtcactatcaagaaggtaaagaattttggggttgattgttcttatcattttattctttagagacagggccttgctatcttgcccaggctggactcgaactcctggatttaattgacccttctgcctcagcttctgagtagccaagactgcaggtgcacaccaccatacctggttttgtggttgattcttgatcttgtttgtcattatgtttggtatacacatgactgtagttgctctcttgttggtgaggggtaggaaaatgatgcctgagtgttcttattttaccctgttgatgattttggtgcagatccagtctttccttggatttttagaaatgtacttgaagtatatttcctccctgtcccctcctatatatatttgttttgctgactgtagttaccagtgatgggatattttccccaacagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagaggtaatgatagattactgtgtattctaatacaaaatgcagcagtgttctcaaaatgctttattattaaagtaaaaagggaagggataaaatgagacaaaatttaggaaggttattgggtttgatgaaatgagtttagattcctggattatgatatgtttaaggttgtatttttatgtgaaagtgattatttattaaatactttacaggaaagctaggtgatgggaaggctaatgggtggataaaagagcacataaaatctgattacatgtcttaccactcatttctgataatgtgtgttgctttggggactgcatttaaaatttgagggtaaacttcaagaataaaggtagttactgtctgggttggtagtggcaaataagaaatgcatgaaggggaggatattcacccattaattatcttgagtaatttgcaggtacccccaggtgaagccctagataatgtggcaactctaataaagcccacctgaaactccagttaacatagctgttggtctttcataatactacagtggtctcactcatagattctgtggcttactgaaaaatatgttactaggtaaataattgatcaatatgtagattggaactgtcactaggtattggaatgctgcctaaaaagttaagttcctgggtagttaattcatcccatttttttattccctctccttctctctcccttcttcctttcttcttcttctcttcttcttttttttttttttttttttaaacagagacagagtcttgatctgtcacccaggctggtgtgcagtagtgccatcacagctcactgcaacctcgaactcctgggctcaggcgatcctcccaccgcagcctcctgaatagctaggactagagatgtgtgtcactatgcctggccaatttttaaattttttgtagagacatgatcttgctgtgttgcccaggttggtttcaaactcctgagctcaagtgatcctcctgcctcagcttcccaaagtgctgggaatataggtgttagccactgtagctggctggttttttaaaattttattttattttaaatctgattaaaagctttcatgcatgcttagaattttttagtaaaagtttgatgtttgttttgcagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtatttgtgttgacatttccttttattttttttctttttaagtaattattctttccatactactataattcttgtaaagttaatctattttataatagaaactttgaagaattaagttgtattttgttacagtgtctggtagtctaattcttttcctaaattttttttcaaattcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagaggtaatttgttttctgtatatttcagctcatatttcatcatttttcggtgttagataatgtgatataaaaattcttccattttaggtttatttaaagaaagttaaatctttagctctcatttctttataattattttggatgtcagtaaaattatgatgtaatttagaaataacagatgtgtatgttttaagatgtgactataactctttagtagccaatatgaaattttttcatggaggtgtttattgctggaatgggcagattgggtcattaagagaatggtagaagtaatcaggaaaaaaaaaacttgtattaagcagcataatttttattttaaggtaaaatcaagtttcatgcacaagatgacattctgtataagcatttcccaaacttataggatatattaatatgcacttgagaaaatgaaaggcttaaagttaggatgtgggcttaacctactgttcaccaaatttattgaccgaagccctttttagagcatgcctatgaacatcccagcttgctccttttattattaatcacacttattttcagaaggtttgtgtagatgcagatatctgttagctaattatcaatgcactgctagtgactgttacctgcaaaatattctacagtttgagaattaaatgtcttgtgtaaatttaaaaaatgcccctttgaaaggaccaaatgtagtgatttaatctcagaggaggaagattagagatgggggtcataataaactggcctttcaggtgggtattatcattgtaggtagtttttgtattttacttgcttctatttcatgtatcattttttctgatgggtatgtttatacctgtgtgtctggtaatgtatacaggttaatttttaaaactttattttcagggatctggagacttggataatctagatgctattcttggtgatctgactagttctgacttttacaataattccatatcctcaaatggtagtcatctggggactaagcaacaggtgtttcaaggaactaattctctgggtaagaatgaactaggttttttttttttttgctgcctttgaaacttttctgcatacctgtaaacactcttacactaagaccaggatataaatagcatttataacttcagaacatatattctgcctctgttttctatactaatttatatgtgctttagaaagctttttgaacattttcctgttttttaaaaattaaataaatttcccacttctaactaatatgccagtaatcatggcacttatagaaaaatattcatgtttgattattccaggtgagtactgtaggtactagggcatatatttttcttagccacagagaactggattaaaaagcaactcagactctagattaaaacctgtccattggtgttttaacagaatcttgtcatttaattaagatagttttctttggtgtttgctggttcttatctagcccctctcctgttgctgtgtgttgacttcatcaatttaacaaaggtaggccgggcatggtggctcacacctgtggtcccagctactcgggaggctaaggcatgagaatcgcttgaacctgggaggcgaaggttgcagtgagccaagattgcgccactgcactccagcctgggtgacagagtgagactccgtctcaaacaaacagacagaaaaacaaagatatattgtgtgtgtcaattgaaaaggcagcatgcacaattattcagaatggtcattattcagtagcattatttcctaaactagaatggatagatcaattaagagtgggggggaaaaaaagaaggttagaaggggattttacattttatttcttttcgatcagaaggcaacttatctggttaagttgattgttaaaattataaacagtatacttaagtacaaatatgcaagaaccttcaggagcttggaacatttgtgaatttttcaatattaagtgaagcgcagagtatcagtgaccatatcaggctacagaaaagttctcagtacttcagccgacatggagattgttgtttctactttatttggaatatgagacccttttttggctggcaggggggcggggggtggcggtggtgggtgagggccacttccctcacttattttgtaaaggaagacagtgtttgtttttgtaagaaagacattcttgggtggggagtggtggtatttgtgttttgtacttgattatttatatattaaatcacgaagaaatgtttttgtattgtgttttcaacaggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtatgttatttctaattagtatgtatgattattttgggaaaagcatatttaaaatacttaaagccatctaaataattgggagtaaataataactttttgaataacgttagtatgtttcttccatgaatatccttcatttattctatgttttggttatgtaaactcttcaagagtcttttggtctatgacattttccagcctgttgaatatatgagaatagtggcctatgtctccacagttggccagcccttttcttaccatgacaaagtgctgttttgtcaaggttgatgttgtgtataatggctgtacttacatggtataagaaggatttcattataatatggaaaagacctaagtatggctacctgttttaggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgagtaagtgtccaccctcccctcttcatgaaaaaagaaagttagatgtttcaggataatttttgctcttatttgagaatttgtgctttctttttgctcccccagggcctggtgaaatccccatgggaatgggggctaatccctatggccaagcagcagcatctaaccaactgggttcctggcccgatggcatgttgtccatggaacaagtttctcatggcactcaaaataggtggggtgttattttgtgactctgtagaaaatctcagcattgggtagtttagaaaagagttggagcacagaagcaaacgtgaaagagaatgagaattccctataattgaggtactgggttgccagctgggcatttctcgtgtaactctgtgtaaaaatgaggctgaagcagtaagcagtgcgtgtggcattcacaggagagggaggagatacaaccatgttgtccagccattagggccattcagtggccaaacctctgagagcctctctgtgagatgattgtctctctagtcccatgaggaggggaaaaaagataagtacatgtttctagtggttttataaatgttcttcagagggttagcctcagttttccagaaaattaaacttttttaaaaaaacttttcttttcccccaaccacctgctgcctattgagaaaattcttttaaggattggctaattgttttctaaaattattttaaacatttcagtgatgatagtgaaataactatatagcatctttaaaatttttcataaaataaagattgtaggcccggtgtggtggctcacgcctgtaatcccagcactttgggaggccgaggcgggcagatcacaaggtcaggagatcgagactatcctggctaacaaggtgaaacccctgtctctactaaaaaaaaaaaaaaaaaaaaattagccgggtgtggtggtgtgtgcctgtagtcccagctactcaggaggctgaggaaggagaatggcgtgaacccgggtggcggagcttgcagtgagctgagattatgccactgcaccccagcctgggcaacagagtgagactccgtctctaaaaaaaaaaaaaattgtagattgtatttaatttttatttagcttagtaatttacttgcatgcaagaggccatggtcaatgtcagctctaacaggaattctacagtaagttaagcaaggaaaataaaaatgaactgatctattgagcagacagtgatgtaactatatgaatttatttgagtgcttctctactctatatgaatttatttgaatgcttctctactcaatagagagcaaatagtttcaagttaacagaacttttctgaggcaggataaatgtttaacttcatgcccttgtatgtgttggagaactgaggcaacttgctgtgggtgtatggggtttgtgttacacttgccaatatgagctctgtgggccaagtgtgacaaagtcattttggtatttctccagactcacgtcagtgatagctcaacatttctttttttttttttttttttttgagacggaatctggctctgtcgcccaggctggagtgcagtggtgcaatctcggctcaaggatctcctgggctcaagcaatctgcccacctctacctcccaaagttctgggattacaggtgtcagccaccacgcctggctcccttcttttttttttttttttttttttttttttgagacaaagtcttgctctctctcccagcctggagtgcagtggcgcaatctcggatcactgcaagctccgcctcctgggttcatgccattcccgcctcagcctcccgactagctgggactacaggcgctcaccaccacgcctggctgattttttgtatttttagtagagacggggtttcaccattcacaggatggtctcgatctcctgacctcgtgatccgcccgcctcggcctcccaaagtgctgggattacaggcttgagccactgcgcctggccatagctcaacatttgtatccttccttttattcttttgatttctctaattttcaagtattataattattacctccttcactgttttcgtgaggagtatcttctcccatccttccctaccctccccctggcccccatttctgctataccccaaatgcctagggtttggcaattacaatttggtgttgggattgggggtttaagctgtatatggtggtctaaagtggcctggtgaaatttctaaattgtgggccttaaacttaaattgatgccattcactcttttttaccacttggtttattatttgtgtttgtagcatttgagttactgttcattaaaaatactatgcatggttgctgtgatctattactcttagaaaaaaaaaaagcaccattgacattgattgcaagtctttttctaggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcaggtaggttgcattaacatggaagtaggagagtgtatatttgtgtgtgtgcgcgcgtacacattcatgaagccacatacaagaatgcctgtgtgtgtctctcctagtacttgtgttatatcactacattcatggataccagcattaaatttggaaaatatccttttttggtctcaattcgtatgttaaaatagaaaatatacttacgattgcgatattactttcaacaacccactatttttggcaattgtagaaatgatttagttaagctactgtactgttcttaaaaatgtgaccttttattcatgttaacagttctcatttttataactatctttctctactacttagccaagccgtgtgtattctgaggcaagctttttttttgcttgtttgtttaaacaaaacttgtttacaatggccaagctgaacatcctaacatcatggtgtcctgttcctgtttacataccccgccttatgaaaacatgccattcacaaatctgtatttctgaaagacacattctgtagtgactgttttttcttttttgaatcggagtctcgctctgtcaaccaggctggagtgcagtggcacaatttcatctcactgcaacctccacctccagggttcaagtgattctcctgccttagcctcgcgagtagctgtgattacaggcacccgccaccacgcccgggtaatttcttttgtatttttagtagagatgagattttgccatgttggccaggctggtctcaaacttctgacctcaagtgatccactcgccttggcctcccaaagtgctgggattacaggcgtgagccaccgtgcccagccatgactgtttttatttaaaggctatggaggggccactgtataggtttgtgcgttcaacagtaagcaggaaagatcatcaggggctgtcagttgttgttggggaaatagatgtgtacatatggaagtacactgccatgtggcaaatgctgtcacagtgcagatgggaaacgctgagcagtccttgtgtacaccttcagggataccagtgacatagaaccttggcactgaggagccatattttatactccaacagaagtatagaagttcttttttatttctttacttgttcaggcacactaaataacccatcaattccttccttccctcctgtagttctctctgttttactgtgtccttgtgaggcaagtctagaaattaataattgtcactattcccctgtgttggactcctagtatcctgaatctcaaatcgctttctgtcttgatttactcctttgttttgctgcaacacaacttctattaacttcttcatccctactgcatgaaataaaatgttttgggttctatgtgtctgaaaatatctttattccaccctcctacatgtctggctatgtattacattctaggtttaaaataattatatacttttgaaagatttctgccatagttttctggcatctagtgtggccactgagttgtatttctttctgattttgattcatttgcatgtgacccgtttattctctttggaatgatttaggaactttttctctccgaaattttatgatgctgtatcttggtatgggtcttttttcattcattctgctgtgtactagatacactgatattccctttggtttaggggtgttttcttgtataatttctttattaaccttatctctcctgtgtttttttttctgacctacttttctgggatttctgttgacatgttgggcattaaattcgttctatttttttttttttgagacggagtctcgctctgtcgcccaggctggagtgcagtggcgtgatcttggctcactgcaagctccacctcctgggttcaagccattctcctgcctcagcctcccgagtagctgggactacaggtgcccgccaccacacctggctaattttttgtatttttagtagagacggggtttcaccgtgttagcgaggatggtctcgatcccctgacctcgtgatccacccacctcagcctcccaaagtgggattacaggctgggattacaggcgtgagccaccgcgcctggcccttcattctatattttgaagtcttctctatttttcttgtctttgatttgcttgagtcacgttcaagcttggaaagtgttggacgcttttatcaagtatctggtgatccctgactgttcttatatgttaagagtgagacattaagaagctgatttgacactttgcaagtgtgagcagcatcagttgtctttactgagggtaattaagtggggaactagccctagcccttttatttcaggactccccaaatttttatttatttatttttgagacggagtctctccctatcgcccaggctggagtgcagaagcgtgatctcggctcactgcaacctccacctcctgtgttcaagcgattctcctgcctcaacctcctgagtagctgggactacaggcgcacgccaccacgcccggcttttttttgtatttttagtaaagacggggtttcaccatattggccaggctggtctcgaactcctgacctcgtgatccacctgcctcggcctcccaaagtgctgagattacaggtgtgagccaccgcgcctggccaggactccccaaatttccacatgtagagttgttttcaaccaccactaccactcctgccatctggtaatcttttattacctggttgcattttgggagctgggctagggaggcaagtgtgggatattaaattataaaatataaaattttatttaaattataaatatgctaaatataaaatttcctgttttcagcctctgcctcactcctttcttaggctctgcttggtgcccctgaacccctgtacctttgtcgggtaggtagaaggtacaggcctttcgggagtcagggagcaggcagggaggtagttgacctcctgctctatactcagactcctaaccaacctcctcatgtcagcaccatgctctgatcccctaccaccctcactggagtctcaatagatctgtggaatacatttgcttgtttttcatatgtatttttcctctgtgggcacataagtctaagtttttctgttctgttgagctggttcctacttctctattcactttgtatcttctattataaatatggaaatacttgatcttgttgcgttattagtgttttatggataaatactaccttttaagtattttttttttaaataaactggatacctcttagttccctttattgtcattttagtagggttagcaagtgaatgcaggtaagcatgcatgatcagtctgccatgtttaacttaaagtatagtttgctttattaagacatcttcagccaggcatgatggtgtgtgcctgtagtcccagctactggggaggctgaggtgggaggatcacatgaacccaagttgatgggacaaaatagaaacatagttgccagttactatggtaacagtccaagaggtgtcctgggaagggtcataagggtgaaatggaaagaagggagggatacatgatatgccctggaggaaaaattgacaggacttggtggtcacacgtgtttactcttggaaagggagaatgtgaagaatcaaattgctgggttttggttcctgggcagtgaatggtgatgctgtgtaccgtcaccatttgacatctgtgaggggttggtttcaggacccctgtggataccaaaatccatggatgctcaagtcccttatataaaacagtctagtatttgcatatagcctatgcacatcctcccacatagtttaaatcagctctacattacttataatacctaatacaatgtaaatgttatgtatattatatagttgttacactgtattgtttagggaattattataagaagaatgatgactgtgtgtattcagtcaggtacagctaccgtttccttcccctggaatgttttcagtcccctgttggttgaatccatgagtgtggaaccatggatatggagggccaactgtattgtgatatagtagggtaggttggaggagaacaagcctgcttggggggaagggctgttgggaatcatggtgtctgttttctgcctgttaagtttgagatacctgagacatcagggtgcggatgttaagtaggcatttccataaacaaaaccaaaagttcagagatgttttggctggagacaaaaatgtgatcattatcaccagcggatgagagcacctaagtagaaaatatatcaagagaaaataagagagcctaggactgaaccctgatgaacagttagcattcattcaaggaaaggccagagagatgggagaaaaatgagaagtgttgcgaagtacagtggggtgaagtatgcttcaagagagacatgtcaagcatgctggctgcatgcttggcattcagtgcctgtggatgagaaaataaaggtgaatgcacagtacacctggttcttgtcttagcacagcaggttgttctcttcttcagaatatcaacttttacttctttttctgtcacctgtgggatgttattttgaatgtatccttagcatgtagagaagtgatgcctggcacataacaagcatttacttaaatacttgttgaatgactggatgttttttgcactttctttagagcatttgacttctgttgctttcatagatgttcttcactgttcttttatgtgttgtgtttaagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcaggtaaccagtcatgtgttcttccctctggcttctccttctgttgttttcagactatgtttctcagtgttcttaccactggtgcaatctatccctgtcaactaaagaaattctttttgttttacttctgtgtaaggttttatttgtacaaatggctccttgttaaggagtagttttatgagaatattctattttacaggtaaaaagtaaaaaaatgtcaggaaggattgctcttggggaagaaaaatgttacttgatgactttgtagtcttaaaggtagataaggttttttttgaaaaaaatccttactgctaataaccaaatacttaaaccttcttgatttcagcatttttaatggaactcttctttctagatgttttataaaactagagttgtcttttaatattctaaaatatgacttctgtttaccctattgttttcttagtccccaagaaatgttttaaaattcaattgtttttattgtttatgtcttcaaaccatataagtagatgaatgcctgaggttttttttttgtttgtttgtttgttttgtttttttttttttttttgaggtggagtcttgctctgtcgcccaggctggagtgcagtggcatgatcttggcttactgcaacctccaccttctgggttcaggtgattctcatgcctcagcctcccgagtagctggggagccacgcaagcccggctagtttttgtatttttagtagagacagggtttcaccatgttggccaggcccgtcttgaactcctgacctcaggtgatcctcctgccttgaccttccaaagtgctgggattacaggtgtgagccaccgtgtgcggccaaatgcctgagtttggaatccaaagagccagagactccattgcataaatattgttaaaagtcagtttaggtactcagaaaagctgtgttactgtattcattttactttctgccgtttcttcactaaaagtcatttagggaaagctaatggagtttattcagaattcctctgatcaacttaaaggtatttccccatgtgcccgaataatcccagagaaagcctgactataaatcttttgagtttctattgtgtgtgtgtatatatatataaaatttatttatttattattattttttctgatacagggtttcaggatggaatgcagtggtgcagtcacagcccactgcagcctcgacctcccaggctcaggtgatcattccacctcagcctcccaggtagctgggactacaggagtgtgccaccactcttggctaattttttgtagagatggggtttcttcatgttgcccagactgatctcagactcttgggctcaagtgatctgcccacctcagcctctcaaagtgctgggattacaggtgtgaagatattctttaagctgcaaaattgcactttacttttttttccccagtgccaaacagtagcccatcatatgctagccaaagacttttcaacattgacctttttgcagtgtgaaagtactggttcagtttagacgtgacttagccaggttattgtgtttggagatattacctcattggctggtgctgagggtctggaaagctgttttggcagactgacgtgctctgcttgcattctaaccaacttgtctcacctcagtttttgaatcagagccgacaggcacttgaattgaaaatggaaaaccctactgctggtggtgctgcggtgatgaggcctatgatgcagccccaggtgagctcccaggtgaggatgataagcctctccacatgcattgctctgtgctcaggacagggcttggcctgtggttggctctcagtaaatgtttgttaaacaaatgaaggtaattctgaatttcttgtgtaagaaagcagtcgcattaaagactttcgactcttccattcttctctctggctggtgactgggaggaatcagaggagggagagctttcttcattaaaaccatcgattagtgtttttttaattggttccctttgtgatcagttgctgtactgtgagaacagctatcacttggctgtttaggaatttaataaatctgtaaatgttcctctgttcctggattatgaaacaacatgcacactgggtaaaattctgaaattataaagaagaaaataaagaatacataatcctgttctcagtgatagcctctgagatgacctgtttcttgtagtaggaggggatattaaaattcccttctacttccagccagtggtggagacagtattgaggggtttttttaatgtgcatgaggcagatgaccacacagcaatcctctactgtgatttgaaatatcgtttataattgttttttaaaaagcaactgtgaaatgctcgatttttattgtcttatgcctacttggaagtactgatatttacattttcttgataataaaacatcttgtggaagctgagctagaatgtcctacagaaagatgataaaagcttgctttttggagatgacccgtagctagtagagctgaaatcagcttccttgttgtacttcagttatgtcaccttctgaacctccagatagcttctgcttgccccttacctctttctgaaagtttaaagaaagttcaagattttctgaggtggacccctgcttatctgagtataaccccatcttattttttttggcttcatgtttcagccctccaccaccccaacacactgaatcctcattttcctgtaattgtctttcatagttcctgaaaaatttgtcctcagattccacccctaaatgttttcttactttgtggaatgtttctagtcatgttaaagcttgacagtgtgttgtcttttgtcttttaaccccaaataattttcaggtccctcttcttcagttctccctccctccccttgcaatagccagaaagctttttttttttttttttgagagtcactgttgcccaggctggagtacagtggcacgatctcggctcactgcagcgtcaattccctgggtttaagggattttcctgcctcagcctcctgagtagctgggattacaggtgctcatcaccaaggctggctagttttggtatttttagtagagacagggtttcaccattttggccaggctggtctcgaactcctgacctcaagtgatccgcccaccttggcctcccaaagtgctgggattacaggcgtaagccactgcaccaggtcataaagcttttatgtgaagaattgtatgttttggccggcacagtggctcacacctgtaatttaagcacttcgggaggccgaggtgggcggatcacctgaggttaggagtttgagaccagcctggctaacatggtgaagcactatctctactaaaaatacaaaaattagccagagtggtggtgcacgcctgtaatcccagctacttgggaggctgaggcagaagactcacttgaacccgggagacgaaggttgctgtgaggcgagattgtgccactgcgctccagcctgggcgacagagtgagaccctgttaaaaaaaaaaaggccctgggtgttttctgtcttatacctggtgtattgtgggggtactatatgtatgcaactggcaggttcttgctatatatatgtaattgcactctttcttgggtattagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggtaaatctgacaatgaaaatgtgccttccccaagttaacattactaaggacataagcttcattacatttattgcacatgaaagacaaaaacacgattcactccctctttacttcacaaggaaaaccaaattaatttaaatgattggaaaacaaaaatgctgcagcacacaggtaattgagacaggtgtatcctgtcatagttgaatatttttttcagtcccactcattaagagtccccaaactctggaagaaacactgcaaagttgtccccttgccccttcttgtatgttccagtatagtagaactctctaatctctgaatgcttggtcaagtcagtgagaggaatgcactttgtgggcttttaagttgattttcttggtgacttggatttattattttttttttgagatgggggtcttgctctgtcacccaggttggagtgcagtggtgcgatcttggctcactgcaacctctgcctcccgggttcaagtgattctcctgcctcagccctgagtagctgggactacaggtgcattccaccacccccggctgtttttttttttaaatttttaatagagacggggtttcactgtgttagccaggatggtctcgatctcctgacctcgtgatctgcctgcatcggcctcccaaagtgctgggattacaggcgtgagtcaccgtgcccggccctggatttattattacagtgatgcagatacctcttcatttcagcctttgagaggttccaggaacatggtgggaataaaggtgtctattggggagccctgtcatctgaggattataactcccctgccctttaaagaaggatggagtgatgtgagttgagtgatacggagtcccttttctacaggaaacccattaaagcaactgatctttcagtgatccagatggtgctcctttctgtagtaagcctgttactctagtcgtcatcttggtgagaatctagaatacctgggggggcagcatcttatagcactctgtatcttacacttatcacttccctccacccccacctcctttaaaaaaaaaacaaaattactacagaaatctgatattctaaggagaaggcatttgggcatttttatttcttctgttttatttttgtaaggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacaggtaaagaacagtgacttataaagttagtcacatcctagtcccagaagtccaagaacttaatgtatttttcagtcaagcctttttggatggagaggttgaaaggactgggttcatattagaaggtgtgatttggcttgtccattttgagagtccttcaagcacgcacatatctattagggtgtctagtacagaaagctgtgaaaaatggatcacaggctgtcagggagttttctctaacattcccagcttaagtatagcaatgtttgacacaattgtagtaatttctgtgggcatgccctttgtcgctaaagtgacttccagaggtaatattaccatttgtttacttacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcaggtatgggatcgattccttacctttttcaaaaagtttttcttgttctctggatagaactaaagcctaggctataatcagaatgtcctaggtatattttaacttgaatgtataacttaaaatatagtaattgaaaaaacttggtttgaaggcattgggccattagatacttttggtaagccagagctgcattgtaagatgggatctcaggaacctgaatcactcagccagagctgcactgtaagccatgaatgtggacatgggtatttttttgttgtgcaaagcatgtgttttactcattttttttttttttttttttttcctggttgctgacagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaattggagcctaaagagtttttttttttttttttaaatccctgttgggttaagggtaaaggaggttaaggaagcctatttcaaataatggtaacagtttctgagaagttaaaaaacgccactagggagttgctagggagccttggcctgtttggggcattgaaacaaatgtgggtgcttttagggattatctccgtcatctgttaaatgagaaatgggttggactggtgattgatagttgaaatctgtcaactacttgtatcaggttagactacctgatacacaaagaagggttggccaaggcgaatttctttgcaattgattaatacttttttaaaaaatgaagtaccaaagctggtatactatgagacttacctgtagtcccttgaagtatggtagactttttagtcaatctacaaccatctactccccttttaagaaaatcttctaaacccaaggcattttcttccaaaaagatgttgactggtagtatcttgaatactttaaaaaaacagacacaccaaaaaactcccaagaaatggccttttacaaaatgtcaaaggttcttcataccaactgctggtcattggctggggttttgaacactgtatgacaatacttaaactacaaaattttttttacaaatacagtttcatcaaaacttgggacatacatcaacttcatttcttttcagtaccttaaaaaaaaaacatcagttctgggacataacaaagaaatactaggagaaatggtatctggacaggaacagaaatgtccacaactgcgagggattttcttttacactggccacagagcgtttattgacaccaccactcctgaaaattgggatttcttattaggttcccctaaaagttccc

SEQ ID NO: 16724 - DNA, 138693 bp, Human
aggtgtgagccaccgcgcccggcctattcctttgttttttagagatagggcctctccctgtcgcctaggctggagtgcagtggcatgatcatagctcactgcagagtagaactcctgggcttaagcgatcctcctgccttagcctcccgagtagctgggacttcaggtgcatgccaccatgccctgctaattttttaaatattttttagagatgagggtctcgctgtgttgcccaagctggtctcgaattcctggcctgaagcaatcctcccacctcagcctcctgaatagctgggattccgaaaaaatctccaaaaatcctgaaggattttaagcagaggagtgaatgtgatctaatttacctgatcaggatgaagttgacactgtccctcacctctaattcaggagacagatgagaaaacaggcaaaaatcatgaaagtgtgatgactaatttgataagacgcttaggccacctgaaagtgcagggattttgccaatgttagggccaggcttgactgtaggtctttatcatatgcaattgagccaaaacttattttaaaaaagcgtctacagctgttttcctaactcccctcaaaaaacaatattaaacaatcgtttagcacactaatttcagccctcaaatatttcagtcttcaactttggacctcttatttttttttatcttctgtgacaaagtctcgctcccacctcagcctccccagtagctgggaccacagatgcctgccactaagcccgactaatttttgtattttttgctaagacgaggtctcgctatgttgcccaggctggtcatgaactcctgaactcaaacagtcctcccaccttggcctcctgaaatgctgggattacaggcatgagccaccacagccggcttggacctcccacttttttgggggcagtggaggtaagacaatagcagattttgcttgcaaacaggcaacctcttccgtgatggaagggctattctgagccattttgtttctcctggggcagaattaactggtactaaaaacatccattcacaatcccagcatttcagctgtggccttgttctcgagtggcaacattaaacgagcaaggagcttgtttcagaaaagagcacctcccctccagggtatccacgggcactgaaacatttatttattgcagggtgtgaaatgtgtctaggaagggaacataatgatcttggtgggttagtgataaatggggtgagggtggggggtaggtgaaggaaggtgtaggaggtggaaccagggcctggaggtggccaagttcatgtcatgcttccacactctgtccctgtaacatggtaaccatggcgcctgactgtacctttcccttggagacaccttttggtccggcccatgccacctcccctggctccatcccactctatcccttcattgctctggcctggcctgaggcctctctccatccagttttgatggaggtagctctgcctgccatgtggatccagcctcggaggtaaagcagctgcagaatcaatggggcctttctgcacctgggcggccacttccagaaagcccacccggactttcttttactaacagggtctcggtccatctccagccgtcaccttcccaaagaccctcctggcctcctctccattctgcgggccgagaagaaccccaggagagcagcggggaccgggagcgaggagtgggggtggcaaaccctaccctgcctgccaccttcagtccagtggtggacaatacctggaccccatagctgccaactcgggaagccgcgcccccccccaggtgcccaccgcccccagggtacccgggcattccccgaggcctggctcctgggaggagactcagggaaaaaggagctcctagaacctgggcgccggcccggccccgtcaaggctgtcggggatttaaagggccgggacccacccggacggcggacgcccctccccgtgcccgcgcaggccgcacccacttgggggcggcgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggtaagttggcgggcgggcgtccgaacggccccgggaggtgcgcgcggccctcaggcgcggggaggcctctgcggcgcggcggctccgcggagggatggagctgggggctccgagcgccccgggatcccctaggccccagccagagcccacctggggctgcggggccgatggcgtttgcggccgagctgagaggaagctgtgggaggcgcagcgctcgcgggcgcgggaattggcgctcggcgctcgccgtagctcggcctgggacgcggtcacggagcgcccgggacggcgaccaaaggagggaaccggagggccgtttgtgagctgagaggtcgggtgggacgttgggggcctgtccctccggaggcgccccccggccaacctggcacctccgggcctctacgccggcactggactcgttaggcccggcgcggggagcgaaggtagcggcgaccacagcgccccctctggcccggcggcgccgcctcaggcagggcttggcggggtctgggggcggcggggcagtttgtccccaggagtaggagcaggcccggcgccagcccggcctgggccttcggcgtccggggtggtgaagttgcttttcctcagacacgcagaatgggggcgtttccccccggccagggccccccaggctccgcgggaccccgggaaatggaagagttgacgacttccgtgggaagggggaagtttggacaggactagggaggttcttaggcagggagaggccgtgaccccgagtcttgggtcccctgggatggggatgggcagggagaggccgtgacttccgagtcttgggtaccctgggatggggatgggcaaggagagaccgtaaccccgagtcttgggtcccctcggatggggatggatagggagagaccgtgatcccgagtcctgggtcccctcggatggggatgggcagggagagtccgtgacccccatgccttgggccgatggagatggggaagggggtgtcacctgaaacaggcagttgccaggtcccctagcagggcttgacaaactcccccgccttggtttccttcttggcttttcctacccggagccagagggctggggcttctggtgggcttgttgtgggacacctgtgggcatgctctctgcatggaagaagggtttttggtgtctaggagagagtggccggaaggagctctctagtgtcacctgtgtcagctgcaaagcagtgtatccggtaggcctgcaaaggaggtcctggtgtgtctgttgaaagaaaacgaagccatgaaaccacctgttagtgcagagcaggattatgcaaggaggaggggtgaaagcaacttatttcaccagcttctcgggatactttgtgacacctgttaaaatagaaaccaagtctccatctgtgtgtcagctgggagcagccactgagtgcctgctgcctggcagctacaaacagaatttatagtttcccgtgcccgtcacgtaaccacagtctggaggggtgctgcttgggagcccacctttggcacttggggattttgatgtccgctgaagtttggaaaccagtcacacgtacgaccaaggttgccccaatccagcctgctgcctgcgttttgttgttgttgttgtttttttttttttttttccgagactgaaccttgctctattgcccaggatggagtgcagtggcacaatcttggctcactgcaatctccacctcctgggttcaagtgattctcctgcttcagcctcctgagtagctgggattacaggtgcccactaccacgcctggctaatttttgtatttttagtagagatggggtttcatcatgttggctacgctggtctggaactcctgacctcgtgatctccctgccttcgccttccaaagtgctgggattccaggcgtgagccactgcgcctggcctgctgcatgattttataccgcccatgagctaagaatggttttatatttttaaatggctggggaaaagaggaaggatatttcatggtaaatgagagttatatgaaattcagatttcagtgtccataaataaagttttattggaacacagcctcatttatttacatgttgtctgtctgtgactgctttctggttatagcagcgctgagtagttgtgacagactgcgtggccacaaagattaaaatatctactatgtggctctttacagaaaatgtttgccaacccctgactcagagaaagagaaaataccgtaggaaggaacagtatctgcatacaaaaatcatgtttcaaaattaatagacaaaattggagttgggtaaacttcatattaaaaaaaccagaaggaatagtgttagattctggattaagatgaaagcgtatcgattatgtaggcctttaggtaagattttcacagagattgtgatcctgtgccctccataaattgactaactctatgcttcttttcataggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacgtgagttgatcctttttatcattaagaaatgcataaataaggccggatgcggtggctcacgtctgtaatcccagcactttgggaggccgaggcgggtggatcacctgatgtcaggagtttgggactagcctggccaacatggtgaaaccacgtctctactaaaatacaaaaattagccaggtgtggtggctcacgcctgtagtcccagctacttgggaggctgaggcaggaggatcgcttgaacccaggaggcagagtttgcagtgagctgagatcgcaccactgcactccagcctgggtgacagagcgagactccctctcaaaaaaaaaaaaaaaagagaaatgcataaatatgacacatttatctcagctcagatgttgtgtactttgagattaatcgtaacagtaacttttattctcattttccttttctctaccttgtagagaagcaaagtgatgagtaatactggctggagccccaaagaggcacgtgtgtgtgtttgtgtgtgtgtgtatatgcttgtcagtgcatgcacgtgtatgtctgggagtacaaatgggtgcgactggttgtagggaactagctatgtgccttctattaggccatgacagtcaaactgataagatctgattgcttctcttaaattactaaatccaagttttgcattaacataatttccttaacataatttcaattacctgatgcttgttttgccgttcacagctgatgaaacaaagttgaaaatgatgcaagaagttagtgaaaattttgaggtatgagcattatattttctatttttcattttgaggtaaatattcttattcactttcctgtcctgctttgtcagtctttttactagcaactcaaagatcattgtctttgttcaagtaatttagtatatttcgaaactgaaatctgaaactttgtacacagcgttttccatcttcacgctggtgatagcgaaccccataccatgttgaggattgtcagttttgttttggttggtttaaaaacattttttcattttaaaatatggtagctcttttaggctaccatgcctgttgggatgcactcagatttattcttgtacttttctttctttcttttctttcttttttttttttttttgagatggagtttcgctcttgtcgcccaggctggggtgcagtggcgtcatcttggctcactgtaacctctgccttccgggttcaagcaattctcctgactcagccttcagggtagctgagactataggtgcctgctaccatgcctgggtaatttttgtatttttagtagagacggggtttcaccatgttggtcaggctggccttgaactcctgacctcaggtgatctacctgcctcagcctctcaaggtgatagcattacaggcgtgagccacctcacctggcctgtttattgtcttttttgaggcagagtctggctgtgtcacccaggctagagtgcagtggcgtgatcttggctcactgcaacctccacctcccggattcaagcgattctcctgccttagcctcccaagtagttgggattacaggtgtgcaccacacccggctgatttttgcatttttagtagagaccgggtttcaccatgttggccaggctggccttgaactccttacttcaggtgatcctcctgccttggcctcccatagtgctgggattacaggcatgggccactgtgcccggccgagatgcactcagatttatgttgtgaatttgttatgttcaggtaatttgatggtgtattcttatgcaatgagatctggatgtcatttctggttctgctaattagaacatctgtgaccttgatcaagcaagaactttctctcttgtggacctcacatcctacaattgtatattgtcctgcatgtccctcagacacttttcgtttttcttcagtcttttttctttttgtcctttagattggataatttctgatcttctgagaatttttttattatctgcaacttgctgggtttttcttagaatttcagtttattttttgtatttttttaaattttagttattgtggtttcagttctagaatttccatttggttcttcatacatttcatttatctgcagattccccatctttgtttattaagaccatattcttctcttatgttttgaacatatttactgtatgagggctgctttaaagtcttctagtattaaagccaacatttgggctatatgaaggtcaatttctattggctgtgggccatgttatcctgtttctttgtctagtaatttatatatttggagacaaggtcttactgtcatccaggctggagtgcagtggtacaatttcagctcacagcatcctcaacctcttgggctcaggtgagcctcccactcagcctgttaagtagctgggactacaggcatgcactaccacgcctggctaatttttgtatattttgtagagatgcagtttcaccatgttgcccaggctggtctcaaactcctggactcaaaggatccacccacctcggcctcccaaagtgctgggattatggatgtgagccactgtgcccaaccgtctagtaatttttttactgtacagtggacattacttgtgagacatcatagggactctagatcctattatctccctcggaagaatgtcgacgttttgtcgtagtaggcagttcagttaccagctgatgccactgaatttgcgtaggcttggttttatgctttggggaggatctgtggatagcccagggtctttccttggtgggattcaacctcaaattctgcctgtggatctcatcagaggttgattttaggctttgttgcagttggtctagaataggccttattctaggacatggtctagctggatgcgtgaggtctgggaggttattaagatgttaagtaggtctttgcacgctggctaggcttgaaatccagcatcctctaacattgctagatgtatggtatcttcattcatcttgcaatctttttgttttttttgtttgtttgtttttaagatagggtctccctctgtcacccaggctggagtacagtggtgtggtcacagctcactgcagtctcaacttcctgggcccacctcagcctctggagtagctgggaccacaggtgtgcaccaccatgccccactaatttttgtatttttagtagagatggggtttcgccttgttgcccaggctggtcaggaactcctgaccttaagcgatccacccacctcagcctcccaaagtgctaggattacaaacgtgagccaccatgcccagccgcatctctcagtcttaaagcaggtacattgtggtgagcttcaggcagtgtcaccctgtgtgtgtgcagtccagccctcagctgtcctcactggagacactccccattcccttgctctgtggtttgcttttctctggtgctgtgccctgcagattccagccactttagctctcctgaacactgaggattttactcctcagctcagcaggccctgacccctgcttggacccagcttgctgaaccccagttggaaaattgtacctaggcagagggccatggtggtcatggggctaagcatgtaaatttcccttctcctgggagtcatgctccggtactggccctaatccaacacctgaaaaaagttatctcgtattttgcacaactttttggtttacctgggtaccagttagtctcatagacagatgagaaagtcacatttgttacttatttttttcacatcagatgggtaatgtgctgacataacaaggtttgagggaggcatgtctcacatataagcatgaaaccccaatcatcacccttacaaactacaaaaggatcacgtttccgatttttattgtttattagattaaaaaaaattttaagagatagggtcttgctgtacagtggtgcagtcacagctcactgcagccttgaactcctgggctcaagtggtcctcctgagtagctgggactacagatgcaagacactatgcttggctaatttttttttttttagagacagggtcttgctatgttacccagtctggttgaactctgggctcaagcgatcctcctgctttggcttcccaaggtgctggtattacaggtgtaacccgctgtgcccagccaacatttcttttttttaatatgaggataatagtcttaagaacaatagagaaaatattccctagcttccgtaaggtcttttgtattaataaacattaaatacatgttagtggggttgaatcaaataccctactatctgtagcaatggatagtattttagcttttttttaatagacattttcaaggacttgttgccttgagctgagctagaaaaaaaacttgagatatttagagatctagctaaagagctttctcttctgctcaagctgctaaaacaagctgtttaaaatatatatatatatatatgaagaggtgagaggcagaagagtataccctgcattctgcattttattggaagaactgatctgagagaaccatagtcttggcaggtttgttggagaggctgaaatcataggcagtctgtgaacctgcaggaacaagccagtgagtcagggcaccaagtgtggacatacggctatctggattaaatatctgtaaatatctgacccttttgaggttttgagactttattctcctttttagtatttgcaattagcaggttacctccttcctggcttttggtctcagatgcattgatcagcaactaaaagttagtggggcaagtctgggtgtggtggctgacgcctgtaatcccagaactttgggaggccgaggcgggtggatcacttgaggccaggagttcgagaccaacctggccaacatggtgaaactctgtctctactccaaatacaaaaatctagccgagcatggtggcacatgcctggcctgtagtcccagctactgggaaggctgaggcagagaatcacttgaacctgggagatagaggttgcagtgagcggagatcatgccattgcactccagcctgggcaacaatatatctatatctatatctatctatcatagatatagatatctatatagatagagatagatatagatagatatagatatctatatagatagagatagatatagatatctagagagatagagatagatatagatatctagagagatatggatatctagagagatatagatatctagatagatatagatatctagagagatagagatagatatagatatctagagagatatggatatctagagagatatagatatctagagagatagtatatagcagtatagttagggcttttccaagtaatgacttttgcaatctgtgtatcaacatttaccttaaatgaaattcagatgactgaattcttcaaagaattaaatactagaatgaccatcaagaagcagttctctaaattactaccacccagaaaaatgtttaaatgaagtgagtgaaatttaaaaactcccagtgatttcaggagtcttacagattcattattaaatgcgccatctttcaagacaaaataaaccctcaggttaggaatcacatgaacaatttatctggatcaaaaaactggtggctgagttgagatacttgcagaataaccaggcagcttgttgaatgaatcttcttttaattataaaaaatttttttagagacaacgtcttgctatggagtatagtacctattcacaggcgccatcatagcacaccacagcattgaactcctgggctcaaatgatcttcctgcttcggcccccaagtagcagggactacaggcatgcaccaccatgctcagcttgagtgaatctttttaactggagaaattctcttttttttagacatggtcttgttatgttgccccagctggtcttgaactcctgggcccaagcaatagtcccaccttgtcttcctaaataaagtgctaggattacaggtgtgagtcactgtgcccagccctactagagacatttgaaatgcagatatttgaaagctgtataatcagtagttaatatggacttacatgcaaatatgtttgacttcttgataacctggcagttagttcagtgttgcagcatgaatcttctccctcttttccttgaatccttggttgtgggtgtttcataaaaagtcttaacctttaagggtgaaaggtgccaaacacagttcttctgccccacaaatgcactgtctgcttggagagaagctatttgattcctgcacagctcctggggccgcctcccatacagtgttctgtgtgagtggaggccccagaaatctgcaccgagttggcccaggagacaggtgctcaggtgtgttagctggtcgtggtggtgggctctgtaatcccagctactctggaggctgaggcaggagaatcacttgaacctggaggcggaggttgcagtgagccgagattgtaccattgcactccagcctggtgacaagagtgaaactccgtctcaaaaaaaaaaaaaaaaaaaaaaactgcaatggttttctttccttgttccatactgctttctgatttttgactgtttcactgtccttcctttatagacccctcttctgaagttacattatgttatagacaactccagatctttctctttagccccatatttaactgcccaggtgtctggtctcaccagcttgtcagactcctgatagtaaaagttgaactccaggacaggtgcggtggctcccgcctgtaatcccaacactttgggaggctgaggcagcagatcacgaggtcaggagatcgagaccatcttggctaacacggtgaaaccccgtctctaccaaaaatacaaaaaattagccgggcctggtggcgggcgcctgtagtcccagctacttgggaggctgaggcaggagaatggcgtgaacctaggaggcagagcttgcagtgagccgagatcacgccactgcactccagcctgggtgacagagcgagactccatctcaaaaaaaaaaaaaagttgaactccagtccagatgtggcggctcatgcctgtaattccagcactttgggaggccaaagcaggtggatcacctgagatcaggaattcaagaccagcctgaccaacatggtgaaaccctatctccacttaaaaaaaaaaagttagccaggcgtggtggcttatgcctgtagtcccagctactcgagaggctgaggcaggagaatcacttggatcctggaggcagagtttgcagtgagccaagatcacgccattgcactccagcctgggcgacagagtgagactccgtctcaaaaaaaacttaaaagttgaactcctttctcttatgcttccttctccatcatgctgaactctgttgatatgccttttacactcgtgctttctcttgattttgtgcctttgcatgtgcttttcttagaatcttcttttctaccttttcatgggtagctcctacttgcctttcaagttttagtgtaaatgtcacttcaggaaggtgtcctccgcccttggttacatttagtaaatgatgtctcacagttatatgttcccttagttgttggcatatcccccctcatggttctgtatccttagtctttttgtttgatatctgtcttccttctgctgctgcctcccccatctctgagggcatgaatattatgtgttctgttcattattttatcccttttgagcacatgataggagtttagaaaatatttgttgaatgaataagtgaagcattaaacaagaaaaaggatttgggtgttagatatacttgatttgaatccacttccaaaactttactttttttttttttttttttttgatatgaggtcttgctatattgcccaggctggcctcgaattcctgggctccagtgatcctcccacttcagcctcctgagtagctggtactacagaccagctagtgtgcccattttcaaaacttaacctcttagatcctctttccttatctgtgaaatggagataatacctatcttagagataatacccatctcagactaaatgagaaagactaaaaggtacacagcacagtatttgacatgtaagtgctctgtaaataacaacacaacacttccgagcatttcctgtaggcagtgttagaaacttcataaactttgcatatattaactcatgcagtcttcacaatagtcctataaggaaggcgggaaataatatccccagagtttaggtaactgtccaaagtttctacttcctaagtgggacccagaaactgccctagtatcttcatgctgtagttttatttcctattctcctttttttttttttttttaaaaaaatagagacaggatctcatgctgttgcctaggctggtgtgcagtggcatcatcatagctcactgctgccttgaactcccagtctgaagtgatccttttacttcagccctctgagcagctaagaccacagcataggcacgtgccacaatgcccagctttttaaaaaaaatattttgtagagatggagtcttgctctgttgcccaggctggtcttgaacttctgggctcaagggatcctcctgcctcggcctcccaaagtggtgggattaccggcatgagctacagtgcccagcccttcctattctacttttaaaatcagtactaggatcaataatggattagattagattataatataattagtatacatctaattagcacataatgaatatacatctaactaatacattggtttgctcaggctctttgttttccagatcaagaaactgagacctagaagctaaataacttcatagaggtttcatacttagatcgtggcagagacaagctagtacaggttccaggttcagcatttcccaaaggattggtatttctaattttaataggaaaagttagcatttagttttcctgaattggatttcagaaatacaatcatcctaatttaaaattatgttattactaaataatacaagtagcacaaatttgcttttggctaaaatgttttatattcctttgcagttattataatgtgtaaatttgaaatgaaaatacatacacataactgaatggggtcttttatttttgcacaattagaatgtcacgtcatctcctcagtattctacattcctagaacatatcatccctcgattccttacatttctccaagatggagaagttcagtttcttcaggagaaaccagcacaggtaatgtaaaaaaataacatgagaagacaagggtgctgtgggattgtgaccagttacgaattaactcagaaaacttacggttccacttaaaaacgaaagaggttttgtcacataaggataactttgttcaagaccgctgcctcctcagttacatgtcttggtttgatttttgtctaggacgtcccttttacaatttaaattattcacatttgccaactgatgacatgtgtgtacactgtttactatagaccagtgcaaatgtatacagaagaaggaatgactaccccccatacctattgcctagctccaatcttactgtcttattaatgtcagttcttttttttttttttttttttttttaaaagacaaggtctcactctgtcacccagtctggagtgcagtggtgccaatcgtagctcactgcagccttgacttcttgggatcaggtgatcttcccacctcagtctccccagtagctgggactactggtgtgcgccacaatgcctggctaatttttaaaaaattttctgtagagaatgggggtcttgctgtgttgcccaggctggtcttgaactcttgagctcaatagatcctccttcctcagcttcccaaaattctggtattacaggtgtgagccactacgcctagcctagtgtcagttcttatagctatggtcaattttgttttatcgacacgcccccaacacactgttcatacctccctaccttgatcatttagaaatagtccatatatatatattttttttttttttttttttttttgggagacggagtctcgctctgtcacccaggctggagtgcagtggcacgaactcagctcactgcaacctctgcctcccaggttcaaacaattctcctgcctcagcctcccaagcagctgggattacaggtgcatgccaccatgcccagctagtttttgtactttaatagagaccatgttggccaggctggtcgtgaactcctgacctcaggtgatccgcccacctcggcctcccaaagtgccgagactacaggcgtgagccactgcgcccggcctaccactttttctataaatatttcagcatgtagctctttttttttttttttttgagatggagtctcgctctgtttcccaggctgaagtgcagtggcgcagtctcggctcactgcgagctccgcctcccgggttcacaccattctcctgcctcagcctcccgagtagctgggactacaggcgcctgccaccacacccagctaattttttgtattttttttagtagagacagggtttcaccatgttagccaggatggtctcgatctcctgacctcgtgatctgcccacctcgtcctcccaaagtgctgggattacaggcgtgagccaccgcgcccggcccagcatgtagctcttaaaaataacttttaaaaaacgttcccataataccagcttattagtaaataaagtatttttatatcatgccagtgtgagaccttacatatttgaccttttagttgtcagctccacagacagaatcacagaagcttagtacagctcatgatataactagtccttgggcccaaggtagttggcgatagcattatgggagctaatgcgagatggtaaggggagatcccaaactatgttcagtttgtgttttgctctttttatcttcaatgaactccatgttcgtacaccagtgtccgttggacttactgataagccgtggaaggggagaaattggcttagtcgatttggtacagagttgtagaaatactgaaaatgatcatctgcagtacttactttgggttacatttaagtagtttctaggactgcttgaaaaactgggtccattttgtaggatggtggttcattcctagtgctgggtgtaaacagctgtgtgacacttgcagagtgtgagataattaatttggaacccttggaagtatttttatccttacatttatttattttttcttgccagcaactgcggaagctcgtacttgaaataattcatagaataccaaccaacgaacatcttcgtcctcacacaaaaaatgttttgtctgtgatgtttcgctttttagaggtaagttttgagaattaattcttgtcgtatagccgtatgtaaaactttcactgatttttcttatggtaaatttcagcattatacaactgttttatctttctcccaaattccaagtcacatgagtaaaaatttttcttaatgtcccttttcccccatttcctccactcagaaagattacttaattgaaaatcattgtttgagttactgaggaattggccagacatagtaggtacctttgaaacagttgcggatggtgagccgggtgcgggcccgcagacgcccagtgagtggctcacttgcattgttctttccgtgtgtatctccagtgtggcgcatcacacctagtacatgctcataaagagtatctcacatccttggggtgaatccatctggtacctccaaattgttttcttgcttctcttagtctttctttttttttttcttttttgagatgaagtcttggcccaggctggagtgcagtggtgtgatcttggttcactgcatcctccacctcctgggttcaagtgattgtcatgcctcaacctcccgagtagctgggattacaggcccttgccaccatgcctagctgatttttgtatttttagtagagatggggtttcgccatgttggtcaggcttgtcttgaactcctgaccttgtgatccacccgctttggcctcccaaagtgctcggattacaggcgtgagccacctcgcccagccctcctaatcttgatgcagttagatttcagtcgtgtttctgggcctattggaaagatgagcttggattctgtcttggctggggcgctttgttgctgtgtcatgtcagccacagtgcttaacccctgagatatcatgccctcacaggtcagatgtagatggaaccccatcctcacagagcatttgtaaggtgcttagcacagggtccagtccttggcacttgcccaataattctttcctggtcttttcacaatattgtccaacaatggaaagtgtcatttgggccatgaagtccttagctcctggtgccactttccacaaaggccagtgaagcccctgtccaggttactcatgcagagctggctggtgggattcccttctggtggtgcaccgaagctttctgtctgggacaactgtgttctgtgagctgatgaattttcagcaaatccaatagttggttgatggaaagtgtgtgtgcagaaactgctgagaaaattagcctttaaagtgagtcttcagaagtataactttcattaaatgcttttttttagacggaaaatgaagaaaatgttcttatttgtctaagaataattattgagctacacaaacagttcaggccaccgatcacacaagaagtaagttgtttaaaatccttatagcatttataaagtgtgtcaacatgttccttctgtgaaattttttgctgtctcaaagttggctgaacacatactgttttcaagtgtagaaatacagcctaagtttggggcaattctttatgagtttaacagtgacttaaaaaaatgttattatcaatactttgctaaattggttcagtagttgaaatgtattaaatgaccaaactgacaggttatttgggctgttctggtatttatgcgtatgatgtacaagtcattgtatgttgtacagggattaagatgtgggctctgaagccagagccgggtttgaatctcacctctgcaattcagtagctgtgtgacattggttaagtttgtaaccttttggagatttttctgtaaagtgacaataatcatagtatgtccttaaaatgtcatttgaggaattagacataaagtttaaagttattagcacagtgattggcatctacctatacagtaagcagcaagtatacatttaccataattatatcttctctgatgataacctaaataagtgcctgttatagatgatttaaggtagaaattaaattatttattaaaattaaaaattatttattgaattaaataacttaaaatagaaattaaaagcataaagatgaaataggattcctaccatctcaaaaacaggattttatgtcttggtgattttctttcctttcctttctcttttcttttgttgtttttttttagatgagtcttcctctgttgctcaggctggagtgcagtggcgcaatcttggctcactgcaacctctgcctcccggattcaagcgattctcctgtctcagcctccccaagtagctgggactacaggcttatgccaccacacccagctaatggtttttttttttttttttttttttgtatttttagtagagatggggtttcaccatgttgccaagctggtctgtaactcctgacctcatgtgatccgcctgcctcagcctcccaaagtgctgggattacaggcatgaaccgccatgcctggcctgttctttcctttttctcacgttaatgtttttgtatattttctacataattgtggtaatactgtatataacatcttatagcttgatcatgttaagtgtaagcattttcacagtcataaaaaattctgtatacaatttttaaaaaaatttttgtagagacagagtctgtctatgttgcccaggctggtctcaaactcctggcctcaagtgatcctctagtcttggcctcccgaagtgtcaggattgtaggcatgagccactgtgcccatccacaattattttttaatgggtacatagtattctttcttatgggtgtccttatttctggatattgaaggtatttcaaatttcttattttaatggttattatggaatacctttgtttactgttcaaattatttcatagactagctttgtaggagaattaccgaggcaaaggcattgaagtgttaatgctcctgtgttaagctgatttctaggaaggtttcagtggtttacggccccacagtatatgagagtctttctctcgttccatcctatcaggcattgtgtattactattttgtgaaaggcaaaaactggcatttattttaattttcaactctttgctcttcctgaatcagaaacttgttatctgtttatcagtcctttatatttacttatttttttgtttgtttacatccattgcctatttgtatcttgagcccaccattttccttacctctcttatgagttcttacgtagtaagacaattacaacttttcttatttattatgggtattttctgtttatgaatatcttcctataacgaaagtgtctgctttttttagattcatcattttctggattttgtgaaacagatttacaaggagcttccaaaagtagtggtatgtttttactttggttttaattagttacatttgtttatacttccttattccaaaaagactttagaacagttgggttgcagaaatagtgtgtggggagggtttactattttagaatggggaatgtttagcaatggttaaaaactgggttgataagtcagccattcaaaaaagtagcttttttagtttttctgtttcacttaagtactttttttgtacataaaggcaatatgtttttattgtagaaattttggaaaaataattgtcataattcatttactggtaagcaaccattgacatggaggttttgcttttggttttcactttgtgcattttaaagacggttgagtttacaggctcgaagactttttggggaggtggtgtatattttcagtttttttttaaattttactaacttttttttcgatctcattaagaactctttataagcagtgccacaatatacaggtttgtggagtagaggaggaaaatctcctcatctccttcctgcttattagaagtaaacactcttgccagtttggaatagcttcttccagactcttcttctgggaatcataattctttctttttttttggctgggggtgcgggggtacggggtctctgtctgcccaggctggagtatagtggcgtgatctctgctcaccgcagcctccaccttctgagttcaagcaattctcctgcctcagcctcccaagtagctgggattacaggcgtgcggcacccacccagctaattttgtatttttagtagaggctggtcttgaactcctgacctcaggtgatccacccacctcagcctcccagagtgctgggattacaggcgtgagccactgcacccagcctaaagatttcttttttaatctttaaaaagtttttaaattgatataggataaaattgactctttttggcatttaaaggatttcagtctggggagaatgtataaaacttaaaattagtgactttgagttgtcaagtcctgccacctgccctcctgtcaaagcccgagcgctgcttttcataggcagctgccttgttgaacgtgaaaccccaaatccactgagagcgaaggttggcagtgaggtcctggcttttaaaaatgtcctgtgttttggccaggggcagtggctcacccctgcaatcccagtactttgggaggcccaggtgggtggatcacctgatgctgggagttcgagaccagcttggccaacgtggtgaaaccccgtctctactaaaaatacaaaaattagccaagcatggtggtgcgcgctagtaatctcagctacttgggaggctgaggcgggagaatcacttgaacccgggaggtggaagttgcagtgagccaagatcgtaccactgcactccagcctgggcaacagagcgagactctgtctcaagaaagaagaaaaaatgtcctgtgttttgcttgttccctctttgatgtctatttagagagtgaaaaattaatcagtggggactgccagctcgtagtttcttcccagaagggatggagtgctttctttcctgcctcactgtggtaggaatgtaatagggtttgtatttaatcatttattagccagggcaaaaagagtagaaaatacttttaggcaagctttgtcttctgttgttgaagatggagaacatggtccctgtcgtgttatctttatggtcctgtgggaagagtaaacgtctagtgtgtgttggtttaggctttaaggggcattggaaaatgaatggctgagcctaaatactgtggagttggtgcagcataaaaatgtagaacatactgtttttttccaccaaagagtcaagcgtctttttgttttgttttgttttgttttttttttttgaatgaatattgggtttgactttaggaaaaaatatttttatgacttttatgtagaaccgctactttgagaaccctcaagtgatccccgagaacacagtgcctcccccagaaatggttggtatgataacaacgattgctgtgaaagtcaacccggagcgtgaggacagtgagactcgaacagtaagtgtttcgctgagttatttctacccgtggctcctgtagtttcggatactggcctgttaaaccatttttttttctcttaaatacttggaggcatttaagacaaacgtgtgtgcctggcaaagcatcactggtccttctctgcagcctgggaggggtgaaagtgaccttttgggtgtcattgatgccaggctagaaagataaggttgttgttgaaacccagaatcaccctgctgggaagagcagcagaccaggtgtggggtgtctgttctgtcccttagctttgagtcttttgacattaataaagtcccttaaactatagataaaagcatatagctcagtgactgagagtgtgggctctaggacagagagctccagtacaatgtcctggccccactggggttttctgactccaagaaagttaatgaacctgcgttctgaccttatttttcctctcattatctaaaaaacctgtctcacggactttgtgaaggtaatgctggcatggtccgcaggtaatgtatcgtatatttgtggtgtctgccacataggtaacatgttttgagcacttactatgacaatttttgtgattgaattattatccatgtttgtttttctgaaatggttgtgcagagtgtttcagttgtgctaggatgaacaagaaactttgagtaacgctttcctccttttgttgttcttagttagaaatttgttttctgagtatcattcctttgtattttcttttttccttgtctgttgatatccattgcccatctgtattttgagcctgacattttccttgtttcatgagtccttatatattaggactgttgaacttttctatattgtaagcattttctgtttataaatatctttgaataaaactgctgagtaaattgtactttgtgctgttcttttaaataagtgaagtcataggcattcattttaaaaatttctcagatgatttgaatctccaagtttggacatagtttcctgaactttttacaaatgattatgtagaaaaatatgcaaacctttaggccgggcacggtagcacacacctgtaatcccagcacttcgggagaccaaggtgggcagatcacctgaggtcaggagtttgagaccagcctggccaacatggcaaaaccgcatctctactaaaaaacacaaaaattagctggacgtggtggttcatgcctgtaatcccagctactcaggaggctgaggcaggagaatggcttgaacccaggaggtggaggctgtagtgagccaagatcgcaccactgcattccagcctggtgacaagagcaagactccatctcaaaaaaaaagaaaaccttcatattgaattgtattaaatgatagttctgcatactttgttttcaacatagtttggatctttcatcagtttggatctttcatcacaaatatttacaaagaggtgtcactgttttccgttctctctctttcagtgggtgatgctcagtgggcactggtgggggctattttaaatgccacaatggtaacccgggtcctacccatttctgtcttccagcattccatcattccgaggggatcactttctctgaaagtgttggcagaattgcccattattgttgttttaatgtatcaggtatgtgtattgctcattagtctcttgggttttgggcttcttataagaaaattggcatctggggccaaaagatgtgtataatacacacatgctaaataatgtgatgattcttcggtatgccagattttgtcgccatagcagagtgtcaatgtatgaaaatctggtatgtttgcttttagctctacaaactgaacatccacaatgttgttgctgagtttgtgcccttgatcatgaacaccattgccattcaggtgtctgcacaagcgaggtgaggcgtcactgtagccggctgccacagtgcctggattccaagtaaaaatacacttgctgttgtcattcttaagacatgaaaattatgagtgataaaattttggtaaaattatatgcactgttgactttctgcacctgtgtttcagggatgacagttgtagctattttcgttcttaatttggaaagatgagataatagctcgtattctggtgcgttgtaaattaaaaatgtcgtcaggcattaccgtgctcaatgacagctatggcatgtccaagccttgctcaccttcaagactttgttcttgctgattgttcagcttgagtgctagaatgttctttacaccctcagttccccatcagccttcatctccagataggctgtgttcatcctttgaagcctctcggtgaagccttttctcaaacctaaggacgttcctcctgagactgtcttcatgcaccctcctgacttggagcccgtctggctgtgtcatttgagggcagcatctgaggaggaatcttctttggccatcgccacggccctagttggggtcttgcactgagcagatgttactcgaattctttctgcggattgagtagaacggcctggcactggctttgtgggattcacattgtaactgctatggaatgggctggagaactggttggtgtgtttccttaaaacttttatgttatttggaattgcacgaaaggtgtagacacctttgctattgttgctgtgttgtttgggtctgtgtggaaatcaatcttttgggtttagtaatggttacaggcttttaattaatactaacatcactcataattgagaggtaatatttttgttctcttcttattcaggcaacataagctttacaacaaggagttgtatgctgacttcattgctgctcagattaaaacattgtcatttttagcttacattatcaggatttaccaggtaaggtcattgacttttatgtcaggtttattgagatagtttacatacaataaaattcaccttttgtgggtgtacagttctaggaattgacaaatattggtaatcattactaacacatcaaaatacggtacatttccatcaacctccaaaattccattgttacatatttgttgtcagtttcttcccaccacctccattccttggcatacacaccgatttatttggtccccatagttttgtcctttctagaatgtcatctaaatggaaatgtccagtgtctagtctctgcaaccttttgagtctggcttctttcacttagcagtaatgtggagataggaccttgttttactgattactttttattgctgtgtagttgtctttgcttggcagccttaacaaaaaatcccataggctaggttgcttacacggtagcaattgtctcacagttctggaggctggaagtctgagatcaaggttctggtttctggtgagggctttcttcctgccttgcagacagctgccttctgctgtgtcctcacaatggcgaacagagagggagagttctctcctcctcttacacggccaccgtcctgccagataacggctgcagccgtatgacctcactgaactttcatcccctcctgaagactctgtgtccagatacagtcacatatggagttagggctttcacatgggaattttaaggggatgcagctcaatccacagcagtagaatcccattgtgtggatgtatcatggtgtgtgtttatccattcaccaactgatgagtattcagattatttctaatgtttttgaaaacagctttattatttacttactattttttgagatagaatctcactctgttgcccagggtggagtgcagtggcacaatctcaactcactgtagcctctgcctcactggttcaagctattcttgtgcctcagccactcgagtagctaggattacaggcatgcactaccatgcctggctaatatttgtattttttgtagaggtgaggtttggccatgttgcccaggctggtcttgaacccctggcctcaagtgatctgcccacctcagcctcccatggtgctgggattaccggcatgagccaggcctaaaaacagcgttattgagatatagtttatgtatcataaagttccccctctttaagtgtacaattaagtggtttttagtttagccacagatttgtaccattaccaccatccaattttagaataatgtcatcatcccaaaaagaaaccctgtcccatcagcagccttccttgactatgtgctcttggcaaccacgattgtactttctgtctttacggatttgcctgtttcatttttggccattattaataaagcaactatgcacatttacatgcagatttttgtatggacatatttggttcattgacttttgctgctgttagaagttgtgtgttgtggcagctaggtgtgagagagattggaatttaaaaggcgttatcagtaaaactgatgaagaagttctgggtgcttttctgaggagactgtatggtggatttttgtttcattttttcatgcatagttgtgttcttatttaaatcatgagaacttgaaggaaaaaataccttatctccttttagtgtttttgaaaagaattcttatatgattgttctatagtatggaataaattcagtactgatctatatcaatggaattggattataatttatgctttttgtatggcttttatttcagaaaaataaaaattaaagagctgaattgtttagaataaaaactacttttgaaagcatttgtaatcttttcccccttaattttaatgcatatgattagataatgatagcttacatgaagaaaatggaactggaacatttggtgtaaaaagtcaaattaggtaccccttgacattttagtcagcttgcgttatcttggtgagtggccttctgctgacaccgcaaaagaagattgtgattagagcctgttctgagttggctcaagttgactccactgttgttcacaacttacattaatgggatgactaagtaaacaagtaattaccttaaaaaaaatcttagaagcctggcatggtggctcatgcctataatcccagcaggtgggaggattgcttgagcccaggagttggaggccagctcgggtaacatagcaagacccccatttctaaaaaaaaaaaaaaaaaaaagaaaattaggcatggtggtatgcacccttagtcccagctactgaggtgggaggatggcgtgagcccaggaagtcgagggtcacttgagtcaagcttagtcttaacgattttttttttggagacaagagtctcactctttcatgctggagtgcagtggcttgatcttgcctcactgcaaccttctcctcccaggttcaagtgattgttctgcctcagcctcccaagtagctgggattacaggcatgtgccatcacacccagctaatttttgtatttttagtagagatggggtttcgccatgttggccaggctagtcttgatctcctgacctcatgtgacccacccacctcggcctcccaaaggtcttactgaatttttaagaagctgataacatttgaatttttcttaatactctcctatccctgtaactgtgtcatctcactctgttcttacaggagttggtgactaagtattctcagcagatggtgaaaggaatgctccagttactttcaaattgtccagcagagactgcacacctcagaaaggagcttctgattgctgccaaacacatcctcaccacagagctgagaaaccgtacgtccagcctgtcttgtcttgaatgctgatgctagtcctgtggccatctttggggactcggctgacattccatagttgtgctgtgaggtttccatgtatccttgcttccttcattgctgtcttgggttcattctttcccctcttttctctccctctctgcctccctgtattagtctgttttcacgctgctgataaagacatacccgagactgggcaatttacaagaaaaagaggttttatggacttacagttccacgtggctggggaggcctcacagtcatggcagaaggcaaggacgagcaagtcacatcttacgtggatggtggcccgcaaagagagagcttgtgcagggaaactcccctttttaaaaccatcagatcttagccgggcacggttctcgtgcctcagcctcccaagtagcagaaattacaggcatccaccaccacgcccggttaatttttttatttttagtagagatgggatttcaccatgttggccaggctggtctcgaactcctgacctcaagtgatgtgcctgcctcagccttccaaagtgctgggactactggtgtgagccactgcacccaacctctttccagtactcctgccatgagtaagaattttggaggtgtgttggggacctttgtagcacaaggattcttgtagatctgctgacagattcggctgggtgtggtggctcacgtctgtaatcccagcacttagggaggccgaggcgagcggatcacgaggtcaggagatcctgaccatcctggctgacacggtgaaacaccgtctctactaaaaatacaaaaaattagccaggcgtggtggcgggcacctgtagtcccagctgcttgggaggctgaggcaggagaatggtgtgaaccccggaaggcagagtttgcagtgagccaagatggcgccactgtactccagcctgggcgacagagcaagactctgtctcaaaaaaaaaaaaaaaaaaaaaaaaaatacttttcatgcttaccaggtcacctccttcccgttactgtacaagctagccccttctgaaggcataaagcttggttttaatcagtgttcacagctgctagccagaattgctggcttcccaagctgctgccctgcaggggttgatcacattagactttcggggttcagcttttagtcttcccttttttaaaactccgtttactagttggcttgattttgtttttaacaagatattataggatgctttattttgaagccttttagtagttcctgagacttaaatagacattagcatcacatctcaaagttttggtggaaagaaacatgtagagaatcatgttaaatgttaactgtgtgttacagttaaaacgtccacttccaccaacattttctcttcaccttacttttttggcacctgcaacgttatcaagtggtaactcattttcactcattctgaagagccagtggtttgagaaaacctgccattttaacaagttcagcattttcctagagattctggttctgggtcatggaaaggatctggaaagtagtggtcacgcaatttcatctcctatcactcctccctctgctggaggtgttcccacctccccagccagttctccatgtcacggctgagccctttgcatccctctgtgcctccttcatcttggccacttcactgcagcctgcctggcctgttgcatcctctgacctcagaggggcctgcttgtggctgtttccatttggctgttcctccgtgtgctgcctggctgtgcagttacctagagatgtgcatcttgcacatttcagtgtctgcatttcttttatgcctttgaccctcaatagctacgagctggtgggaaatgtactttatttgacttactgcagctggctttatgtcaggcttattccagaacctgaacaccctttgggatgattgtattaatagaactccccaggggaagtgtggacatgctgtcgctgccccatctgcacatcctcagaagcctgaattgtccctgagtggtgaccggttgtttctatagaaccctggttaggttcaggcctgcaaggacgcagagagtaagtttaggggtggttccacctgcaggaatagagcaagagaggaaccccggtggggattctgatgagcatcatccagggaatgcagaaccgtaacctgggactcatgcctgtgagaacattgtaaaaacgcctggacctttgtaatttacatagagaaacatcgttaggtcttctcaatatgcttcagggtagtaaaggggcatttaggagatcctgttcccttgtccaaactggttgggagggtggtgacaatgtttaaggatggtgggatgtgcccacagttaagtatcagaggtgggatctctgccaggggacaccaagctgatttattcttaatttgatctctgaccctgaacgtgaccctgactgcatctttgacagcaggtggctggtgtggcccagcagagctgctatgttagactgaaatagcacttgtgcctttctggtctcctctctgtcccttttcaggtctggattgcatatcagactgcgggctggctacttcgaaagcactgtaaagtaatttaatgtgtgtaattggttttgttagtgatctgtgcaatggatgtttgtcttctagagttcattccttgcatggacaagctgtttgatgaatccatactaattggctcaggatatactgccagagagactctaaggtatgagattaaaccagtgatatctggttggttaaatgccaggagcatcagttactggcacttcatgttacaagtgtttcaatgaacaccggctgttgagccttgacacacctgttaggttagcaagtgcaggatttttgtttttgttttatttatttatttatttatttatttatttattttgaggccgagtctcactctgtcacccgggctggagtatagcagtgcaatcttggctcactgcaactctgcctcctgggttcaagcaattctccctgcctcagctgcccgagtagctgggattacaggtgcctaccaccatgcctggctaatttttgtatttttagtagagatggggtttcgccatgttggccaggctggtcttgaactcctgacctcaggtgatctgcctgcctcagcctcccacagtgctgggattacaggcgtgaggtactgtgcccagccaagaattgcaggatttttggaaagcccttagattactttttgtgctctagcttaaaggaagaaatcagagtaatcatcttgatttaattttaggtaaaactttatctgactttattattgttttttgctttttgtataatgcatctttttttgttaaaaagaaatttttttttataacctaccaggaagatagaagggaagaaaaccttctggtcctgcacagggagatggagtaatgttgctaatatcttaatgtatgtccgtataatctttgtttcttacacttaaaaaaaaaaaaaaagtagttgtggccaggcacggtggctcacgcctgtaatcccagcactttgggaggccgaggcgggcagatcacctgaggtcgggagtttgagaccagcctgaccaacatgaagaaaccccttctctactaaaaatacaaaattagccaggcgtggtggcgcgtgcctgtaatcccaactagtcgggaggctgaggcaggggaatcgcttgaacccaggaggtagaggttgcagtgagctgagatcatgccattgcaatccagcctgggcaataagagtgaaactctgtctcaaaaaaaaaaaagtagtgataatggttactatttctaaagcagaaaattaacatttaatcatctttacattataaaatgaatcaatgtttgtcatattttacttccaataaggaaggcgtgatggatcttttaaaaaatgtttaggttcctttgaatatgatgcagttttctcactgttttctatagacaatgttataaaatattaagacattttttgtaacttggggttgaacttgcctagaattggacgttagattatgttactcctgctcgaagccctccagtggctttctgtagttcttagagaaaacccaaactcttgaccatagcatttgagtctctgcgtgatttggctctgtccacctgttctacatcttgtgttggtccttcctctctgacttgctgcagccacactggcccctgcagctcccctctccaatctgctgcagcacgccgccccctacagcccccatccctgacctgcttcagccatgctggcccctacagctcccctccctgacctgcttcagccatgctggcccctatagctcccctctctgacctgctgtagccatgctggcccctacagctgccctccctgatgtgctgcagccacactggcccctatagcttcttggctacttcaggcagttaccacctctgggcctttatctttcctgtttcttccatctggaaatttccctggatttttgccttatggcccctttttgtccttaagatctcaacttcagtgccacctcaaaggaactgtccctggaaccctgtttaagaatagcttgccccactcatctttctcatgtgcccttttcacatccccgctagcacttactaacttgtgtagcttatttctttacttgtgtgttctctgctgtaagtaagcttcctgaggactggggctctacttgggtcactggggtgtccctggcaggcccaggatctggcacatgacaggtgtccttgtgtttagtgagggaaaaaactagtagcctgaaaattcttactgtgtctctgtaaagtggtcatcatatataaagattgattgacccgtcctatttatttttgagcaacaaaacccattcagtgcatgatcaagctggtaatattcctccttggcttagctgtatgtgccagcatctattagtaactttatgacgtgcacaaagttaaccttttagcttggaaggtaaagatggaggtatcagtacaaaacttgagccctcttctgtcatgtatctgggagagagtaatgtggtgaaaatgggccatgtaagtgtgccgacccaggggtggtgttcctggggcagatggtgatatccttggtggcctgctgcagcaggcatggccacgtgggaatgagcactagtcgaggtctctgcccgcaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggtaccagctcttctgagagtatcatccatcctgcactctatcctgtttgtggctaaattttttttttttttttttttttgagacagatccttgttctgttgcctaggctgaagtgcagtggcgtgatctcagctcactgcaacctctgcctcctgggttcaagtgattctcatgcctcagcctcccaggtagctgggattataggcatgcaccatcatgcccaactaacattttgtattttagtagagacagggttttcccatgttgaccaggctggtctcgaactcctggcctcaagtgatcctcctgcctcagcctcccaaagtgctgggattacaggcgtgagccaccatgccggacttgtggccaaacttgaaccagtgctgtaggggcggcttgatcgctaggcttgatcccaggagttagaccacctaggttcagacccaggctccccagatgcttcacttctgtgcaccagttttttcatcttttcacttggggtgatgatatctgcctcataggatcgctgtgggagttaaatcaggcagcgcttgaaagctcttagcacacttcctggcaagtaattaggagagttattttctgggggcatagtacccaagtgctagactggctgtggacctctctggggagacacccagagtgtgagggatgtgattcctgagccccaggggtggtggcggggccctgttgggacgaggcctgtagtcctggatgaaatccaggccctgcttgtcaggccagtcactcagccttcctgagccagactctgcacatgcaaaacggatatggtattgggagtaaatcggcacctttcttttcctttacacgtggcacaaaggaggtgcccagatgttaccagccttccaccagttttgttgggttggtgcgaaagtaactgcagtttcatcagaagtaatggcaaaaactgcaattcctttgacaccaacctcatagaaaagcagcatgacttgagcagctggtgtcagtcccatcttattttactgtgatctgagcagtatttggcctgttgaagaagaataattctgtcttccctcttgaatttctcttcccgttaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtggtaattctgctcttcagttatgtagacaaacaatagttttcataaagtgagttttattcaagttaacttaatatactttctcttttccagaagctcagttcattcccaacaagcagttacaacccaaagagacacagatttacatcaaacttgtgaaatatgcaatgcaagctttagatatttatcaggtaaggaagtgccctccagccaggctttcgcatatggaaagtacctcttagtattagaggtcatagtggtggggtggcagtgagagctgttagtatttggatggtccacagtatttgtatacccagatgtgttttgttccacaacatagcactgcgtttatgtgggaattcttatttataagagtctgtgcatttttgaggggcagatagtgtaaacggaatgcaataaaaatataagacttaagtttaataatttttttcatggtctgaacacctagaggttttttttttttaattctttgccaaaattaaggtgagaaaggagaatttaaaaggttttggagggggacatttgttatctaatttaagtgctctattttaagtatgcagctgatctggttacataatggaacatattcagagaggttcagttttaatgcctgtgggcggcttttttcccctgtattaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcaggtataaaactcctttttttatgttgtttgaacattacaattctttgtttatgtcttaaatactttttcatttatttcaaggattttaaaaataatgtagccaaggatgtgcttatagctcaaaatttaaagaaatattaggccataatgtcttgaaacaattcttaaaagattcaaatgctttggatcagttcctttcgttagtagaaataaatatgtgggccaggtgcaatggctcatgcctgtaatcccagcactttaggaggccggggattgcttgagcccaggagtttgagatcagcctgggcaacaatggtgaaacccatctctacaaaaaatacaaaaattagctgggtgtggtggcacacacctgtagtcttagttacttgggaggttgaggcaggaggattgtttgagcccaggaggttgaggctgcagtgagctgagatcgcaccgctgcactccagcctgggtgacagagcgagacccccatctcaaaatctcaaaaaaaaaaaaaaatgcattaaatgtatttgatgatgaggatgaaataacagattacatcattgaagtgaactgccctgctcagtgctcagtaaacccgtttcatttttttcctttggtggataattaaatttcttggaatgtgtgatacaggcttggttttatgttttttgaaagcttactactttgtcttaaaactgctttggggaagggattaatttttcacatgtgtttcttgtattgacagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaaggtaaagtccatttaatctaagtagtgcttctgttcagggttttttattgttgttagagacagggcctcacggtggtgtccaggctggtcagcgttctggactcaagcaatccacctgccttgatctccccagtttttgggactataggcactcaccactgtgagtgtgcctggcttttttttttttaattcttattttcacttttaaacaaactatagtgactctttatatttataaagtactcttcgaagtagtaaatatttgcaacaaataagggccaagtgtgaaaatcattccgtgtatgtctaagcagtaactaatttgtctatctagtaacttaaaatgaaaaatccagaactcttacggtaagcaagtgtggtggtattagtattgacaccactgattttcttttttaaacctattttctttttttggattacacaaataggagcagatggttctatttttaaaaatttcagtgatgcaaacgaacttattagaaggaaaaaaatgtcttcacctacctctcaaatatggtgtgacagtgccgattgttaccaagcagtggtctcactcctggatgcacactgaagccaatacaatggtaccagcttttcagggaaaaaaaaacatctttattgcaaggttgtttgacaaggagacaggagactccgttctcccagagctggggtcttgtggtgggttttataggaagagtaactgtgagggagacggaaaaatgcagtgaggcatgatttgattgagctctgcagtgaggcagtgctcggtcttttgctcttaagttcctattgcaacaaaacagggctcccttgttcttaatttggtcctcgttgcttggtccaggtacttgggttccatctgtggttaacttttccttccagcccgccccagagtcactaatcccgtgtgccttgttcacctgcgcatgtttgctacttgcagtcttggggtctgttgcaactgaaatcaactcagacgaagctgaaccagtttgaactggttctgcggttacagttacatcaacagttgtccacttcactcaggttttgtttttgctttttttgtttttttgggttttttttttgagtctgtcacccaggctggagtgcagtggagtgatcttggctcactgcaacctctgcctcccgggtcaagcaattctcctgcctcagcttcgccagtaactgggattataggtgcatgccaccacgtttggctaatttttgtatttttagtggagatggggtttcaccatgttggccaagctggtctcaaactcctgacctcaggtgatcgtctgccttggcctctgaaagtgctgggattacaggtgtgagccactgcacctggccttcactcaggttttgtgttttctctgtgttaacagtcttggcaatatgtaaatgacacatttcaggactatttctttctttttcccctttaaataaaaaattctgatcagtctgtgcttctttattaagaacatcttagagaagatgtcccatcatacatttttatggatgactaatcctatgtaattggatctcatctgttatttgagtctagcaaatgggtaaaacccatccatagttatattactaaaagcagcaggtggtagaataaaaaccttataaaaatgcactccctcttgtggcaaaatatcttaatttctatagaaaattgaatatgtcaaaagagatgctttcttgggaaaatctgaagatgtaaataagatctgtgcatttggagtaattgcacagatggtgacacagagctccagtaacctgtgctttccttgttttcttttcacagttctatagtaattacttatcaacaaccttaacttttgtgttaatataggagagtactagtcaggcgtggtagcttacacctataatcttataattctagcacttccggaggctgaggcaggaggattgcttgagcccaagagttcaagaccagcctgggcagcatagtgagaccctatctctacaaaataattttaaaaaaaattagctggatgtggtggtgtgcacctgtagtcccagctactcaggaagccgaagagagaggatcgtttgaatgagccaggaggttgaggctgcagtgcacttcagcttaggtgaccgagtgagatcctgtctccaaaacagaagggaaaatacttatttttaaatttaaagatataaaataattataatctgtgtcctcatataattcattatcctcaaataattcatttttttgccagcattagatatgactatgcagaacaacagcaaaaaagcccagaataaaacctatcgggacaaatcgaatgttggaatgtggctgggcatggtggctcatgcctgtaatctcagctactcaggaggctgagacaggagaattgcttgaacctgggaggcggaggtcacagtgagccaagattgtgccactgactatactccagcctgggagacagagtgagaccctgtctcaaaaaaaaaaaaaaaaaaaaaaaaaaaaagacagaaaaagaatgttggaatgtttaagaaaagtattcaaggaacaattttcatagaactttttgtccagaataatacatacagttttgtaaaataaataaataaatatattctgccatataccataataaatttggaaccatatcagtgactataccaagaatttataattatttaaatacacatgcaaaaaattttcatgttaaacttagcatgtgacatatcaaaaccaggatttgacaaaacaaaataaaaagttaatatggtttaaaattttgattaaagctagtatgatctagtagagtggtttttttaaaagaaagatttatacaaaaatattttccaattaagtcttccaaaacgctatagtcttcaatgtcttttgagatttttttacactttgcatacatcttatttgattggtagtacaatttcagttcctgtaggttacttttttttttgagaccgaatttcactcttgttgtccaggctggagtgtgatggtgccatctcggctcactgcaacctctgcctcctgggctcaagcaattctcttgcctcagcctccctaatagctgggattaccagcgtgtgccaccacagctggctaattttgtatttttagtagagacggggtttcaccatgttggccaggctgatctcgtactcctaatctgaggtaatctgcctgccttggcctcccaaagtgctgggattacaggccggagccaccttgcctggcccctgtaggttatttttgcatttcatttgttacagataccaacatatactttaagataaactattttgagttaaataaagattggaatatgcttgtttggttttttccctttggagtaaacacatcagaattgccttccattgctgtcggattacagtgacactttagagtctggagggtatagactctcctcatttagatgccactaatctgcgtcttctccaccccgcagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaaggtcagagcagtgactttggttgccttttagtcttgtgtgtcatgtagtcatgtgtctagccatcctgattgctgggtttcatcctctgtaactggtgagtgtcatggttggtgggatgggatgtggcacatccgccgcccccctgcccccctcccctggccctggtcatctactgggactttgaagggcgctgccttcagggatgggcccttcccctccctcctcagcattgaatgggatttaggtgttagttgtcctggctagggcttggttgcatttttatagtgtttggtaagcaagtctagaaaatgatttctagtggtttagtaagatcagagatccctagactgaaagagaatcagaacaaaaaaagaaaaagcaggtgacaaagttgagacagagttgacttacagttagtttatattttcatttagcttctgatttacatagccagaatcctgtaattcctgtataattaggaatgctctcaaggtacatagttaacagggatctgggttcattgaatgcttttggggtgtgtgctgattggaaacactgtcccaggaattcattacacttcttggtatggtgagctcttggcaagggattgacccttctcatgtatttccttaacttccttagagaagtgacataggctacccaggaggcagcagggacatcctttactgttgactgaaatggtgatgaatctgccatgggagtggaccataacctggctccatgtccggatttaaccctgtctctagttaatccctgctggagcccctgttcacacagtctgatttcctgggctctcagctgtcccccaaggggtgttcctccctcccggtctcattcaagctgaccctgtgctgggaactcagccccttgccctcctctatcctcctcatcctttggatttgggacctggttctgctgccccgtgaggccatccctgatggcttctcttctccctgagttctcgtccttcatcctgccttcctgtgccgtgcaggacgtgccttttcttgggtccactgccacacgcctttctctttctagccagcctcagctctcagtggcactgtctcaggaatggggtcagtaaatccttaactgtcctcgtgagtggtggggagggggactttatcagaaagaggctcctcgccatttataatacaaaaaaattagttttaaaaactgtttagagaatagacctcaactgtggtttactaaagtctgatagtacaacataattaaaaaataatttatgatattaaaaggatatagtactatgattataatttaaattataatttataacagttacatacggcctactgttaccactcagaaggggtcatgagtgcaattattggacagatgtaacagggtggagtctaagggcacagaggtctccctgcagttgtgctgatgtgcacaagagaaggaggggcagttcttttgtgtgtttcacctgggcccgagtctggggagcgtcttccctctctgatagctgcacccccttccctagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggtaggattttagtgaggttgttagctggctgcttccctggaagcagtgggccgtcattgggttctctgtactcaagagtgggctctgcaagatggaccagtgcagctctctgtttaattcatcttcgtgagtcttctggtggattgaaatatgtaaagaaggccgggcacggtgtctcctgactgtgatcccagcactttgggaggccgaggagggtggatcacttgagcccaggagttggagaccagcctgggcaacatggtgaaaacccatctctacaaaaaatacaaaaattagccaagcatggtggccgacacctgtaatcccagctacttgaggctgaggcagggggatcacctgagcccagggaggttgaggctgcagcgaggcatgatcacactgctgtactccagcctgggtgacaaaatcagaccctgtctcaaaaaaaaaaaaaagaggaaatgtgtaaagaaatactgttggtactgaatggacattattttgcagccttgcctgtttttcagagagccttcacgagggttatattctttttttttttttttttttttgtgatagagtcttgctctgtctcccaggctggagtgcagaggcacgatctcggctcactgcaacctccgcctcccgggttcaagcaattcttctgtctcagcctcctgagtagctgggactacagacgcgtaccaccatgcctggctaatttttgtattttagtagagatggggtttcaccatattggccaggctggtctcaaactcctgacctcatgatccgcccacctcagcctcccaaagtgctgggattacagccgcgagtcaccgtgcctggcgagggttatattcttaataagttgatgactgattaaggcaggtgttatggttactatacggccaccattgcttccagtgagaacctctctatccaggaaagatcttcagttgcatagtaaagggatattgactctaaaggaaagatataggtgtttgctccaccctacccaaagggaaaaagaagcagataataaaggaggttgttttgaaaacacttgtatatttgtttattaaagttcatatgttggccaggcactgtggctcacgcctgtaatcccagcactatgggaggctgagacaggcagatcacttgagtcctggagtttgaaaccagcctggccaacatggcgaaaccctgtctctactaaaaatacaaaaattagccaggcatggtagcaagccccctgtaatcccagctactcaggaggctgagcaggagaatcgcttaaactgtctcaaaaaaaaaaaaaaaagaaaaaaaggttgatatgttaaagttagtttttcctacatattttgctgttgttactgatttgtgatctggttggtaattgttggagggttagggtgtgtgtctcaaagcatctgcccctttaatagcaggtagttggccccagataggagtcagagtatgagctttagatgatggaggctcagttactcctaggagtctctgttcaaattagattggagactgcagctaggactgagtttgaggttgggatattttccctccctgtcctgagatttagatcttgggcttcatctaggctggaagaagatggcgtaggggccaggtgtggtggctcacacctgtaatcccagcactttgggaggccgaggcaggagcattgcttgagcctaggagttccagatcagcctaggcaacatggtgaaatcccatctctactaaaaatacagaaaattagctggatgtggtggtacatgcctgtagtcccagctactcacgagtttgaggtggaagaatccgttgaactcaagaggttgaggctacagtgagacatgattgaaccactgcactgcaagctgagtgacagaacaagaccctgtttcaaaaaaaaccaaaagataaagatggcataggccgtgggtcagagtccctgctggtcacctggaggattgatgagagcctgcctttagaacagtagtattggttctacaaggcaaaccctgcggctgacccagggtgcatgagcagcttgtgggagaggaggaggaggtggttcttaggccttcttaccatccatgaggcagatagcccaaaagagacacacacaggctcaaggccacaggaaccaccacaggcctccagatgaatggcacagggtcagcctctcccagtcccatcaaccagctaaggccatgcgagcacagcaggagggcatgcttgttcccagggctgccccctcctgaggacacccaagggttgggtgggcctggtggagggtagatgaggtgagaggtcttagactacttttctgacaattattaagaagcctgtttgaatctacgggaacgtaagagaaattggaattttgcttggtttagagaaaagtaccaagattttatgttaaggagtattgctagacatgaatatttggcattgttaaatggaaggtgatttaagaaaatagatttatggccgggtgcggtggctcacgcctgtaatcccagcactttgggaggctgaggcgggtggatcactggaggtgaggagttcaagaccagcctggccaacaaggtgaaaccctatctgcactaaaaaaaattagctgggcatggtggtgcatgcctgtaatcttagctgctcaggaggctgaggtgggaggattgcttgcttggacctgggaagtagtggttgcagtgagccgagattgcaccactgcactccagcctggttgacagagcgagactccgtctccaaaaaaaaaaaaaagaaaagaaaatagacttacatagtgacctgtagtaatttttaggacctctgataattcagacaaaaaatggggggaaatttacagttttttgcgacagttgagtgcggatatttcttaaatgcggagtccacattaacttaattcttttccatagtcctgtaatggaggtgccttcgtgatctgtgtttttcctttgccaccctttctaatgtaagatttgaagtgtatgagacaatttatgtcatgtttgtaagttataaagcctaataaatagacttaaaaacctgagaagttgccatcccacccaggactggaacctcactgctaagtcgcatccacctgcgtgctcctccccacccatttttttttttgagatgaagtttcgctcttgttgcccaggctggagtgcagtggcgcaatcttggctcaccaaaacctccgcctcctgggttcaagtgattcttctgcctcagcctccccagtagctgggattacaggcatgtgccaccacgcccagctaattttgtgtttttagtagatggggttactccatgttggtcaggctggtctcgaactaccgacttcaggtgatccgcccacctcagcctcccaaagtgctgggattacaggcgtgagcagcatgtgcctaaacaagatactgcttagttttcttgttttggagctctgcagcacttataatatgctgctatttatattccaggagcatggatgaacatttatgtttacacaggtactttctttataaagacataaaacttccttggaagaacatgcaagactaataacattggtttctccaaagaagggagaacggtgtgtttgggtaacagaggtgggaggaaggattgttgccaagcagtgttccatcactttgagggttttttttgacatggagtctcgcccttgtcacccgggctggagtgcagtggtgtgatctcagctcactacaaccttcgccttctgggttcaagtgattctcccacctcagcatcccaaatagctgggattacaacagcctgccaccacgcctggctaatttttgtatatttagtagaggtggggttttgccctgttgaccaggctggtcttgaactcctgacgtcaggtgatctacccgccttagcctcccaaagttctgggattacaggcatgagccactacgcctggcctcccttttgagttttgatccgaacctcgtgaaggcattaccttaagaggaccttaatgaaagcacgctgattttcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggtaagctctgtgacaatgtcgtttcgttttaagccttgtgaagatactatgtttcagtctatgtgaaatgttaattagacctgtgtcttaggcaatctctgagtagaaccagttgtatcaggtgatcggcctggttggcacaggggctttcctaatgccaggagaccagtggaggggtgtcacctgagaacttggtactctggagcagccccctctcctggtgaccaagaggagatgccagcccatcccgccgtgaactccttccattctgatgcctggcaggcttactgagaacctgagttgagtccatgcctgtctgtcttcgcagccacacgcagtgcctcgctttctcccattctctatccaaacgcagctcgcactgtctcattcctggctctcatcccactgccaacagctcctgggtctctgttaggccctttagagatcctcgtttttactgtgtaaaaagcagacagtgcccccgcaccctgctggagtgtcctgcctgctgcctttgccctgtctgtgttgaacacccaccgtctctcctccctgccctgctgacttttctgctccctgtcctagttctgtgtcagcatcattccatcgtcacgttggcttttccctctgactctgtcaccagtccttccccacatggtggcagcatttgtttccatgtctttgcaggacatcatctagctgttgtgtattgggtatttttttaaggatattatcgtaatgtttgagcggatccacgtgagttgggcatttcagtaagctggctgcctgctggggtcctgagcctcttgcagatctgatcttcagccagcatcgtgtggcctggaactgctccaggccctccctttgctctggctaactcctccctgccctgttgcatcattgtgtagtactgggtgtgtttacctttgtagaagacgtgtgcccatgtagtggcttctgtgtccataagtaaacattggggagggagaagctggtacagataagcgtcactctggagttgttttctgtcatcatctcagtcagcctgtcccccgcaacttcctcaagcctatgcctcatccccagccctccccaactcctgccttatgaagcactgttccctctccagcctcagggtgggtgcagtctcagcttctaacccaaaccttcatccacatactttccaaatgaatgctactctcctaagagaattggatggctaaaattctgtcttttgcgtattttatttgactctgtatagacaaaaagctccccccacccccaaaaaattccctttagaagtagttttgccccaaagcagctgaagtctggaagaaatcaggttttgcagaggtaggatcgtaaaggtctgggcccccttacagaggctcaccatggtgcctgtcaaggcattctttctgagcaggacgccatcctgccggcactggctgcagcacacctggtatagctcatagctaaggagcccatgaggtaaagggaaagatgagcgtggctaagccaagtgccagtgagtttccattaaaccattctgcttttggcacacttggcagtccttgattctttttggcaggtaattggctcatatgttatattgattctgaaaaataaaattttagaaagtaccaccatttacaactgctactgatcagatcacatgcagttccgcaataccctcgaagagcacggacactcaagctggggttcatccggggaggagctgttgtcatgcttgtgtgcactgcgtgtctctaagcctggcaggggctggtggggagggcctctgtccctgtcatcaccctctcctggttcctcacacagggcctgggtaaatttttaacaaagattagttatttgatttatatgtacataattattgttaaggtgaatgtcttggctgttaaaggcttcagattacttttgtgtgtggttgtgtcttcgccactatctcagtcaaccccatgagaatgaatagaataaaaatgtgtgcatgtagctatgtaggctttctgaaaaaaatgatgtcaacctttttctttcttaaagaatgagtttagtaaaagcttaagaaagccatctttcagttttgaacctaggcacaggaaagtctgctttgcagaaagttcattattattcttgttaggatcttgaagagcatgtaggtgaggcagaatctggtttaacccagcaaatcttccacaagaggctctccgagctcacttagttcctgtaatctgccattggctatttgaacatgaaattgttaaactccatcttggcattttaatttgaactgtgcaattccttgttttgtaatacttccaccgcctcttttggaagcttcaccaggtgaatacctattaaagctgtattaaagctgtattgtattaaagctgtaaagtgtgtacccactgtgctctcttcaaaagaaaatatgcatgagactggtgctgtggcttagttggttaaggcgcctgtctagaaatgtgcattaagattcttctgggtgattgagaccatcctggctaacacagtgaaaccccgtctctactaaaaatacaaaaaaaattagccgggtgtggtggctggcacctgtggtcccagctactcgggaggctgaggcaggagaatggcgtgaacccgggaggcagagcttgcagtgagcggagatggcaccactgcactccagcctgggcgacagagcaagactccgtctcaaaaaaaaaaaaaaaaaaggttcttctgggtgtggctgggcgcggtggctcatgcctgttatcccagcactttgggaggccgaggcgggcagatcacgaggtcaggagatcgagaccatcctggctaacacagtgaaaccccgactctactaaaaatacaaaaaacttagctgggcgtggtggcgggcacctgtagtcccagctacttgggaggctgaagcaggagaatggcgtgaacccgggaggcagagcttgcagtgacctgagatacgcgccactgcactccagcccaggcgacagagcgagactccgtctcaaaaaaaaaaaaagattcttctgggtgctgcagatgctttcagtgaaagcttttcacaatcatgtaatttcagcacaaactgtagtttctttgtgtcttggttgtaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaagtatgtcggccacttccttctgtgtggttgggtggatcctgttttaggaattggggctgcagagggcctcccaggtttcctggtgctaggagcaggctccttgaagtccagcagatgccatattatctacctactccttcttgttggggccttagagaaaatggaaaggagaactgggtgcttgagaattagaagggatcacagttgtcgcctgcctttattgtgtcttgtcacctcctccattagtttgtaagtgtgaagaaatcaagggtcatgtcccttctccctccctttgtctcaccattctgtccacagcagctggcgcctgaaaggcatgcagtggaccctctgcattttcatttcacagtgatctttctccagatatttctcatgtgatgtctgtatcttgctcttacctcttgagactgtgcatgaccttaatgtaatgatcttttgaggtaacacacacataccatttttctgcatcgtaagtttcaggggatggatttttcctatatattttcacattcttcactgcatcagaagtgatgctgagtatatagtaggtgctcagttgtttaaaggacattgaagagagaggagtcaaggtaaccaaatgcacaaggaagtaaagcaacatgagtaagagccagcagaatcaatggaaggcagaaatagacccacacaggcttcaggtgttaggattatcagaactaggttgtaactatgcttagaatgtttaaattaatgaaagacaaactggaaaatacctccaagaaacagaaacctataaaaattgcccaaaaacttagagagaacctttaagaagttgtcgaatacttatccagaacacatgcagagagagaaaagatggaaaattcaagagagagtaagagacatgaagagtagagggaagtagcatcatttacttttaacccctcaaaaagagcagagagacataatgactgagaatttcccagaactgatgaaaaaattaaacagtgtgcagatccgagatgttgagtgaatccaaagcaggataaataaaaagaaatccacagagacaaactatagtgaaacaactacaaatcagaaacaaagggaaaatcttaaaagatggcagaacaaaaagatgacattcaaatgaatgatcacttggaagctgtgaaagccactgaactgtggaataaacctttagtttgaaaaaagaattgccaacttagagtcatatatctggtgcagtatgacccatgaataaggatgaaataaagatgttttcagataaaaacagaaatctgccaccagcacatcttcagcaaagaacattctaaaggatgttcattcagacagaaagttcctccatggaagattgaggatgagggaaggaaaaagagccaagaaaatgataattcgtgaccaaatctaaatgggatgcagctaaagtgacactcagagggaaacttacagcctgaaaaaacgtgctgtaatcccagcactttgggaggctgaggcgggggtgggtcacctgaggtcaggagttcaagaccatcgagaccagcctggccaatatggtgaagtcccatctctactaaaaatacaaaaaaaattagctgggcgtggtggtgggcacctgtaatcccagctacttgggaggctgaggcaggagaatcgcatgaacctgggaggtagaggttgcagtgagccaggatcgcgccattgcaccccagcctgggtgacagagcgagactccatccaggtgttgctgaaattaaagcagataaattacccaggcctgtctgaataagagggaagcaagcagattaaaaatttgaaaagaagtcctagtggagtcatcagctcaggagttgggtgtcgtgacaccagatctgattttgcctttcagctttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggtgagcacgggggcacggtggggcacgggattggttctttgacttttataggtgctttaaaaacttgctcaggacattttgttgttctagaaaaagctgagtttggctgattgattttcggcttttattttccaattttccatttacgacattgataattggtatttcagtggtgggcactatatcagcttgaaagttactacctaccaagttttgtttgtaagatagacccaatttaataatacttctgtgtccaagtgctttgggacaagctgcctgtgaaacagacagtttgtgttcatactcactgctcaccttcctctgcctggctgtgttttccaaggccagtcttgccctccagaaacttctccatcacctgctccctgctctccaacccatgcctcgcagtctcccctgcgatgcccgtttctgctcccaggatcctcattctgctgttcctcctgcctggaacggctgctcacctccgtttcagtggctctcacactcttggtggtgaagggccacttgtatttgttcacttgtatttccgatccattgtaggtgatgtctttgtaaaagacaataaaaatggccaggcacggtggctcacgcctataatcccagcactttgggaggccgaggtgggcggatcactgaggtcgggagttcgaaaccagcctgaccaacatggagaaatcccgtctctactaaaaataccaaattagctgggcatggtggtgcatgcctgtaatcccagctactcgggaggctgaggcaggagaatcgcttgaacctgggaggcggaggttgtggtgagcagagatcgtgccattgttccagcctgggcaacaagagcgaaactccgtctcaaaaagaaaaaaaaagacaaaaaaaatgtcatgccactgccagttgctacataagtttctgaaaacctactgtcaatttcagcatctcctcccagaccagtcacagttcgtctgcagaccgcactggagtagcactgcccagttggtgtcctcaaagcccctcacccttaagatcaaccagcagagcacatagaattttcccctttaacttttcttggcctgacgggtcaatactgtacaatttagcactttgattgtttctcagtgtttgttctttgttaacattgtctttctggcaaaactaagcttctcagtaacttccaccttggacctgggtacctccgaggcattacctaataatgctgtggccgactgttctctgccatagctggatgccgttgctttttgttgttgtatgttaggaatatccggagcataacccatggtcattcccatattctgccccttggcctatttaataatttttttaaaaaatgttaccccattgtggttttctttattttttttttaatttttgttttgttttgctttttagatacagagtctcactttgttgcccaggctggagtgcagtggcgtggtcatggctcactgcagcctctacctgctgagctcaagtgatcctcctgcctcatcctcttgagtagctgggactacaggcatgtaacaccacgcccggctaatttttttttttttttcagacggggtcttgctctgtcgcccaggctggagtgcagtggtgcgatctcagctcactgcaacctctgcctcccgggttgaagtgattctcctccctcacccctcctgagtagctgggattacaggcacctaccaccacgcccgggtaatttttttggtatttttagtagagacggggtttcaccacattggtcaggctggtctcatactcctgacctcatgatccacccgcctcggcctcccaaagtgctgggataacaggtgtgagccaccacacccagcccacgcccagctaatttttaaaaaaatttttatggagatgcatctcattatgttgctcaggctggtcttgaactcctggcctcaagtgattcccctgccttggcttcccaaagtactgggcttatttaattgtaaaagattatgaaagtggcaaagtggcatgagccactgtggttctcattttgaactaatatatttttgagttatgattgagatacatgaaaataacacagtgtatcatagaaaacgttcagaaaaatacagcctaaaggcatatcagaccacttaatttacacataattgcagtttaacagaagttggcttgaaatctcagtggtggctttttatggagtttcttttttttttaatttattttttttttgagacggagtctcactctggcggccaggctggagtgcagtggtgtgatctgcaacctccgtctcctgggttcaagtgattctcccgcctcagcctcctgagtagctgggattacaggcgcctgccaccatgcctggctaatttttgtatttttagtagagatggggtttcaccatgttggactaggctggtctcaaacttctatgtcaagtgatcctcctgcctcggcctcccagagtgctgggattacgggtgtgagccgccgtgccctgctttttatggagtttctaacttcaaggaaaacattggggagttctgcagtttgagggacaagactgttctcacgtgccttcccatctctccttttaggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggtaaggaagggttgaggagtgtcttctgatttggagggtgtctgtacctgagagtggtccttctagaaactgatagtttaagaattgcggccagacgcagtggctcacgcctgtaatcccagcactttgagaggccaaggcgggcggctcacctgaggttgggagttcgagaccagcctgaccaacatggagaaaccccgtctctactaaaaataaaaaaaattagccaggcgtggtggcgcatgcctgtaatcccagctactcgggaggctaaggcaggagaatcacttgaacctgggagatggaggttgcggtgagccgagatcacaccattgcactccggcctgggcaataagagcgaaactctgtctcaaaaaaaacaagaattgcagtaacgtgttgtggtttgttcattttcctctccaggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtaggtgatgggtggccccaaacctaaccatgctgtttttgaaatggtggtttcctgaagaatactataagatccttctgcaaatatgctctcctagcagcatggtgactttgatactcagatttcatttcagcatcttcactaaaaggacagctcagagctcccataggccttctgtgggtatctaaatacctgtttgctttgataaagaacagttacaggccacagtgtttaccacagtgtgtctgaaaaggggaattctgcttctcatgtgctgtttccggaggagctgcattcttaaacctatgcagatatgactcacaccagtagaacatgatgggcattgccagcttatctggtgaatgcaggggtcacatttggatccacattttctgattaggtgacttagggactaaagcaccaagtgggtgccgtgaagtcacctcattaaagcagctggcgagaagggcatggaccccagtgacagtctttatggcagacaggtgtgcaggagacggcagttgcagtgggtggcatcgccctgctttcattctaagacatccctgacttgcaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtgagatttctgtcaccagaaccaaggtaatttcaacaaaacttttgagccttttttttaaatttgagttgaggtgatactccgtttataattttgtgtcttggtatctgtggggccttggttccaggaccctgcgtgggtaccaaaatctgggatgctcaaatatctgatgtaaaatggtgtgatatttgtatataacttatgcacatattctgtgtactttatttattgatttattttttcttttttaaagcttttttattttcattttttttttgagacagtctcactctgttgcccaggctggagtgcaatcctagctcactgcagcctggaactcctgggctcaagtgatcctcctgcctcagcctcctaagtagctgggactacagacacacaccaccacgcctggctagtttattttttatttttttttaacttttatttatttatttaattatttattttgagacagagtctcgctgttgctcaggctggagtgcagtggcatgatcttggctcactgcaagctctgcctcccaggttcacgccattctcctgcctcagcctcccaagtagctgggactacaggtgcccaccaccacacccggctaattttttgtatttttagtagagatggggtttcacagtgttagctagggtggtctcggtcttctgacctcatgatccgcctgctttggcctcccaaagtgctgggattacaggcatgagccactgcgcccagcctattttttttaacttttaaaattatttcttttctttaaggaaattatcatccagcccaaaatgtcattttcttctttgtaattaaaaaatttttttccagctatttttttttataaagatgggctctcactatgttgcccagtctggccttgaactcctggggtcgagcagtcctcccatttcagcttcccaaagtgttgggattacaggcgtgagccaccgtgcctatccttaaatttttatgggtacataaaaatttgtataatctcccatatactttaaattagttctagattacttataatacctaatacaatgtaaatgctatgtaaatagttacactttaatagtttgttttttcttgtcacgttattttttattttttcctcaagtatgttttctccttgcttggtagcatctgaggatgcagaaccacagacacagagggctagctctaccgttgtgcctgctctttatgacttgagatttgcaaaaaacagtgtacttcaagagagtagagggtagcattcctgaggctatagcacagtctggtagttttattcttgttttgttgtggttttgtcttttgttttggatttttttttttttttaatttttaaagagagagaggttacgctgtacctttaggaactaacatcttacatgcctctccacgaccgaggttttgcacatgaaatgtatctcccgttccctaatgagaagatatctgtaataactttggatctcaaacatggttttcacatttttaaaaagtgtttgtgtctcaaggggcagctggtgagtggtgcctcctccttggcttccccaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagaggtaggggggtggtggtgcggagtggtgtggatggtgatgacgtgtgtctgctagcctgtctttgtacgcgaagactggtcaggcagcattcagagaaggctcgggcggggacctgcaggtaacccactgacacctggcacagcaacctgagcaggtatgttgcgtctgggctcgggcggaagggaggtatggccagcagagacgctgatgtcttgtgagttctcagaactctgttagccccaacaggaatctttgcttgaatttagggcctcaaggttgtattttaaagatgaagctgcacccagttgctttaatcattcttagatcagctggcccggcacaagtgccaatttattgcattcattaatcactgaaatgtgccatgtgctgttgagaacatcacacaagtgccctaagttctgacagcaccccctgaagtgtaggggttgagctgtttgttcttactttgaaggtgtggaaactgaggcttagagtttgctgattacccaaagccacagggcaggtgagctggagagcttgaatttaagccaggactgttatttagagcatgattcctaatcactgcactgtccagccgagttcttattttttttagtggacttgatttgtcccttgacccaaacacggaccctggcagatggcatcttatgagtatttgtcactgtaaacattccagtgtggggtgctattagtctgacaaacaggaatgaaactgtgggtgttgccaaattataagcaacatctttagaatacagtagtggtctggtgatcagataaaatttaaaatttttatgggacatgaatcacacttgcagaggcattgtcagagtataccgtggcaaaaatcagaagaaagcaaattcttccaggtccatactgtctgaatttctgattatgaaaatttacctcttgacattttaaggtcctgtttttgcttggacatatggttataggatcatatgatctggctctgatctttataccttatcatttgtaaggcttgacagaaggtcaagacctttaggaaatgcataacttcccttggctgatctagagacagatgtattttaacctgcatggaaaactcctcactgcacttaagaccagagcctggcagtattgagggcatgaaactggttttccagatgtctctcagtgcctggctgcatcagaacacgtgcggatcttttgaaaagcatggactcgagtcctttccttggagattcaggttcagtccatttgggtgagacctgggaatccactgtctgaaagcttcccaggtgatgctgtgtggctgtgttggggttttgttttgtagttgacttctctctctccatacctgcacgcatatatacacgcatgcccttatatgtgaggagagtatttttgaaggtcatacaaggccctagcaacagtggtttcctctgggcagtggaatggggtgggtggcttgaagtgcttttcactctgtatccttttctgctgttttaagtcttttaccaggttggaatcttttaagggggaaaaatgatattagcctatactagttttccaggatgtgaatgaagagaagggggaaatagtgatagagcacgatatctgttatttagataacagatagagaaatatctacttgtgtggtaaaatatctggaaggatagccactggaattcccagtgatgttcagcttcctactttatgcttttctgtacttgaaaaaaaaaagtgtgttcacttaaatatttgaattatagcccatctgtttcttgaacacttgtctgaggccctggggaggctgatctgaaccaggaagagacggccctgccatcatgggatttgcagttagataaagtaaccccctgttttgaggagaaaaaaaaacgtgatggtatcagagtgggtgagaaaaaaacatggtggtatcagagtgggtgagaaagtgtctaagaattctttccactaatgaagtaaactgagttttgccttaaagaggctcagtcatactttgatacttaaaatctttaggatttgagcttagtttgtcagttgttaattgtgttgcagtgtgtggaagattgctgtgttctgttatttgcaaggttattatgtcttcacaggaagagtgggctaaatgaaattgttttatcttttgcagctgttgaatttgtgtgaggctgaagattcagctttaacaaagctgccctgttataaaagccttccgtcactcgtacctttacgaattgcggcattaagtaagttaatgaaaatctacggggtataaaagtgaaaggagactgaccacaggaggtctatagaaaaaaaaagtggccttttgttgttgtctaatttttatgactttttgtagtctttttaagatgggatcaaaaaattatttttgtatgtttatcaaactgtgtaatgagatgccataaaattacatgtgttgttaggattgaagtaattttgtgctttatagtaaagtctgttgttgttttatgaatcagacgttctggtttaaaaggattgtcgtatcattcatatggtgccagaatcagagtgtatatatagtaagggacatgacagccttagaagcttttcaatgactcaagcatttgttaatcctgcagtctctagcttttcactgggaaacctcagttatcattgtcaagcacaggaatgatgcaaagtgtaggaaaatagactagatctgtattggctgagatagaaacaatcattttctttctagtggggagtgaaggtgaatacccaatacaaacttttttggttgactctctcctgctttgttgatttttatgctcttaataacatatttccagaatctttcttgagttagaggtggagagcttagaggcagaccataatacctgagctagaagatggggtggagtgttccagacagtgcaagccaaagccaacagggggaccaggggtgactggcagctttcttcttctcttggggtcccttctttggggaactctcctgtgcctccttcctgttagccattgtgggtgctacttttgctagaatgaatgttacctgtcacctgacatagaaggttgaggtgtgtctccttccctaagaatatttgccttttgaaagtcttaaagccttttaccctcaaagctgggtagtgaagaaaggctgggctgtgtgtgtctgtcccctgcattgcctgtcactggaggaccagagaccgtgccatcagccttgttcagatgggcctgtcctggatccagccaccccattaccctatgaaggtgtcctgggataggggtgtcagtggggtctctcttcttccccctcaagctttcttcttctcatctgaagacgtaagatttatcatggcttttctggcaggctggacttcactcttagattatactcaacatgtggatggaagaccatgtgtacttttgtctttctcagggccaaacactaggaaagagggctcgtggttcatattttttgctggttggtaggagcctttgggaaagaaaattcagccgggggcagtggctcacagctgtaatcctagcactggggaggccagggcaggagaatcccttgaggccaggagttagagatgaacctgggcaacatagcaagacaccttctctaccaaataataataataaataaatacagagaagaaaattatttgggcatctttccagttaataatggaattgtcttgatttctctccctgaagatgcacttgctgcctgcaattaccttcctcagtccagggagaaaatcatcgctgcactcttcaaagccctgaattccaccaatagtgagctccaagaggccggagaagcctgtatgagaaaggtgagtgtgtgtgcgtgcgtgtatgcgcacgcgtgtgtgcacacacatgtgtgtgtactctgcattaagagttcttcctgtttattgctatataaacagtgtatgcctaaaaggctttatgcatgtggttattacacactaaactgtaataagaatatacctgtttcatagtcatactgagttttttaaaatattaaacagtaaagataagtctccatcatttcgtcataaatttctgaaatagtatatgattaatattccatcttcctaaaggagaacggaaacttgcagctaaggttgaagatgagttctgttctattatgaagtgtcctcagttgtctatttttctttacaacttttcttttttaatagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatggtaagccaaatgcatttaaacgctctgtaacaaactttcaaaaaattaaattattttaaaaataaataatgcagctgggcacagtggttcacgcctgtaatcccagcactttgggaggccgaggtgggtggatcgcttgcagttgggagttcgagaccagactggccaacatggtgaaacccctctctactaaaaatacacaaattagcctggtgtggcagcgtgcatctgtaatcccagctacttagggaggctgaggcaggagaatcacttgaatctgggagacagaggtcgcagtgagccaagattgtgccactgcactccagcctgggcaacgagtgaaactccatctcaaaaaaagaaaattagccaggcttagtggcacgtgcctgtggtcccagcttcttggcttggaggctgaggtgggaggatcacctgagcatgggaggcaaaggttgcagtgagccgagatggcatcactgcaccccagtctgggtgacagagcaagaccctgcctcaaaaaataaataaataaaaacaatgcattcagatggcttaaaattgaaaaggtgtaaaaggatgtactgcagaaagcctccctcccaccctgtcctccagctacccagtcccctccctgagacagccagggttaagactttgttgtgtatccttttagagatgttttatatatgtaagaggacatatgtgtatatattttttcctataaaagggggtacaatatatatatacacagtccttgcttttcccatttaacagccatcatttcatgtcagtacctgaagtacttcattctgctttatggctgcagaatacctcatgacatgaacttgccataatttatttaaccatggcctcactggtgaacatttagattgttcccagccttttcattatataccatgatgcactgaaagacttgttcataatttcacatgcttttatctgtggtgtacatttctagttgtagaatttctggatcaaaagaatgtatgcattttaatctttcaacaccttgtcaaattgctctccaaagaaatttttaccaatatacactcctacaaaatagataagtgtgccttctttcatacagtcttgggtgagaacattggaagtcctttgggtttttagaattaccagagaaataattatgcaggaaaaaacccatttgacagtgtttaaaattgaaatgtaagcggatggaggatttcatctgttagctttcttttgcattcaattttgcttctggtaaatggatttataaataataaacaggatttaatggtccaccactgcaaacatgaatgtatttttcatgcttatgtttcccaagtagcctttgaccatttgacgttttaagatactggagctacttttttatttttggtgtacctttcccccaactataaacaggagtttatatctactgatggacagataaggtagagattgcattatgtagagagagatattgcaggtatggatacattgtgtgtgatacagtgtatcacagtgcacagatacattgtatttatctacacatggaatgtagagaaatctctcatatatgaaagacacgtagctttttacctcatctatatgctagtttcttcatatctacaagtacctaaataataatgacccaaatactaaaattgtaagttatgccctaataatacattataattgaaaaacaaagtataatatggaagtgaattttccaaattggggactttcaccttaagcttccaaatatatgtaatacacatacacacctatcagtttccatatattccatatattcacaagagtggctaaaataaatatataaagttacatcacttcctaatcagagctcatccaataaacactttatcttacatcctgtattacggctgaggtgctttcacacatgaggcccatgagctctatgcatgtgtccaaatgtcctaatgcttttgtgtatgtctcctcttgaaaagtcgtctgtcattttttgctgcctttgtatgcttgcctgaagcagctttggtttgtttgtttatttttatttttatttttgagacagagtatggctctgttgcccaggctggagtgcagtggtgtgatctcgtctcattcctacctctgcctcccgggttcaagtgattctcctgcctcagcctcccaagtaactgggattacaggtgtctgccaccacacccagctaattttttgtatttttaatagagactgggttttcaccgtgttggccaggctggtgttgaactcctgacctcaagtgatccacctgccttgacttcctgaagtgctgggattacagatgtgagccattgtgcctggcctgtttgtttgtttatttgtttatgagacagagtctcactctgtcacccagactggagtacagtggcgcgatctcggctcactggaacctctgccacctgggctcaagtgattctcctgcctcagcctcccaagtagctgggattataggcacctgccgccacgcccagctaattttttgtatttttagtagagacggggcttcgtcatgttggccaggctggtcttaaactcctgacctcatgtgaaccactgcgcctggcccagcctgtttatttttagtccccagtctaacccttcagacctgctgtgagctgggaattcattcagtgaacattgttacccagatttttttttagtgcagtacgaagacagctgccttaatgtctgtagtttctgaccaaggccagtgttctttctgcctaaaataaatcacatgggttttgtgttaatggttcatttaggtgaattttttcctcccttttctgctctctgagtggttcaaactggaggagtttgcatccagacgttttcatccagcatccacctggacttaacgttgacggtgcctttgcgcttagtggcagaggtcttcctgaattacacctgcctgctgtgctctgccagaggcagtggtaagggacacacttttccctacttaatcatgttcttcagaaccaagttcagtcactgctggagctcttgttttccctcataagccttcgagtttaatagctcaagccatcagcagaattttaagagccaaggcaccttacttttagggtgtgcattcatgaaaacaaccctgaaaatttacctttctttaagagttttagagttttagctcttacatttaggtctttggcccattttgagttcatttttgtatatggcattagataatggtccaacttcattcttttgcatatgatgttcagtttccttaagattgagttacctgacatatgattattaagtcttttatgtggttcgttggtttttctgtttgtttgagacagggccttgctctgtgtcccaggctggagtgcagtggcgtgatcatagctcactgcaacctccatctcctgggttcaagcaatcctcccacctcagcctcctcagcagctgagattacaggcatgcgccaccgtgcccggctagtttttgcgtttttagtagagaccaggtcacaccatgttggcctggctgatctaaaacttctgacctcagttgatctgtacacctcccaaagtgctgggattacaggagtgagctaccgcgcctggccatgtgcttgattggcttgaatatttcctcatcaaactaaagatgaattttatatacccattagtgtcattttattcctttgggaaaaaaagaatggtgatgtggctggctgttgtctacccctttaattctgttactctcatttacatctttgtgtaaggagccattctggtaaggagtagggttcatgaatttctgttctggtgattaatatctttcagggaatgttgttggtaaaatgttgagtgctttgaagaaatgtgtgttattgtatgcatttctcaatgccagtgttccctggaacactgactccgcacgatgtcggtgtttcatgaagaccagttcattggccacgtaaggttgggaaacgcggcttctcaaagtttgacatggactgtaaggacattaaaggctcagagaaggcttgtcttagagaagagtttttaaggtgtccaaaccattgttccccattcctgttttactatggaaacctttttaaagcagcttgctaacttcctgtaggacttcggtgttgtgaagggcaggtttgaacaacgcagggtaataaatatgcaactgttattgaatgctcttcttgtggttttagctttaaggcccgggcatttgtctgcctggttttgctggacacagaggctggagcctggctaccaggtgcctgggttaagctaaagtctggggtctcttcccatacacttaaatgcagagtctcttgctgaagcatggccctcattctgcagagggaattgtggccctatggcactcacttgcacagttcctgaccaagtggggtccacatctatctcaccagccccttccctagggtccccattgtgcccactgctcccccgcgtggccaccgttccttctgtgctgtcagggcctttgccctcctcttctctctgcccttctgcttctggcattcctgccttctctagtcccatcctcagcaggaggaccccgaccccctcctttctcatccagagctggttcctgtcttcctcttacaacaccgtaattgtagctacacacagcaggcacctttatgtttacctttttcctcatcagaccacgggctccgcaaggagagggacatcatgacagggatgatgtcggccgttcatgtctctactgtgacacccagtgtgggagccgacacttccaagcactcagtgaacagctaggaaacaagttaacaggaagtaaaatggcagggcatggtattggaacacccgggagtcagggcgtttccttctgtgtcagagcaaggcaggctttttattttgaaacatgaacaaatgccagttattctcatcactagttagatggttgcgctgttttaataatggaaacactgcagttctcacactaaacacgatggaaatgaatgattacatagtagtttccaccagtggaatgcacctactgtgaagttgtgtctcaggatgtgtttttccaacagcaacatctgcgcaagtggatggaagtggtggtgatcacccacaaagggggccagaggagcgacggaaacgtgagtgacttgtttgtttctgggaagggcaccagccgccatgctgggtcagtgctaatgccgggacagtgctttcattaaaatgccggtcagaaacctagtttgacgtgattgtagtccttgtaaattgttaaacacatttgattggtattctgttttgcctatcttttctcttaattgctaaacattcctttttatgtttctttaaaatctcccctttggttcactttaatatgactcttctgttgagaattctggggggcttgaatgttagtatttcaattttaccagctctgctttaaacagtgtattttctagcctgtccttggcagctgctgtctacatggtggtgcgttcctcagctattgtttccattgctttccatcacggggtggtcggtaaatgtgtttaatcattattgcctgataaaaccaactggtttttgggactgaaagctttgaggggaatgtaaaaaggaatcccataaatactggcacgtgtgttttcaaggtctgcgtcatccaccccaattgtttgcccagttatatgactggcccttcaaagcacatttgtatggttttaaaggaaaaccgcttcagctaaatcttttaaagtgtctaatgtgggtcattaaagactttgtctcttaagaatgcatgctttctgctgttttaaatctaatattatttgtatatgtttattttttacagtttttgtttttaacttgctgtcctcgcagtggaattgccttttccatgagtttcataatcccagtgaaacatgacagcagtattcctattagggacttccttatagttcttcagaggcataattaacgtggctttttgtcctcgtgtgcctttgctggatgtgttccatcctaacttggatttttcttttctggctttattatgctttgttttgaccattgtgtgtcaaggtgttttgtttatgtaagtcttgtttcctactgcttctaaacagccaagtaagcaaaactaaaccaggatttttttaaagaagtgatatgccacgcatgaccctgttaaaggtttgctgtttatatatgtggaagagaatcaggaactcttcgtggaggagagcagagtatattaatgagcccaggctcctgggatgaggtgcaggtgtctgtgtgctgctctccctctctcatctgttaggtacttttgctttacattttatatttgtttttatagtaagctattaattttctggaactcagtcagttctagaataaacatttaaaaaaaaacctagtgggtagattcaacctcatttgaatcaaaaagatttaatataaagtccttaatgtagcctagtaaaaaaaaataaaatatttcataaaagttagcagattatttggaggtgggggtgcagttgtataggggatggagtcgtggatactgggaagtccttgagctcctcctggaacatttttatcctgtgattgtgttacctgaccatccagggagggtccagctctgtgaggttggccgcttgtctgaaactcagaggctatggtgtttgggggcttgtctgaaactcagaggccatggtgtttgggggcccagagacaacagggccatggcttcatcacctaagcctggggccaggccactgttcagctcttgaactctgaccatattttaatcttggaaagtagttagttcctgtttggtggaatccccaaatgacagtgttccgttgagacactataattgaagatatgctagatcgttgactaaagaaataagtcaaagctgccctcgagcatttttttttttctttgagacggagcctctgtcacccagcctggagtgcaatagcacagtcttggctcactggagcctccacctcctgggttcaagctattctcctgcctcagcctcccaagtagctgggattacaggcgcctgacaccacatccagctcatttttctatgtttagtagagatggggtttcactttgttggccaggctggtcttgaactcctgacctcaggtgatccacctgctttcgcctcccaaagtgctgggattacaggcgtgagtgacagtggccagcctgccctgaagctttggatacccctttgatcagagttctgccccatcactgtgtttaggaagcttccctttttaaccatgagcttgcaggggagaacgcgtgaccacttgttatgtgtatgcacacatacatgcgtgcacacacacacccacacagagctagttttaggaagactgcttactttacatgataacccagctgtccattgggtgcggtgatggcctaaaccacctggacctcttctgactgtagccgggaaagaggtttttgttattttttattatcttagcccttcatataaaatttgttcactctacaaaagactttttaaaaatgtacttgcatacaacaaggtcttccagtttctcccctttcacaagaatcctgaaaccctattttgaaaacgtgctgtagggaagaattccactgttagacactctctgtcagatgggccgtgttttgacatcgaaggtgaaagtgtgctttttgctgttgagcatttgttaattactgtgtgctttctgataatttgtgtctttactgtcttgttaaccccaataacccttactgtgtttgagtatgtgggaagtttttatgtaaataacataaatagaaaaaagatgattttcctccccatcctcaggaaagcatttccgagtgcgggagatgtcccttgtctccattctgtcagtttgaggtgagaacaacctattaacagtcagtttctgacttgcaatgtgaagaaaagtttaccttttcttttcttttcttttctttttacctttctgttgccttttttcatgctgtaatttttgttttggttcagcctgccatggaaggggtagaggtgagaacttgagcggagctacaggagggggttgttgtcgttgctggttttgctgtgactcgttagctgtgtcgtggttctgtactggacagagtgcgttgtgcccttgagtgcagtgacctgtattgtctgtctgtggcagagttgtatcagtatcattgctgtgaactgtctgatgccaagcatgttttctattaggatgttttaagcaagactcttaagttcgtgtgagaattgcaatgtctcaattatattcaagattgaattagattttgtgttcgtaacctctatctgaatacacatagctagcaacctcctgagaggaaactcacagagtatattgtgcctgctagaagtgggaggaattacatgttctttcacactactgactgccctgaatttaaaaccttacagcttgtcccactcacccacccagtccccttcatctccctcttgcgtgcacacacaccacacatgcacacacaccgatgcactcacaacacgcgtgcacacagaccacacgtgcactcacaccacacatgcacacacaccacacatgcacacacaccagtgcactcacaacatacatgcactcacaccacacatgcacacacaccacacgcgcacacaccacatatgcacacaacacatatgcacacacaccacacatgcacacacaccacaatgcactgacaacacacatgcacacacaacacacatgcacacataccacacatgcacacacacactgatgcactcacaacatggtgcagcattgcacacaccccgagctttccctcttgtgtaaaatggggatgatggcatctgttactcctgcctcccagtggtgttgcaaagacccaaagaagtggtttctgtgacagtgctttgaaaatgaaaaagcagattgtaaaagtaccattttagaatgttataatttcaggatagaacttactcttcctaagtcttgcagattctggggaagagaattgtagggggcatggagctggccttgagcccattttcctcattttgtctccatctcctgctttgccttttggtgtaaagagaaattctgaaaagtctctcaggtgctgctgggagtggggcccttcctgatccgtgctatcatccccttcttaccccgaggatcgcagcgcgcacagcgcagcacggcacattggaacgtgtccctcccttgtggccatggagaattcctttgaatgacaggagcaaaactggaaagtgagaagggaaagctggagcaacagcagcccacccctgagctgtgagacagtagaacatgcagcacccttggcatttcacacatctttgatttaattcagcggagcagtttgtcagctttatttttaggcctggttgacaaatacttagtaccaggatcagttgtttatatacattgatatttaatttccagggtaaatagttaattttttgaagaactttctctgctagggttttttttgtttgtgtggttttttttttcttttctttttttttgagaccgggtctcattctgttgcccaggctggagtgcagtggcacgatctcagctcactgtaacctccgcctcctgggttcaagcagttctcctgcctcagcctctggagtagctgggactacaggcgcccgccaccacgctcggctaacttttgtatttttagtagagacggggtttcgccatgttggccaggctggtctcgaactcctgacctcaggtgatccacccgcctcagcctcccaaagtgctgggattacaggcatgagctaccacactggccactgctaggttttgagggcaaaagacatctgtgcccttagaacttagtgtgttgagaggacctcgtgataccttggcaaagtagggcatcctcacactgctctggccccaggtggaatcatccctgcttctgtgaggggactattatggcagcctggtaaggtcacctttaccacttgtgagcacgcatgacagcaaacagcacgatcacatcgggtgtacaccgtcggcccctccacacccctacaatggacaggaatgctgaaggccacgggcagtcagtttccttaggacacagcacagttagaacctaaggctagtaagttgtggcttttacatgtgaacccttcgcttcactgcctagccttgccaacatagttagactatagtagggtctgtagtgacgttgacctctgtcacttgcaaaattaatcgacctgtttataatttctggttttcttgatcaggaaatgaagatttgctcagcaattataaacctttttcatctgatcccggctgctcctcagacactggtgaagcctttgctagaggttgtcatgaaaacggagcgggcgatgctgatcgaggtaagggccatactgaaggctgcttctcgctctgccaccctccggtgcttatagcgtcctcacttgatcgtattttcaatggacggaacagcataaagacgttcgatgtcaacatttgcttgtgggtgttcatgcactccagtaacaagggaccttgttaggtagacagcctcaagctctgagaagaggaagttgtgagatgcagcattcccacatgttttgcaggcggggagtccattccgagagcccctgatcaagttcctgactcgacatccctcgcagacagtggagctgttcatgatggaagccacactgaacgatccccagtggagcagaatgtttatggtaagagctgtgagcagctggagtcaggggtcccttcaaatgcttgtgagctgtcgtgctctgaaatgttcagttcatatttcactattcagtgtcctggctgcttttttttcagatccatttgaatattggaaacagcattgctgtttggttgtgtctgtgaaatgtgcaggtctaggaaccactctttataggactttggtggtggtagcaaataaatgttctgccaggattataaaatcataaagtatgattattatttaaaagtattttctaagggcccacacctgtaatcccagcacttcgggaaactgaggcaggtggtttacttgagcccaggagtttgagaccagcatgggcaacagagtgagaccttgtctttacaaaaaatatgaaaattagccgggcacggtggcacatgcctgtagtcccagctcctcaggagcttgaggtgggaggattgcttgagttcggagttggaggctgcagtgagctatgattttaccactgcacttcagcctgggcaatagacccaagactctgtctctttttaaaaagaaaaaaaaaaagcatctttttaaaaagcatgcgtgtggtgcttttttggtaagccttctttgagagatttagaaagatttttaaaagatttagaaagatttaacattcatatcctctaactttctgtgagtttgattagcttaaaacggcttttctatttgttttgctttcagagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaaggtagcgccccttcctccagcccccaatgcccaggggtttaatcgagacacggttccctaattatctcttctttgacagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaagtgggtgcctcctcccgccctgccccgcgggactggctctgtcccaaaagctcagccagagcctccttctactctgtacaaggctgtggtcattggatgcgtgcagtcagattggttgtggagaatgggctgtgtctctgagctgtttaaaggcaagtcagaggcgtagttgttaatgaaatttgctctaagttaacctgtcttcttcttttgaccctccagaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagtgagtcccactcttatgctgtagaagggtatgggtatttggtctggttttctagggaactttgggcccttttctttttttgctgtgtcactcttgaataaatagtagagtgagccaggtgctgtggcatgtgcctgtaatcccaggtactcaggaggccacagcgggaggattgcttgagctcaggagttggaggctgcaccgagctataatcacaccactgcatcccagcatgggtgacacaatgagactctgtctcaagaaaaaaataaaattagtgggctgggctgtaggtgagaaagtgccgttgctcaggagcgtcaggtgcatgcaggagtgacccagtgttgaagggtggtttgttaattgccttgtttttagaaaatggcttgtttgacatgaaaagaataaaccaggctgacatctcttttccacaagtttttaacctacctttctagttgctctttgcataggagtcaaggttggtagtcacaccctgggttgagttccaacttgatggtgtgctaaggccaagactagctgttcttcccgtcttaagaaacaaacagcatggctttgtttttctccttctttatttaaattttttttgtaggttctgcagcatatcttgaatcctgctttcttgtacagctttgagaagggggaaggagagcagctcttgggacctcccaatccagaaggagataacccagaaagcatcaccagtgtgtttattaccaaggtggtatcactatgtgtgtgggtgtgagaagtagcctggcatgtggatgaacatctgtgtgtgtgtgtgtgtgtgtgtgtgtgtgtgtgttaagggggttcattgaaataagtttgttccgccaacacgtttatttttcatgattgtgttagtttttagcagaccgtcaccttaacgattcttgttagtgagtttttgaaggcagccttactttggaatgaattaactttcccacattaatagatttagtcagaaatggaatagatctcaatgaaaattcatatagcagttattttgtgaaaacccctgttgccggtcagcagagtttctgtgttccattttcatcttcagttttacaaaagactctcctaacagccagtgagcatatgagactgcctgcagtagctgctgtgactcctccttttccagtgaatgaaaccctgtggtggccgtagtccagtctgaaatgagctcggttttaatatctctgtgctttacagtttgtgttagagagggctttttgaattaaatgcctgcatcatgttatttccccaaggcttactgtattgatcttcactgttaaaggccgtgtttgccctgagattctcacactgagtgtttgttggaatgctgagtgatggcgttcctcatcagaaatacagattgctggttttcttatccattttgtcctgagatcaaggcagaggggactgttgtttccattggcagattcttggaccttacatagtctttgtcctttcagctgggcctccttcctgaagtgttgacattccaccctatgatcagagtgagcccaagggtttattcttggtccccgtactgatatttgccttattctgggcaagtgtagggagatggggtccagacaggaccccttcccctttgttaccttctccaggctgtgtctcctgggtcagatgctgctgtggggattttgaacgtcaggatgaggagaaaaggagctggcaggctggaggctgtggatgcaggtgtgggcctgccaagaagcagtacatctggggaagagaggaccttggggctaaaagggaccttgataaaaacatgattatagtggaagacttcagtctgtctgtttttcagaattattaagacctggtagacagacagcggttaggatacttagttgaattgaatgatgctgccattatacttgatttaatagagatgcgtagaatattcctcaaagaaggcacatttttttcttatgtcaatgaaacacttaaaaaatctgtcagatgctttcaaaactgcaacaattttttgaaagtagacatttttccaggtcacattttctgatcataatgcagaaaaatgaggagtagacaaaagttgaccaggaaaaaacatctcaactacttggaaattaagaaactcagtcctaaatcacctcgaatcaaagaggtcttcttttccacctcaccctcctccagcccctgcatcctgactcttaagcctgccctattttaaatgttgaatttggtgaatttctaatccatttgtaaaccaaaaagtatctgagacggatctcaatcaatttagaaatttattttgccaaagttaaggatgtgtccgggagagacatttgtgcctttctctaaaaatggttttgagggcttcagtatttgaaggggaagagtgggctgaaggggaacgggggaaggtgtggtcatccacacgttgccaaagaaggggaccaggtaggggaagagtcagttctgtgttcatctcatgctcggtaagtcagcactttacgtaagataaggtgaacgtggggcagtcacctgtgcagatcgttaacctttcatctgtagctctccttaggaacgaaaggagccagtttcttgcatgactcagctttcagcttaatttttttccactgggcagagcaaattggggtcctggggtttttttctcctttcacatatatgtgaaggaaaatggataggatgttattgataacctccttgtaaaacttcatgttacattgtgtgtgtgtgtgtgtttttaaggcttaaacctgtcgtatgaccctcagtcagtaacccagttcacaactggaaatgagtccttcctgctgtccctgcacaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtattttgcaagcccctcctgtccgccgacatcagcgtgaatctcacatggtgcacttggctccctggtgcagtctcagcctctcctgttgtcttctcccaaaaccaataaaaaccatgaaaacacagacactgtatgattccacttagaagaccatagggcactcaaattcagagagacagaaagtagaatagagattgcgggggttggggagagggggtggggagcgagtattgaatggtgcggagtttctgcctgggaagatgcaaacattccggagatgatggggctcatggctgcacacagtgtgaaggtgccgagcgccactgggctgtgcacccaaaaatgggtaagatggtacattctgtgttatgtgtgctttaccacagtgaaaggaaatttgtggggaaaacaccccacactgtgagccctcccatgactgtccacgttctcccttcctcccccattcccactctgctctctcgttcctcaacagctttgcttttaaaaggaaaggtcacccttttccatctcaagcttctctgtccattgcattctggcttctgactctgacattccatggcagatgttataatattcaagggccccagcccacttctcttagccaaagacaataggtacttttggatccgtatctcatgagcttgttgctgtgcagctggtattgagcgcctcttcctggagtacctcggtggtttgggctctgaggttgggcaccccgggtttgaggctggtattgagcgcttcttcctggagtccctcagtggtttgggctctgaggttgggcaccccgggtttgagtgttgtttcttccgctcacacggtccatgccctttggcaagttaatgtctccgtgtgagaattaaatgtaatactccactcgagcatgtggcattatttaatcactgatagttcttctgtgagaccgtctttgacagctttcccctgacatctttctcttgtgaacctctgtggtgttgaactctgcaccccaatcaagccagaggtctctcacatcccctcccatgggtcgttgagctagaactccagcctcggggctgccctgccctcccccagttgtctcagacacaaacactcgagaactctgtgaccttctctgctcctccccactgcccaggcaccagcaggttctgcagcttctaacacccaccccgtcccctctaccctcagaactggtcttctctgtgttcccatgacctcacatcggggcctcacctctcacttgagtgactgcagctgccgcttctcagcgcctctcttgttggccctgttcactttatttcccatcctgcagtcggagggagatgagccatgtacctccctaactcgctgctggttaggcgggacatgggatccctgcagggagcttggtcttacctgtctgcatgtcctggcctagttcagcacgggcacgtagtaggtgcattataaatactagaatgaatgtattcattggtcaaaacttaacagaaagcaactaagttgtttcctaataagaaagtcctaagaagtttttaaaaaattgttttggaaaagtagcatgtcttgacaccaagggattgtcttcttatttcttaaagccttccttctcatcctccataaacgtctcttccctgttttaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtgtaggagggacggtgggctgcggggcgcgcgtcttcaggcattcactttgaacctttaccttgtcttgttctgcaataatcaggtggtcgttcatcttttagtaaggctacttctggttcattgattagtttgtgtatgtgtgtatggctttatcagcatggaaattgctgtaatatagagaatatgtcacaggtgtgtgtgtctttgcgtctgaggctacatttctgttgtaagtactgtgcccagttaacccttgtatgctgctaagtttgcaccttaaggtgggagatagtcctcattgactctagatttccatcacctgccttggaaagttattcatgttgctggcacctccttctctggccaaattaccctttttgtgggatttatttatatgtaaatgtttcttgtagatttggggtagaagagaaaggattgagttgaaagcaaattcttttatagtcacctcttagaggaactttgcttttgggtatgtcttaaacttttacaatgtcaagttctgaagtttgatacatgtgattagactcaccttcctgtctgaagagaatttgatttttcaagactgaagtatactattgtaatgggatgtaatgggatgtagttggggtgggggagggtgataaacacatacataaggcagtgagaatttcctcgctcaggttaggattcagaattcttgagcatcaagttgggctgtgtgtgtatgttggggctgagaggcatgtcgggggtgtgtgtgtgcacgtgcgcacacgtgcatgcactgtgggaccaagctcccatgttcccggcgtgatgctggccctgcgtccgcaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcaggtaggggtgtcagcctcaggggtgccccgatcgtcttcctttgacttctccctagaaatcagtcagtaaaaccaagcgcctgtgtgtttttaagccggattcagatatggacccaaattccagtggagaaggagtcaattctgtctcatcctccattaagagaggcctgtccgtggattctgcccaggaagtgaaacgctttaggacggccaccggagccatcagtgcagtaagatcatgtgcctctgtatgggtgctgcgcattctgctgggagttggttcgtttattccctatatttagaatgtgagctcggtgctcagctgcattcaggagaggaagctgggaacagccacggtcaccagattgaaactccaggacatgtcactcatgcaaggggttcccaggtcaccagacatgcttgcctcatgcgttcagttcataccattaaagttctgttgatgatggttgattacttgcagaaaggcatctagagaaactctttgaagtaaggagttgattaagaacatgtgcccatactgagatcagtttctgagaaggacatgtgttctgtttcacgaggcagccaccaagagggtcctgggtattgccccttgtggagtggtggccctaggagccctgagtctgaccccagctggtgtcatggacctgctggcttgtggacgcaggcctggccaccctacttctggcttcgtaggcctgaggctgagctcttctcccaccctcaccatcccccatcttatgtggcacccatgtctgccctcggcttctattagaaacctggcactgtctgcactttgtccattggcctcgctccacacatctggtccggagcaagtctcactctgccgcaaataactcatccctgccttcacactgtggtcccagtctctgtcacccctcgcagtaaccagatgggagctgctcaactgcctccctgttctctctttcgctgttcctctctccgcctccacttttattccctctttatttttcacaaagcagtcagacttccacaaaagtttccttttgcatcttgaatcaggggaagctgggtgaagggtacgtgagacctctacagtgtttttgtagaaatctcttgtggatcttacaatcctttggaagtaaaaagttgaatcaagtcaggttgccattccccttgcttgagccctcgcattgactgtggcctccagggcccgggtgaccaggccctgctgatggctcttggcccccagcaccgtctcagtgctcagccatgcgggccatccctctgctctcaatgcacccctggttctggccctgtgctcactcaggatgtgtcccctggccttttccctccactgggagctgtctctcttcttttttctcatggcccgcttcgtctcaacctaaagacctcccttgatgtcgtcttgggcctcgcacttttgttccccatcacatgagccactattttgttgactagccatctgccctcctgctggctgtgtcgacttcaccagggcacagaccacatctgtctttggtatccccagcgcccagagctgcctctgtccccgggaggtaccgcatacccattagctgggtgaaaagtcaagcctgggttggaaattagtgttgcgattctcttcctgcctgaaaggaggtccttttccaggtctttgggaggagccagtcgctacctggagcagactctctcctcgccaagcccattgacaagcagcacacagacactgtggtgaacttccttatccgcgtggcctgtcaggtacgggatccaagtgccctgcgttagggcttctgcagaccagaggctactgactaacaccccaggaggttatctgtggcaatttcatcaaaaaagatacagacaaaccaaggtctgccagctggttctgtcattttcgtatcaactgcacttgattttgtggcaggttaacatttccaaaatctacctgtgtcttataattgatctaatttttttggtttttttttttgagatggagtctcgctttgttgcccaggctggagtgcagtggtgcgatcttggctcactgcagcttcaactcaggttcaagcgattctcgtccctcagcctcctgagttgctgggattacaggcgcgtgccaccacacccagctagtttttgtatttttggtagagatggggtttcaccatgttggccaggctggtctcgagctcctgacctcaagtgatccacccaccttggcctcccaaagtgctgggattgcaggcatgagccaccgtgcctggcctgataggatttttttaaaaagcatttcactctttcagtggtaataaaataatgatgtgccttctagttgacggcatgttaacattggtggattatggtgggacatgatctcagctgatcatttaacttccaggtgttctttttgcatccttaagatgggaacggtacacagctcagtaaagggtgagatgatccaacctacagaaggaagggacatttagcagttttagtgctttgataacttgagtttatttatcattcatatcaatctatatcttaatagaatttttggaaattcatttctgaaactttatatttcaaagaaccattgtaaatgaaattttcctaaattttaagttcttattcctgttaaacaaaatagtatatcttacagttctgttgggaatttccaagtactgaaaaggatctgctaagtacctaaccagtagataattccttgcctccctgcagtgtgcagggaggtcctgtggggagccagcagggcccacaagccattgcaggtcaccacggatgcgctgcagaggagggggccgtgaggggtcatgagtcaggctggttggggaaggtgtccagctgtgtggaggtcaggcggaagagaggtggctgtgaggtgaagatctgagacaggtgtaagggccagggcacagttgagacgtgctgtcactggaatgactgtaaactcggatgcagtgaaatgccggctgtaactcggatgaattcctaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggtgagtgcgagtgtctgaagggccagggcagcgccaccgaggccactagcagatactgtcacctgggcagggactggacatttgtggatcactctgacccttatgcctaaaccccaaatctcctgtcccctttgccagtcatggcctctcccacattggcctccactgctctctccagggagagagtttgactaattgataatggctttgctcttgaggctttaggagttcgagaccagtctgggcagcatagtgagatcccaattctacaaaagagaagacagaaaattagctgggcatgatggtgtgagcttgtagtcccagctacttagaagagcctaaagcaggagggttggctgaacctgggaggttgaggctgcagtgagctatgattggtgccactgcactacagcttgggagacagagcaagcaagacctggtctcttaaaaaaaaaaaaaaaaaagaaaaagaaaagaaaagaaagaatggctttgggacttgagctttcatgctggccccaactacacgtaggagtgtttaaccttaatacagttctcttgcattttgtggactcgtttctaaaacttacctaccagttggcttgggataagcatttttaattgactgttgcaacaacctttaagatgagctttggatttttaaaacagatttaatgatggagctataatttgttatcaagtaccatgtagcacttaggtaacaaggagctagtcccaaaatgctaattatcttattttggtggctgtttttttgcttataaaaaccatgatcctgtgcttttctggtggcagcaaaagctattttcttgccttatccacatttggtttttctagttcttgacaggatttggaaacttttgctattgagattataaaacctattgcaagcacttgttattctggactgcaaaggccatgttgcttctatttgacctctgctatgaaccacgaactctgtcttctattttattctgtttctttggtttgtttttattaatttttagtgcttccatcatctgttagttgattccatgatacatagtttgaaagatgcttgtctttggaaggatatttgttttttgtttttgtttcgtttttttgagacagtctcactctgtcgcccaggctggattgcagtggcacagtcttggctcactgcaacctccacctcccgggttcaagcgattctcatgcctcaacctcccaagtagctgagactacaggcgtatgccaccatgcctggctttttgtgtgtgtgtgtgtgtgtgtgtgtgtgtgtatttttagtagagacggggtttcaccatgttgaccaggccagcctcaaattcctggcctcaagtgatccatccacttcagcctcccaaagtgctgggattacaggcgtaaccactgcgcctggcctggaaggatatttgtatttttgtatcttaagaaaatgggaagagaaaagcaaaattcattgcaggaacttttttagaattttaccaatttcaaaatattaatattgtttattatcgaatattaatattttagtaagtatttttaaaaaagagtttgagtagttatttaaagtgattttataaagtaatcattcttgtgaaatacgattgtcattctctagtggttttttttacttagtctccaaataattaatccagtgctagattttgccagactcttgtttctagaatttgttgtcattgagtgtttgtttcctctgtgagtggcctgtgttgtccattccaggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtatgtgacctttcccaccggtgcttttctttcaaagtggacggtgggcgcggagcttgctatgagagcgcttgtcctccagttattgtgtcgagcgctttgttatcactttcctttctacttgcaaactttcttttaaaaactgacatggaaacatagaatgggccgggtgtggtggctcacgcctgtaatcccagcactttgggaggccgaggcgggcggatcacctgaggtcaggaattcaagaccagcctgaccaacgtggagaaaccccatctctactaaaaatacaaatttagctgggtgtggtggcacgcacctgtaatcccagctactcgggaggctgaggcaggagaatcgcttgaacccaggaggccagaggttgcggtgagccgagatcgtgccattgcaatccagcctgggcaacaagagcaaaactccatctcaaaaaaagcatagaatggcagctctcactgaatgttgtctgctttggaaattcagttcttcatcagttgaatattatttttttaagctactaaagagaagtattaaaagtattcaaatgttgaacatttggcaggatcaaattttagcatgttataaataagtatatttcaaggagattctgttagcttttttgagtattctgcatatagctgtgtagaacgggaaccagcccagaggtgaggcccacactgtcctgcagggagagaagtgcccgtgccaatccctcctgatacccaagcagccagcactcagtccctggcatcagcactggtgggcccaagagccataaccacagtgcctgggtccctgccctgttgtaggtacttccagtgtggcctccaaatatgaagagctggagtgcctctacgcagccgtcggaaaggtcatctatgaagggctcaccaactacgagaaggccaccaatgccaatccctcccagctcttcggtgagtgtgtgtctgtcctggtgttcgtggtggctcagtttggcctctttccccgctcactggacgtgcttccctttgggaaagggctccggttgttgggcagagctttgagccgctgcgttgttcaggtgtctgttgcctggggccctcaaggccgccgtctcctgtagactgcatcccccttcgccgatgcttgctctgtgctccctcctcagcttccagcacaggctttggtgtgagggatgttgccagggtgcatgtgtcctgccaccccagtgtcacactaaacaggcaccgcaagagctacatgacaatgtgtggactctgcctttcaccaccagcctgcctgtgagtcagccactcacaagatgagaacttgtcccgtcttattgctgaggctctggctggcccaggtgagacggaaactgcctccctccttaggtgatcagggcagctgggtcactctggccccaggtacgcaggagtcagatttatagatgtgccctcagttttgtggcagacacatgtctttgatcctagactttggattagtgcctcaaaatttattttctcctttattgcatattcattgggtgaaactttgaaaatacaaatgaaggaatactaagtagaagtcacctgtcaggctctcttcccaatagcaatcagtcccagtattttagagtgattatcatattctatacacacgtatacaaatacctatatagatagcccttgttaggcaaacgcttttctgaatttgccaactgaatatatttggatgagttccttgctctccaaacttgccaggagctaggagaatttggttaacatggtgtcccttgctctcttagcttgctgtctctcttcaggcagcagctgggtgcggagagtgaggagtgcttctgggtctttttttaagtggagtcaccctgcagaagatgccagcttccatcacagggcagcacaagtatctcctcccgctgctcattctctggaggactcttgttgagaagggctgacctcatgggccctgcctccctcctctgtggggtgtcgaaggccggggcagcctcggggtgaggtgggcctaggaagttggccacaccgtcgtccccatgccggatctggggtgtagtctcagccgtctgctccatagaggagagcatagcactcgggaaccacagagtacaccccatttccatcactgtcatcaagtgtcatgggttgcctgggttacaaccagactggtcttttgttgactgctctgttaagaattggtcttttaacaaagctagcctgaaatcacctcataactggcaaacactctttggttgatccgtgaatacagatttaaaatttaacgagtagggccaggtgcagtaactcacgcctataatcccagcactttgggaggctgaggcaggcggattacttgaggtcaggagtttgagaccagcctggccaacatggtgaaaccccgtctctactaaaaatacaaaaattagccgggcgtggtggcaggtgcctgtaatcccacctactcgggaggctgaggcaggagaattgcttgaatcctggaggcagaggttgcagtgagccgagattacgccactgcactccagcctgggtgatagagcaagactcgacattaaaaaaaaaaaaaaaaaaagtttaatgggtaggttgaaatcaaggtgattgtcacaatgccaaatatgaaagataattctactcagtgtttctgttctagtattggctttgctgatttttattgatcttaggctgtttctcagaatgaagtgcaaattgaattcaaagatatttggcatgtcctttagatagactagatttttcttcctctttttcttatttttcccaaacctattataggagtaaaaacttagggtaatttgccatcacccaaaaataaaatgcagaactgaaggtaagaacgttgtttctactgaagcacaaaaatcagttctcattcatgatgatttgatctagttgagaattaggagtggaaatacagtgtttcattcagaatgtagcgtgagccatgtaaaagctcacagtgttgacactgggattaactatgcttttgtcagaatacattgttttgaataatgtgttgctttcactctgtttttcgtggttgttacttttctgtgaaacacttggcaatttctacattttagggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtgatgtgctggccaccgggggcctttcctcagactctgttgaacagagaacagactctgttgtgcaggctggggctgaactctaaagggaatgtgcattcaccaagtcctgttgtttggtcgtaaatcgttaccatttgctcttcaatgtaggggtttaaaaaacaactcattgttaaaaatggactgttattaagctgggtacggtggcacgcctgtggtcccagctcctcagcgggctgaggcaagaggattgcatgaggcccagagttggaggctgctgtgagctgtgatcacgcctgtgaatatccactgcactcagtctgcaacagattgagactctctctcacgtgtgcatgcgtgtgcatgtgcacacacacacacacctgcttttaaagtctgtgagtgtaagaatgcagaaattttaaaatagttggacttttagatgctgcattcaccactgagacttaccagtgcttactgtgaaacagatactgcttaatcagagttgctggttctgaagagttaagtcacaggctccagagctgagcagtgggctcctggaatctggatgctgtgtgggggtgtggggctgcctggcaggggctgtggtgggcatggcttctgggtgcacctcagagtacaggggccatgattaggacttcacagctgggtgtggagaggccggagccacctgcactggtccgtcagctccctcatccctctccctgcagagagggctacatttccaagatgcacgtaagaacatatgagtgcttcaaatcccagagctctagttgcaggaaaaaacattgagggggaaaatgggcagaacccagcatgccaggcaaggcttagtggctgcctgtttaaatcaacgtttagagacccgtgggtttgttcttaattggggcgagcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcaggtgagctgggacggtgtgccatgtgatctccctttcaataaaagaaaattcaagcctcaacatcttggtctttctgaaacttgaagcaaaacatttttttctgctgtaattgcactcacagcatcttttcttaattaagatggatttttgtctgtaatctcagcactttgggaggctgaggtggacagatcacaaggtcaggagattgagaccgtcctggctaacacggtgaaaccccgtctctactaaaaatacaaaaaattagccaggcatggtggcgggcgcctgcagtcccagctactcgggaggctgaggcaggagaatggcgtgaacccaggaggtggagcttgcggtgagctgagatcacgccattgcactccagcctgggcgacagagcaagactctgtcttggaaaaaaaaaaagaaagatggatttttttcagtgcacttaacagatgttaaatagaaactgagttgctcatcttaatgtggctttgctcctcttaaaatgttaaatgaagactcactcctgtcatcccagcactttgggagaccgaggcaggtggatcacttgaggtcaggagtttgagaccagcctggccaacatggtgaaaccccgtctctactaaaaatacaaaaattagtcaggtatggtggcgcatgcctgtaatcccggctgctcaggatgctgaggccagagaatcgcttgaatccaggaggcagaggttgcagtaagccaagatcacaccactgtactccagtctgggcatcacggcgagacactgtcttagaaaaaaaaaaaagttgttaaatgaaccttgttaacctttttatggcgataaagataagacaaataatacttaaagtaaaagtaataatagagactatcatttcacttagatgcttgcaaacttctgatttgttttataatttacagttgctttctctctaaaatgagttgtagcccctacgaaaattacattggcatgtcttgattttaagcatccaaagataaagccatctttgccttactgtttaggaatgaccttgtcttattgtgcttgataaaattgtaggagcttaaaaaatactagagcagatggttgaaatacttttaactgcgtcttttctcaaatttcatacagacacctacactccgggagaagtccattttgcttgtgaagatgatgacttacatagaaaaacgctttccggaagaccttgaattaaatgcccagtttttagatcttgttaactatgtctacaggtaattacagcaattaatcaagtactacatatattggtccttaatgtgctccccggccagccagccatgcagccatgattttaatcttttactcatacctaagtttaaaatattcatttaaatgctaaattgtgtgacctactttggtgtcattaaaggaccttgtgttgtaatgctgcatgagcctgccacgatttataacatactcttggttttcatagtggcatttcagcaagttcacatccacgttcacctgtttctgcttgtttgcatatgacttggggagtccatcgtcttgcctgtctctgacttggtgttacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgaggtaggaagactcggctcacatctgtggccgggggcagctgtgggttttctgagttggggctccaaagccaggaggtgttcacacacactgagatgaattggaaatctccagcacaaacctgcttctgatctccaggaagaaaataaagacttcagggcaagcgttcatctaaagcgtttttgggctgatttaaaatcctgtgtcagaaagttgaatagtatatttttgtaggtgaagattcattttttcttcaaatataaaaaagtttgaattctgtctgcgtgccctagaaaataaaactgtggacttgtcaactcccattgttctttttttttttgagacagagtcctgctctgttgcccaggttggagtgaagtggtatgatctcagctcactgcaacctctgccttccaggtttaagcaattgttgtgccccagcctccccggtagctgggattataggcccatgtaaccacacccggctgatttttgtatttttagtagagatggggtttcaccatgttgcccgggctggtcacaaactcccaagctcaagtgatctgacttcctcggcctcccaaaatgctgtgattacaggcatgaggcaccatgcctggcccccatcattccttaagcagaaagatggagcagccgggccagggcctgaccacgctgtcggttttggttccttagtgtgaggagtcgggtgctggcaacacaagcgtgtttaacatgctcagtgttatgaaagcgaggtccagacctagagtagaattgacttttcatggaaggcaagtcagatgttctttgagtttccagcaggattgtggtaagcttctagcttgctagagtttcagcctgtggctcactcatcagcttgagtttgctgtggcaggttaccagtgctgtgcaggtagttctcgtccatttacctggagtgaatgaaaccaggtcaccacgtactatgtctcctgagacagctgggacagaaggtggattagttctctttgatgagaagaagggagtgagttgtggtgctgggtctcaggagagcctgctagcatgtttcctgttcgtgccggatgggcgttctcttggcgcgtgtgcagcgtgcgtttggaattttgcctatggccacacctgggcagagttccctgctcttccatcactcgttcaggagacctttcgactgctggttagttgccaggcactgggtcaggtgctaaaaagacaaagacagacgacatattggctgtggcaggtccatgtgaatcggtcaggggaagggcacaagccaagagtcctcgactccctccttcctttgcccctgagtatctgctccctcactgcgggtgacagttcagggcccactggccaccgccatctctcattaggacgatggaaccatttccgtagtgttcaaccacctcccctcctactgataagttttctctgtcgttacaaaattattcttaataaagcagataacaatactctttccattgtgcgtggcataaaatccagcctccaggctatggtccccatagcctctctctgccaggtgactggccccctgcctctctctgcatccccatctcatccctctccctccagcatcagtctccagtgtgctggccttccatattcttgatcttgcctcactcttgccactcaggctaatgtgcagctccttttaattctgtcagtccaccctgtttcctggccatgttaccacagtgagcacatgcctggctgtgtccttccccctgacacttcagctccttgaggcaggggacactatctctgtgcagtcaacagatgagtctgcagggcccccatggcacccagtgggtgctcagggaatattcgcccaagatggcaagagtgtcgtggccaggcagcttgtgcacggcctgtggggaagaacggtgtggtggcgagtggcccaactgcagaggcaggcaggggcttcagtacatcacggaggggctcgcaactcacacggggaagcctacactgtcgcctgaggctgcgggaagctatgggtgggtgggccggggtaaagggccactgtgtggaaagagatgggttcaggaggacgagtctgggggtgaggtgggaggttccacccaggtgggagcaggaaccgcctaggtgttcaggagttaagagtggcaggacctggtgtgtgctatgagtgaaccagaggtcttctgtatgtggacgatgccttggaggggttggaggagaggaagcccgtctggttggggacaggtgggaaagggtgctgagctcatacttggacctgcagagtcagaggtgcctgagtgaggggcatctgggagagaagtccagatgccctgaatgccacgcgcatgccttgggtctgtctcctttccgcaccccttgcagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggtgaggccctgcaccccacaggcagaatcccagagaggaggtgaggccccacaccccacgggcagaatcccagagaggaggtgagaccccgtgccccacgggcagaatcccagagaggaggtgaggccccgcgccccacgggcagaatcccagaggagtggaggtgaggccccgcgccccacgggcagaatccttggtcctgcggaagaagtttttgtatcagctttagatttgttttgggcatgaacaaggtataaaaacctgtctacctgaaagctctgaatgtggtacctaagttcagctagattttttttttttttagttagaattgagaagcatcttgcactcccattcggttttgagatgaatcacgttaccatgagctagtactgctgagaacagaacatttccctgtgccgtgatttttctctcctggtgagaaaagcccgtgttcattacagaaagcgctgcctgggggaatgctgcctgccacacaggggctggggctctagttggttcctccagcagcctgctcagaacccatgtctctgcctagtcccgggacgggcagcagggagcctttgctcctccgagaacctgtacgaaggttgatgccttaggcttggtggctttctgtcctccatgaagtagtggctgccgctgttcctggcagggatttttgtaggctgtatctccttaaggtcgttggtttttggaggctcagcctgtgtggagcgttgcgtcttaggagacagtcaccccgtgctgcaggcgggcatggcaccttctttgctctaaaaggggtggtgcgtcccctcttccatgtgcaggatgtctactcattaataatttcgaattaaaatttttttcctttttttactgttgctaaaacactagattacctggtcatttggtcttttctttctgtaatcttcctgtgtgaaataaattgccaagtctgaagttcttcattttcaagggcacacaccaaattgtcgatacctgacttcaaggagtagtttgattgttgactgacttctccaaaccttcagacagaaataaggtgtattcctctttgggaatggtcatataaaacattgcaccagcaacatgctccgccgtggccctgaagggattctcagtcggagcaagccaggcagctgggcgactgtattgcattttgagtaatgatagactatgattccattaatctttattatttttacgtttaaagtttattcttttaaattgtgcttttgacaaaaaacccaaatgtgaaagcacactggtggcttctttatagtcatttttaaaaagagagcgatctggtctagttaatccaggttttgtttattttaggattgaagattatttaaatacttacacacttccaggaaacgaacacgaattttaccaaaattgtaacaagaagcctacaggaggtgtgtttgttgggttttcttgaagcctttgaccttttggttttgcttgctgctttgtttcttaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaaggtctgtacgcagcttggaaaggattcgttgctttcctcccatggacagttcaaagcctaaatcaggatcattccacagcagtgtaactttttctgtttcttttctttttctttttgagatgggatgttgctttgtcacccagcctgcagtctagtggcgcagtcgcacctcactgcggcctcagtctcctgggccaagcgatcctcccacctcagcctcccaggtagctgggaccacagacataggctgccacacccagctaatttgttaattttttagtagatacagggtcttgatatgttgctcagactggtcttggattcctggactcaagtgatccacccaccttggcctcccaaagtgctgggattataggcgtgaagcagagatttggagtgtcacagtgtcttataggagaaaataggaaaaaagttaatttctccaccaccatctcttgaaagaaacggtaaaaccgtgtacaaaaaatgtgtgaggagacataataatgttggattatttttcaagtgcactaaaagaggagaaaatgataaatgagttaatttgctaaatcaagcccactttgtggaactgggggcctccaggtgcatctgtgtttgaatctagccaggtagaaactctctggcttctgcaaactctcaggtaaattataagtctgtttttatgtcctgaccttgaaagactggttgaagctccgtgtaccaggttgcttttgatgaggaggtatttttctgttctttcaggagctgggtgatgattctgattattctgttcatatcaggagctaggtgggaaaaaagcacaaactacttttcgcaagtgatttttacgttaaaatcttttggtgacctatgttgaacttgtgcactggatcagtctttgaacttatacccaagtgacaccattgtcatcttggataaggataaaatgcttttctgtgggatggagcgggaagcagagcagcctgatacatgtgagtgatagctctcatgttatgggccaggcacttcttttgtttgtttgtttgtttgtgtgagacagggtctcactctgttgctcaggctggagtatagtggtgcaatctcggctcacagcaacctccatctcccaggttctagcgattctcctgcctcagcctcctgagtagctgggattacaggcacacaccaccacacctggccaatttttgtatttttagtagagacagggtttcaccatgttggccaggctgatcttgaactcctgacctcaggtgatctgcctgcctcggcctcccaaagtgctgggattacaggcatcttaatagacccatgtccctactgccgccaccaccagaaaaaagggctataagtccatgtcctgaagcccaaggcctcctttggctgatggtcaccatgacacatcaccacgtcatcaggtgcctgcgcctcagttttagcctcagctcctggtgcgagtgccatcaggagaggaagttctagcagtatgttgtgcgaggggtcaggatatttggttttactcaacaatatttttgtcttggctcagttggtcacagctgtacacctccacgtcctctgtggggccatggctgctctctggatggcggctgggctagaccagacgtggctgaaatctcggcagatctcacagaaaatcttgcccacagatgtccccatggtcttctcttgatctgaggcttcatagcctgagtctcagggcccatctgtgtcaccctttgtaagaggattgctcaggccggagctgcagacgtcagccatactgttcccagatgcgtgtcacagaggagaccctcgaactcagtgcccagcacaggtgggcacaccatcacccctgagcctggtgtgccgcccacttgctgcatgtccttgggccgctctggcagacctgtgcccgcctcttagcagggtgtggttctcagggtacttgggtgtgatttaattcttcccttctccttgggttcttttgtgtcccattttcctcgttcaccttttacatttgatctcatttcatcatttcagcatctttttactgagagcctgctctgtgtcaggtgatgttctggacactggaaacacagtggtagctggtcctcagtagggtgtatgttctagtgaggggaaataatgaacagaaagaagtgctaatccctcaggaggcgagatgggtgccggggtaaagcagccagggctggtggggttggagagggtggtgtcgtgttatttcatcttctgtgtatttatgggagttgagatttttcatggagcaagatggggttacaaatcattgtgtttgttgtttccaccctgatgttctccttcctggagctcctctaccctgtgaagtggtcaggtgccaccagctcttcttagactcttggattctaaatgtggagagggcggtcctcaccccaggcacacaggctctttctctttcacctcatttcccaggtctggccattgttccctgtgggaattctgtggaggcagcaacccctcgctgggctcttttgacactgtggggccaccacggggtcctcacccctgcacctctttgggacagtgtgtacatcagaacaagccatggacttggggagcaggagcggactgtaatcctgagacacaaaaccctgaacatcataatcccggatgttgaaatccctaaagatcaaaatttctaacctctcaaatcccgaaaatataatgctggaaaaaaacaatttaaaaattctttaaaacatacacagagataccccaaataatactttactaggtaggtttccaggtattccttagtccagtcaagttgatgctgtaaacatggcacccataggcatctccttaaaccatgcagacagtaacatgtaatagtttctaacctgatgcagctgtgctgtgatgatgattttttcagggattttgatctttgaggatttcgacacttggggttagggtgtatagaattgtgtcttttgggattctgatccaaacccccacggttggagttgagcagctttatcagcaggtcagtgaccttgctgggctcttcaattctccccagctcttggtctccgctaaactgacgtggagctgagagcccctgatgggctggtcagggtgaagtgtgtggccatgtgagggaaactgtgcttacttcatcacagtcctcacagggcagcctgatgacagatacttaggagcgttctttacctaaatgttttcacccattttccttgaaagatttgtatccttggtgtctgtttttagtagaaacgtgaatgtgcccatggtttcccccttgggtttgctgcaggacaaatgaaagcataatcatgtccctggcactctgccaccgtgccagggcagcagggacagtgtggctgtcagcatgtgccccagccctgttgcgccactgcctgatgccatgtagggtgtctcctgtgggctagagcagcctcaggcagacctagaaacctggctgttaataaggaatgttggcagctaattcagatcagatcttcaaaaacaagagggctgggatgagataaacacaactgtgaatttgctgtgccctccaggccctcagtttcgacttcgggctctagttgtccaggcgttccgttccagtccgttccattctcttctgttctgtttcagtccgtctcggtcattttctcctgcctcttgtccactgcagattgcagagactgaactttcagttcttgatttgttcttcagaataatacctgttggcaaatagtttatgtcatatacgtgtgttttcactttcctattttcagtggcctgggcctcggtgacatctgtgtccttctaagttactctttcagtcttgtcagtgtttttgtccttcttggatatggtgggatcagtagtgttaagaaacccccttaaaaactaaggacaaatgcaggcgccattgctgagcctctcgggatgcctgggcttggctgctaagtgcaccatggcttcccaccactcaggatctgtgggcttttactctaacatggcattttctcagatctttgaaactttgaaagtggaggagcatcggtaatgtatgagacagatcatgggtgtcttctgagcgtggttgtgcgaggcacccccagcccgtggccatctcagcctgttgtctttctgttcatagactggagcgctgctcagcgctttcgttcagctgtgccacatttccacgacgctggcagagaagacgtgggtccagcttttccccagattgtggaagatcctctctgacagacagcagcatgtgagtgtatctttaaaatcctgttttggaaaattgtagttttagcttttggtaagtattcataaaagaacacagtctcgaacaagtttcagaaaatgagggaaccgctggctgtcactcgagcgaattaggaaaggtattcttgcatcgagagagacagcaagacttgccgatttttgaatgaaggcctaaatgacatgtgctttggtttcaggcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggtgagggtgcgcctcagtttgttaattacctcttccctgccagtgacttcacactttaaataaatactcctcccaaatgatttcaaatgacagcacagtgaaactatttttaggggggaaaaaaagtctctgtctcaagcactcaggaaccttactttgtgttttcaggagatactggattcccttgcggagctttactccctgttacaagaggaagatatgtgggctggtctgtggcagaagcggtgcaagtactcggagacagcgactgcgattgcttacgagcagcacgggttctttgagcaggtaaacctcagaccactgacggtcttgggtgtgtaatgagaggtcatttataacggttctttaataaaatgtcctcaagtcggagttcacgttctctttttttgagatggagtcttgctctgtcgcccagcctggagtgcagtggcacaatctcggctcactgcaacctccacctcccaggttcaagcgattctcctgcctcagcctcccaagtagctgggattacaggcgcccaccaccatgcccagctaatctttgtatttttagtagagacggggttttgccatgttggccgtgctggtctcgaactcctgacctaagatccgcccacctcggcctcccaaagtgctaggattacaggtatgagccactgcgcctggcccatagttcacatttaaatacgttttaaagcatttcagtcccgcacgtaaaggctctatgactgaagtctgcatttaagagatacctacgtatatgacatgagctaaagcacagtcctgataagtcctttgcattagatgccagcgtggatgctttttccctcccgtcgttggtcctgttggaagtgataggttttgtttttgcttacgttttactccctgtgtctgcccttcagtgtggctcaggccaccatttcagggtgcaattcctagcactgtgtagggtgctgtgccgcggaagctccagaagcagatgtggccttgcggctcctgctccgattactaaaggatggagaaagtaatcccacgtctggacagcctctcctccttccattctgttcagggaatcccactgtcttctgtctctgaacagagagctgcgggcatttagtgctcctggagaagagctccatgtgctcccaggtctgtgattcagcctgctctagacaactgggccatggcagtgaaaaggctgtgtttcttagccaggtgcaggcaggcacctgtagcccagctactcagggagtctgaggcaggagggtcccttgagcctaggaattaagagtttgagtccagctttggcaacatagcaaaacctcatctcaaaaaacttagttctaagttttaaatttaaaaagaaagaaaaggtgtgtttctagttaaacagtgatttaaaaacattaactttttttaggcacaagaatcctatgaaaaggcaatggataaagccaaaaaagaacatgagaggagtaacgcctcccctgctattttccctgaataccagctctgggaagaccactggattcggtaagccaaacacagtgcttgacgtgtgcatgaatcagttaagggaaccagggaaaaatctctgaccttttcttgtaatgagcgttttttaaagaaagctttgctactttatggccacataaagaacaaatagaaacccaaaaccagcatttaaagccttgagtaattaaacaagtcaactggagaagcagtaaactgtccctgcatctcccctggctccagtgctctgggctgtctgctgaatagcaggtggtttgtggtgtccagggtgggcagggggctctccccacaatggagcacacctccatgtcccacagaagtccactcttactgtgttgttcttctgtagaatggaaatttgctccttaaaaccctgtccctgcctttgtgaattcatgagtgtgctggtgattgagcttttgctctgggatctgtggtcttctagatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtgagacgccccgggggcatccctgccgctgcctgggtcccttttcctgaagctgcaggtgtctcttgggagatttcccttagaacaagcattttggcagtggaaagacagcttttgggaaggaaaggttccttttgattgtctaacacctttcctgaatttgagtaatgacacttttacaaaatgagaaattgaagattagaaatagtcacaaactatgaactagaagatggaatcgaggccaggtgttgacttctggtttgggacctgggaaatgactcattggatgcagggagtttgtgttccttagagaaataaccagtcatttatatcagtaaaaatacattcttccctcagtatccaggacaccccagcggtaccaaaatccacggacactcaagtccctgatataaaacggtgtagtattgcatgtaatctctgcacagccgcctgggttctttaaatcctgtctaggttacttacagtacctaatacagtgtaattgctacttacacagttgttttgttacactgtagtttttagggaatgacaagaaaaagctctgtacatgcttagtacagatgcagttttttttcccccaaatattttccatccacagttggtcaaatccacacatatggaggaccagttgtatatattttgctgtcagaatgcatttacgatgcttattccttctttactctgacaaaacataaaattgaataagtatttgtagctcaccttaacgttcccttctttctccttcccaaagtttcccttagctggatatatgcagcgtcacatggtcccgaggtctcacagatgcatttcttctttcatagattcttgatcattttataaaacttgtaaattactcactgcttagaaaaaaactcaaatatgtgagtaaacatcctgggtaatctgcactaaattaatttcaaatagtcttgaaaaggattcagcaaattacttctgtctgtttctgtgcttcctagggtagtttcttggtttcatttagtaagtgggttagctttttttcagtggggaaaatagaagagatgccgtttttcttagtgtaactgagggtaggtgttgtaattggcaaaaatctatctcaactaatgttcgagtccagaccctgtgacattggtgccaatgtggagggtaatgttggaagctgctgtagtcttgtttgccttcctgaatttcttcttcagtgggttatcgagaactaagaggtaccatgaatgtgctttggaagagtaagatgtcaaaaacaagccacagtgtcatataattgtggggtggtgtcattattaccattattgcatgcagtccttgggacagataccatcatggcactcatgtgtgtcccttttattgttatttattgttttccaaagaggaatgtttattgatcttgctacagcaattcctgtaaacttcccatcatagagatgtccttccatctttctaatcacagagatgtttgaaaactttcatgaaaaaaattttttaaatatttttaaatgagattaacaaaatgtgaggcgttccagtgctttcttcagaaggtaatgagccaaaaaaaaaagaaaaggccttttagggcagaaaggaacacatggtctccacctggctgaggagcggttggcccaggctcatcggctgctccatggaactgacgctggagtgcaggaaatctgggggacattttatagtaggcaagaaagtgtggctttaaaatgacagtaaaatttgcacatgttccctcatgttcatgtaaacctgaattaacacctgaacggtttaatttcccaggataacaatatgaattggaagcaattcaaaattacacccatgtggccgggcgtggtggctcacgcctgtgatcccaacgctttgggaggccaaggcaggcagatcacttgagcccaggagtttgagaccagcctgggtaacagcaagacccccgtttctacaaaaaataaacaaaaattagcctggtgtggggtacatgcctgtagttccagctgcttgggacactgaggcaggaagatcacttgagccctggaggggctgtagtgtgctatgagcatgaccctgcagtctagcttgaacgacagagggggaccctgtctcaaaaaaaatcacactgatgtttatcatactggagattaatatatatataacagcttaaaatgtgctgattggccaggcacggtggctcatgcctgtaatcccagcactttgggaggctgaggcaggcagatcacctgaggtcaggagttcaagaccagcctgaccaacatggtgaaacccatctctactaaaaacacaagaaattatctgggcatggtggcacacgcctgtaatcccagctgctcaggaggctgaggcaggagaatagcttgaacctgggaggcagaggttgcagtgagccacgatcacaccactgctctgcaggctgggcaacagagcaagattccgtctcaaaaaaataataataataatgccggctgacttgttagcagactgtgtgatttttcatctgatctgtcataacagcattgatcagtttcttttctttggaacaactgatgaccttaaagccagaagcctgtggtatgctttcatagctagagagattggccgctcactggaatttagaaaaggagagtatccagaaaagactgtgtaaacgcatgacttctctaaagaaaatacatttctatagcctaatttctgtgtattgccttgcatacctagtgaccaaaaaaagtgatctttttcctgtttgacactttacactgagggaaagaaggcccctcacgtcctgtgtcacgttctttcactgccaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggtgcgtgcggtgcccccatgcgagcacaggcctgtggcctgtcgcagccaagcgccggtgtccaggcttaggtctgcagactgctccggacagcagagatgaaactccttctgcttgtcttgtcctctcccacttatacgcgtcctcaggaaaggaaggccacagttaaaacgttgagaaaaacatgtcggtgtttctgcgggattgaagacatcctcacagtgattctggttttgaattttgcctgagggattgttttcagtgcccactgtgccaccctcagttacagagtccatcgctctgttttcagcaagcttttggcgggagctggagggacagggttaggaaatgttttccgaaatctgaatgtaatgagttaaatttgaaatataaacagaaagcacagattgttctaggcaatttcaaaaattactgtcaaccaagatacagagtattgaactaagtgttatgtttaggagattaaaaaacattttaaaacaatagattctgcctcaaaggagcattgaacctgagacagcgggcatagccatagaaacaaatttacatttggagggagactgtgattcagagccatgctcatcagacagaaaatcaggataatgaggatcgagggaaggaagatatcgtgtgcgccatagaagccaaggacagaatttggataggctgaggattgtggccagggccttccaggtgagaaggtggtatcagaagtttggtgccaacagcgcatctggaatttaagggtagtctacctcccaggctcataggacggtgactcaaaatgtgtttacattttatgggtccaaagaggtcatgagaaccacgtttgcaggtgcttagtgtggctgtggggtttagcaggcacgttgggaaaaggcacgcctgcagcagggatgccaggctgtcccgaccttaggcattgctggacaaagagccgggcagggagggtggcaaagggcatggacagcaggaggaggagttttgaggactgcccattagctaggtttggtgtctgtaccatcgttctcccagtctcctgtctctcaggagccacaagctgaggttttaaaattggagacaccataaggaaagtagtgtttggggtgaacagtaaatgaaatgtgggatctcaggtgtctgtggtgtaaatgagagtgcttcctttggtaattgcatcataagatctttgcgataatcatgtccccaatggactctggtgtgtttttcccgtttgatctttactgacatttaccgcagagtctcttatgctggtcccatcaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccagggtaaaccgacctggtccggcatgcattcatcatgtaattttccagacgccccacggttctggtttcgtctctgtgttttggtttggtttggtttggtttttttttcccccaggttttctattttggggtagggaatgacaggtcggggtggtaatggtacagggaaagatgaaggtggtagaagaagtaaagttttgttttttgtttctgtacctgttacatttttctagttggggcagaatcgtacaggccggggggatcaatgctctgagccatggcactctgcgttgaaggtcccatcccaggacgagttgtgctcaggtggctctgcgtggccttttctggttttcctggtccccctcttatcccctaaacctgtcaggcatccacgtgtttagagcagcctttgtcattttatgatttggttagccaagatggtaacactccactcaagaattagcaccttttaaaagttgcttatggcataaaatacaaagtaacgagggtttatcacagagctgcccattttcataagccatgtgtgtgtgtgtttcattttttatttaagccttgttgtgaagtgctttgaaagaggatcggtgtgggctaatgattcctttctttgccctctagcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcaggtgcggacaggacacttgaagaatgaggccaggtggagattgaggccaggtggagaatgaggcaatgtggggtctcctggttcagaatataaggaaggtggactcgaactttccacaaatacagcctcagtaagggggaaacagtccttccaaaacacaaaagggaaaggaagctacttgactgtgaattacagtctcttgtggtctctgtcctactatatacttagttaatgtgtttaaggaaagaaaaaaattacacactacagaattatgaggatctaagatagattttgactattttcagaggaatcttgataagaacaataaaaccgaccagacctataaagctttggagaaaataagacccctaagtatttaggattaaatacttaaagttagctttagtaattcagtttaaattctgaacgtcaatcaataaatattcatggtaggcaaatcttttgtcaatttaaagtacattggtcaatgactcataggacttactgcctagattagtattttatgaggttttcatattgtttagaaatttcaagaactttttttctgctcattttttttgaacagggccttgaagttattgaatctacaaatttaaaatacttcacaaaagagatgacagccgaattttatgcactgaagggaatgttcttggctcagatcaacaagtatgtatgttatattgaaaggataagagaaaaaatgcatcagattatttaaagttatttataacctgaagccaatgtgaagctcaagctagaaatgggtatgatttggtgacagtcattaggtaggattttttaggtactgcacctctgcaaaaagagtaacttgtgacaaattgataagcctatttgatgtgtagtattttaaaagcttttctcaaatgagctactggatcacagaactgctgataacatggattcatttccccatttcctcagtccgccatttacagagctggttcgttttgtggagatgattcctgctttagaccaggggtcagtaaaggatggcctgggggccagccacatccagccactgccctgtttttgtcagtgaagtgatattggaacacatccctccccactgatgttgcctgtgactgctttcgctttactgcagagttgaggagttgtgataggaatcgtatggtctgcagagcctaaaccatttgctgtctagcccatcgcaggaaaggttgccaaaccctggtttagagaagtaaacgtcagaggagattttgtaaatatcatgcaaatgaggtagactcacaagatgctgcctgttgccttgtgtaggctccagtgcctgcttttcacatcttcagtctgtggggcttgcatgtttagcttatttttaaattaggaagcagttttgtcaacataaaaaggttttatctttttgtgtaatgttttaaattcatgtgacagacacaaccattccaaagtgtacaatttagtgggttttagtatatttacagtgttacacaaccattaccactagctaattctagaatatttccatcatcccccaagtaaaccctgtatctgttagtagtcactctcctttctcccctccccctttctcttgacaactactaatgtactttctgcctctatggatttgcttattctgaacattcatataaatagaagcatacactgtgtggccttttgtgactgtcttctttcacttagcaggatgttttcaagcttcatccatgtgctgtcatgtatcagtaacctgttctttttcatggctgaataatattccattggatatccatacattttgtttatccatgcagcagttgatggatgtgtgggttgttcctactttttagctacatgagtaatgctggtgtaaacactgaatatgtgtctttgtgtgagcatgtttgagttctcttggttatatacctggggacagaatatctgggtcatattgtacttctctgtttatctttttgagacattgtcaatcttccacagttggccgtaccatttttacattcccaccagcaatgtttaaggttttaatttctccatatcctcaccagcacttgttattttcttattatttatctgattatagccatcctaatgagtataaaatatatttcattgtggttttgaattgcattttcctaatgactgttgatgctgagcttcttttcttggttttgattgttagtttgtaattctttataggtctggataaaagtctcttgcagatatatgatttccaagtattttgtcacgttctgtgggctgtcttttcacttttttgatagtgtcctttaatgtacaagtttttaattttgatgaagtccaattcatgtatttttttcttttgttgctcatacttttcacgtcttctaagaaaccataccctaatccaggatcagaagcatttattcttatgttttcttctaagcatttcatagatttagctcttacatttgggtctctgatccattttgaataattttttatgtggtgtgaggtaggggtctatatttattatgctgcatgtggatatacggttgtcccagcaccatttgctgaaaagtctagtctttctccattgaatggtcttgacaccctcatcaaaaatcagttgaggccaggcccagtggctcacacctgtaatcctagcactttgggaggctgaggtgggaggatcacttgagcccaggagtttgagaccaacctggacaatatagtggagacccccatttccaaaacccaaaaaacaaaaatccgttgaccattttttgtgggcttatttctggactctcacttctattccattgatctgctatgtagagtctcatatttccatatgaattttaggttattttcatgtatttctgccaaaacagttggaattacgacagagattgcattgaatctgtagatcagtttgtgagcattttgccatctgaagcaagttttccagtttgtgaacacgagatgtctttccactagtttaggtcttctttagtttaattcaacaatgttttttagtttttagtgtacaagtcttgcacttatgttaaatttattcctcaatattgtcacgtgaatggagccattttcttcattttcacattgctcattgctaacatttggaaataccagggttttgtatattgatcttagatttctcaaccttgctgagtgtatttgctctaatagctttttggggattcttcttttctgtgtataagatcgtgtcaactgcaggtagagatggactgacatcttctcttccaataaggatgccttttatttctttttcttcccaattgccctgactagaacctcaagtacagtgctgaattaaagagatgagatccttgtctttttcttgatcttggggaaagccattcagtctttcagccttgagtatgatgttagctgtgggtgttctgtagatgccttttataagcttgaggaacttcccttctgttctaaatttgctgggtatttttatcatgagatgttgttggacttttttcaaatggctttttctgtgtcctctgagatgattgtgttttttttccttcattgttttaatgtggtatatcacattgattggttttatttatattgacttttttgttttctgtgttgaaccacccttattgctgggataaatcccacttggtcatgatggataatccttttaatccgctgctggagttgggttgctcatttttgtcgaggatgtttgcgtctgtatcataaagcacctgggtctgaagttcccttgctatgtctggtacattgctggtgtaatagtgaagcggtataactgctgtggaaacagtttgacggttccacaaaaagtaagcatagagttcccacgtgaccagcatttccactccctggtatacacccagaagtgttgaaacaaacagatacctgttcgggaatgtttgtagcaggactatttgcaataatcaagatgtggaaacaacacaaatgaacagataaacaaaatgtttatgttctatgtgtgcaatggaatgttattcacttgttaaagagaatgaagcactgacacaggcttcaacatggataaacctcgaaaacactgtgctaggtgaaagaagccagattcaaaagatcacatggtgtatgattcaatttatatgaaatgtacagaaccggtcaatccacagagacagaaggcagactgcaggttcccaggggctggaggtgggaggggttcagagcgactgcttatggggcggttgcacaacattgtgaatggaccaaatgccccgcagtgttcattttataatggttaatttcagattacgtgaagctcgcttcaattgaaaaccatacacgttttggttttctgtctcctcacaggtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgagaccgaaaaaacgagctttgaccagaggccatctgtcaccttcagatttggacagaaatttagctatagtttactcatccgtgccgggtgtgaggcatgatttcatgccttaactcttaatcctcatcactgttcgaagtatctttcacagttccatttcaaagctgagaaaactgaggcctggacactcttagggccccagaacttccaagtggcaaagcctcacgtagagcccaagtctagcactgcctgtgggagctcacacgaaacagagggctgaggaggggatgtggagctagaacttccctcctagacgcccgttaggttgtcatccctcccctgcagggctgttgtcagcacagccacagagctggcgtgctggggtggttgtgggtttctctctgcaccgtgccccccagcagccctgagctcagggtgggtgtcacccacgtgctcactgaaggatgtgcacttgacactcaggttcccccttcatgtggcttcctgtcttcccccaagaagcagacaaataaaacccagaattaattccagcaggaaacccaagaataaattgttccctttcctattttgtccattaaaggtttggattttttagaattccttgatttaacataaaaatttggaatgtacaccagcacatggcagttaaagccgactacagagacagctacacgcactgcttcagtgcctggctccgggttgcttacacccagatgtaattgtttcagtcgtccatggacacctggctgccagcctgtggcctacctgttgccggggtgatgagcatctgagagttttagcaaaagttcattttgtttggatgagatcatgagtgtaggttaacgggtgggcaggccccaggcatcttcctgttgctgtcttgcagtcggtcactggtcagtgctagtcagtggattagatcagcgagtaattgtcattaaaactaaatcaaaaggccgggagtggtggctcacgcttgtaaacccagcactttgggaggccaaggtgggtggatcacttgatgtcaggagttcaagaccagcctggccgacatggcaaaaccccatctctactaaaaatacaaaaattagccaggcgtggtggtgtgtgcctgtagtcccagctactggggaggctgaggcaggagaattgcttgaacccgggaggtggaggttgcagtgagccaagatcgcaccacggcactccagtcctgggtgacaaagcaagactgtctcaaaaacaaaacacaaaaaaactaaagagaaaatctatttttaaattttaggttttatatactgtaagatttacattaagtttagcaataatgttggcctgcttatagatactttttttacatggccagtaaagccgctctatacagtgttgtaatgttggggaaaaagtctcttgcttgagggcttcagaattgtcattctactctagaatttctccttctgtctcaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggtgggaagagcagggtggccttgttcacgtgcacaaaacattgtgtcttcattttgcgttcttttttctcccagaaagtaaatttgagtgttcaaagtattaaaaacaagttaaagagatgggaagatataatcatgtagatattatttaatataaagcataattaaaagttattaaagaatatatcagagttgaaatgaaatagctaataaagcagttcagtgttaaaattctaatttcttaaacattttcccatatataatgtaagtaaaataaacttgtagtaaaacatacaattgccagtgggtaccctgagaatgacagtgagccctgaatctgattggtagttttcctctgattttttgtcatatgctgggagctcttcggagctgcccttaaactaaaacatgcccaattgtggctgtcgccctttcgacagttgagctgcatcataaggaacccatggttctcaagggcagtggggccaggccggggaagcggacagcccagggccctatggaaaggctctcataaccatctcttgagaatgattccaggatgtccctctcccgtgaaaagacccaggcatagaggaaggaccagaaacggcggaagcgtggctacagtgaggtttgggacacagcgcctttgtggttgcttttgtaaaatcacgaagcaccgcaggagtccgtgaaggtgttcaggaaggagctgggcccgcgcgttctgcccacccattcctctggctccttcctgcacgcagcacctgtgctatgtgggccctgagcgatgccctggttttccttgaggaggcagctgtgtttttgagtcccagcattctgtgtagcacttatcctcaggatgcaggtccgacctacttggtctcatcacttctggagcatctcaggttcaagagcagccgcctctgcctgtgacggcttagatgttattcctttcttcctttcatgggcacattctgaaagattcaagtgacatggtactgtcctgtcagccacagaactccagttcaatcaaatgggagtttcttaactgaaacggacatccctccatctcctcccagctgcagttaggcagaataaagttatttgataatggaattagttcacaatccacagtgaattgtgcctgacagattagctggtatttgtttgtttttttatttgcttcagtgagatctggggacacatgtattttgccttcctcagatttactgcctggaaggaaagcgtggtttccctgtcactcacagttcctgggtggagttgatgaaatgcatgtgttgatgtgtcttggctcttttaaagtgaattaaatattttgcctgctgttgaacctggccttgtgcgtcagatcagtgctgcagtatttgcttccttggtccaaaggcagatcagacacctgtttctgacttgacattggttattttcagtacaaattatctttatccagagctcagcagagagcagcactgtttataacatcttgtctctgagcaggttggacgcgtgtatccccaagcggtctactttcccatccggaccctgtacctgaccctgaaaatagaacagcgggaacgctacaagagcggtacgtctcgggtggggccggtaggccaggccgggaagggctcattccagggggtgccccacatccagacagaccaccgcagccacccctgccctgcagctcactcatagccgtggccaatctctcctcagtgggcagcaccgtagggcaggaagcaaagtctgatctgagtacagtctctcttttgccaggatgtaataggcgttcatttatccgagtgatttgatctataggtagagaaaatatgtgaaattttcagcttcagaaaactgtaaagtttacctttctccttagtagtaagtgcatcccaatacacagcagatgccagctgccgtgtgtgtgtgtgtgtgtgtgtgtgtgtttaagttatgaggagtatcttcagctgtgagaagaatcagcattgaagtcagtcttaccagatgttggtgaaatttcactcacagtgtaagacttttaatctatattgaatagcccttgtatgcaaagcaacaactgatttgatggcttcagttacccactaggcagggtgctttaaataatgagacgaccgtttactgccccttgttttcaatgctgagtctcctaagggccgtgggccgtgtgtggttggtgagaggcggtggatgagggctgcatggcacatttcagctctaacctctggggagtcagtctgcctaggtggcttcatgtcttggtcatttgaaaattaaggttttttagttttaagactaagtgtagagaggtaaattcagaaaaaaatggtcattaaaggctctgcaatgtatctcacagggaaaaatgaccgtatttttcaaaagcagtattttgcaattggcttggctttccaaaccagtttcctattaactgcttttagattctctgagtttatagtagcaaggaacgtgtaacagattgtgagatatttttccaaacatttatgtttaggatgatcagacgtaacagaaacgttaaaaggagttctcagggaactcttgtgcgccctcacctggactcaccaggcggcgtgttgtcacatctgcatcctcctaaaacacatacacgggtttatttaatggaatggattgaagccgcattgtagacaactgcgctgtccctccccgcgtccctcagcgcacctgcgcctagaaccagggccttctcccacgcagtccttggggaagcggtcttgtagggattcacacgccggcaggaaccagcgctcctttggcccatgggtcctgcagcgctccgagccctggcgtctgtcggttttgcgctgacactggcgttgtgtgtgttgctctcagattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggtatttggctctgatcttgcacatggtggctccttgtagaggggacgtggtgttctgtatgcttctgtggctctcttcccttgagctttagttgccggtccttttatatatttgttgttgaacttaaccatggaccaggcaaatagctatctctgcacactagtacagccttaaagattcaaagtacaagacatgaaagagggtggaattgaggaagccacttcttgctgttaaaatgctggccgtgctcacgtccctgagctcagtgacctgagtgccactgttaaccaggtgtgagcaggagcagtggcatgagtaacagggttataatttccatagatgggaaattgtagggatgtggggtcttttcagcagtcagaccacttccttaataacgttggcttaagctgatgacagaatagtccacgcctcactgcccagatgcttacctggttgagccccggggccagctccttactgctgtgaagtctcgtgtgtgcacagtgcacgcagacacgcggtgggaacagtacagctgcctgaaaatgcaggggttttgtggctaatcgcagacgggtgtatgatccaaaaaagtggggcttttctgttttcgctttttgaatgttcaggtcccttactccccaaggtcaaaagcgcctgctcccatgtggcatgcacaggcgtcccgtttcttgcacacgccgatttcatgcctgctgtgtgtgggtcctgccggggagtgcagagatgaccctgggctgggagggccgcactcaataggcgcttttggctgctggttctggagtggagggctgtgtttgtcagttgtctctggctcttttctaccaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacgggtgagtctccattttccttcccttccatagggagaattgtgcacgctgatttcctccggctttagtgttgaagctgattggatccttggttttctgatcactgcacggggcacactggttacactctgtttacagtgcagacttcagagtgcatagctgagaccacatgtttttctcccagggaggggtcaaggtttggagcaggagctgccaggatccaagacggggtagaaaatgcatggtttcaggccacactgccctcctgccctcctgccttcctgagacccttccttcacttgtttttggtgggaaacagggtagggtggggtggtgggagacattgttagtgtgaaccagtaggagacagagtcctggtgagccggtgggagatggggccgggtgagccggtaggagatggcaccaggtgggatggtgggagatggtgttagtgagccagtaggagacagcgtctggcgggccagtgggagacagggtccggtgggcccatggaagactgggtctgggtgcgccggtgggagatggcgccgggtgagccagtaggatttataggggcagggcctgcagcgacgagctaagtgcaagctcactgtggattctgggcatcgtaatagggagatgtattttcaatgcttgtctgtagttcagattaatgcgttttcctaggctcacagcttaactcctggctctgcctcttatgttgtgatgtgaggaaaggagtccaatttccttcagcccaggtttcttcctctgtcaaacagggatcctcaccccacagtatcccccccccaccatctacacacccctgttccatccttgcacccccatcccatcatacacacacatgtcccatctacgcacccacgtcccgtccatgcaccccatccactcacctgtatcctatcacctgcatcccatcactcccatgtcccatctacacacccgcgtcccatctacttactcttgtcccatcatagacacctacatcccatttacacacgcatgtcccatcatacacacccctgtcccatctacacacccgcgtcccatcctcgcatccccatcccgtcctcacactcccgtcccgtcctcgcatccccatcccatcctcatacccccatcccatccatgcacccccgtcccatctactcacccctgtcccattcacactcccccgtctagtccacacaccccatccacttacctgcgtcccctcatcctcatgtcccatctacacaccaacgtcccatctacttaccctcatcccatcatacacacctacatcccatttacacacgcgtgtccccgcgtatgcactgtgtcccatctacacacccacatcacatctgcgcatccacatcccattgtgcacacccacatccaccgcggtgcgcacaggcacagctgcttctcgtgctgtctggaacacgttgcttcttactcctcattcagcctccatcccacttacctgcgggctccctagtagagaagcgcgtggcgggctctcttgccaggttctcactgagagctcctggtcccaggatgtggcttcagctgcctgagtaacttccccaagccttcatctctcaagtgtcagcacatgagtgattgcagcacatgagtgattgctgtgtgaaaacgagatttgtctggtacagtttcccagagatgaaagaaagattaaatcattcacatttaaaagcttaattactgcatttttaaaattgtagaacaaatcattttaattttcatttcttatcttcaacttattctttaaattaacttcaatttttatacaaaatgtcctgaatggaagtgcatgaaactatctggttaaaacaaaatatgggccttcaaacctaagctcagtcactagcccaggtaaaaagaagagatgctattctgtgacctttttcctcttaataatatgttatatgccgaacagtttaaaaatgtgattagttgccttggtgacagaataaatagcagcaactctgttctaattataagatgattttaaattttatttttaagattaagtatcctctttgacaatccagaaacatagtctttgctgactctgtggacacacacctaaaacagttaaaaaggattcctcaattttcaatgacaaagtacaaaaaaagagtatgttcttggtgggcacggtggctcacgtctgtaatcccagcactttcagaggccgaggtgggcgggtcacttgaggtcaggagttcgagaccagcctgaccaacatggtgaaaccccatctctactaaaaatacaaaaattagcctgtcgtggtggcgtgcgcctgtaatcccagctactcaggaggcttaggtgggaggatcgctggaacttgggagacggaggttgcagtgagccaaaatcacgccactgcactccagcctgggcaacagtgagactctgtctcaaaaaagaatatgttctcaagctgcagttcagtttttctgtccccttttccaaaaaatcttactttactaccaagccactcacctaactataaggaaagacagtttttcaaaaaggcaacaaaatccagaaaaaggagtaggtatcagtccaaaattatcacccaaaacactgctgttgcaaaaaaaaaaaaaaaaaaaaaaaaaaaaattagagtaggaagccgaattcccatagcttgttagagaagatcttttaaaagaattcagaaagttaagagtggaactacagtggtatagacaggctcaaaatgcagataattcaggaacattcagcttggaaatatattaggctttctcctagtccagcagaggaaataaaatcatgtgttgctggaattaatattaaaattgtccccacacgcagaaggtaaagaaagagaatgtggaacaaacgtagcaaagacaagtcaccttaagtctaggctctactgcccaggaaaattgaatcgaacttaaattcttcctgagtcattatcactaaattctagatttggcctgaaaccagtggaccacatacaccactaataaataccaagtgatccacagtgtttgtggtattacatttttttaattattataagtttatattctgaaaagcagtagatcaaaatgatgctgcaccatccagtcggttacagactaaacggctccctccaaagaggactgacttggcagaaacctaggctggaaggaatgtgagtaacatgaagtacatcaggctctcagtataatttccgtaaggcttttctacccaccccagttgtagggagtagtactgagggagctccaacacagtgtcttacaggggtgcttcccagagacagaagggctctaagtttaactcttgacccctcttctccttacctaaagcttggggaagaaaataaatatttaatttttaacttttcagagctttgagcacattataatatttaatattctgtagcttcattttctgaacctttggcttagaatttttttctcaacttacattaaaaaaaagtatgaatgctccttcaccagatgaaaatataagccatgttcttccatctcttctacacaggaagagtgaatgaatagtactgtaaatatcctgtgaggttactttgtgtacttgacgaaagattagggaaaaccaatccacttccatagctcgagcagtagttaactagtcttcaatctcatcttccccaatgtctccattcatatccaagcatgaaacagccggttacaacacggtgaagtagggttggcgaaatgtttgtaaggggttgctagagagagaacccatgccgacccaatagaaatagagcctgcagccagtacatggcatccacctcacttctctatgtgaattccacagcatgggcatctcttcgagttctcttctagccactcctttctttccatctcttccagtgccctctgactcaccctcttaccttacctctgttacagaaatcttgtcttggcctcatctgcttgcaggtattcgttttgtaagtctgttaatttctctgccatcaccttacatggagaggccccatggtaggtcagtctgcacaaggtacagaaggcaaagttacagctggagcagatgcccgtggtacagccaggccctgcaggcccccacaggcgggggcagcacaccacatctgccaccagctccaaggtggatgggaggagaaggcagccatgacgggcagagaactctgcttccgctggctctttgacctggccaggagtggccaccgaagggcactttggttctgagcagttgaggcattgaacctggccatctctgatctggatttcaaagcagtccttcagataggctttgcagtacacaggcttcactccaagaagtacatgcattcactgcccagcttctcgcagaaacagatgtcgtacaggaacagtctactattaaagcattttatctgctaagcttgatcaaagtccaagatttcctggatcagacttgacagtgattccacatcctgcacagctctctcatccacaatttcctcttgatctacatgagatccagcagctcctccaaaatctagctctgatgggaggggcttgagctatccttctcggcactttttcctgagaacttatcgtgagctcagagggagagacaatattggggtgcaccagggtctcttgcttaagaaactgcatccaggcagacaggatcccactgccactgtgttcttcccataggttgtctaagtgcttgcatagagcagagagctgagttggtgacagcaatttgccactaagtgtgaatgaaggtgggaaggaggatggataatctggtggcagttcagagttcagcacaagtggagggagaaagcaaatggtatattcaaagctactattctgggggcactcatctgaattgccgctcacaaataacttgaagttctgtggcaaatcccgatcgatgctgatttctccacctcagacaggctttgcttttccgaattcatctccatcttaaatactcgccagggccagcagctcacctcctgagcttctcagtcttctgacaacatttaattttatgaggaattgttaataacaatcagaaaaaaaggatgtcagcaccgcaatctgtatttcagtttgtttatttatttatttatttattttaaggtggagttttgctctgttgcccaggctggagtgcagtggcgtgatctcagctcaccgccacctctgcctcccaggttcaagtgattctcccgcctcagcctcccgagtagctgggattacaggtgcacgtgccaccacacctggctaatttttgatttttagtacaggtggggtttcactacgttggccaggctggttttgaactcctgacctcaaatgatccacccacttcgacctcccaaagtgctgggattacaggtgtgagtcactgcccggccatgtatttcagtttagagtggagttcgtgcagatcccatttattctccaggtggtggagatgagactgccaaagccgggtaacaggccaagatgtagaactcatactacatatactatggaaatcctgccatgtggggcaagccggaaactgctaccccagtgagggaagcccctcctccacagtgtttccctccagcctgcgaaactctttttcattcttccaggccacactctgcgcactccagccttggggccagccctggtctgggttcagcatgccactgccgccgtctccagcactcgccagccggcgtcacttgggcaactgaccaacaagtggggcaggccgcagcctagctctctgccccagcgctgggatcagagggcgctgtgtgggcctgtgagcaatgggccagcctggggtgtcctgaaggagcagggcccacacctttcccttcctcatcagcaccctgaagggtcgtggccaggctgggctgggggcaccctgtctcgagtttgggggatcgaagcccactgagcagttctggcccggcccccttctctgccttgcacacccagagtgtggtccctaccataccttccagctgccctgcagtgcccaacttagcgcttttgtaatgatctttgccacgttctttcttcactgatgggttaaatcgtagactaagtggttcacatgtgtggtattcaaagaatctcctaaagactcattgtgtcctagatgacacagttaatattaagtcacataaaagaaaatcttcatctccttaatcggaaaggacactcaacagccatagctgtgaccagggttgcatcgaggttgcatccagctgaagtgtggcgtgtgccctgcagttgctccaggcagtctgggggcgcagctccctgttcgtgatgtgtgggttgggcttgccttaggtgaacccacagctgagggaggtgctctttgaaaagtgaagggcaagcccggtcctccccgtctatacgtgaagcgctttcatctcctcaggcttattgtgaagtgtgtgtgatgtgtggtctttcacccttctgagaacggaagagtccgagatgaaagttttatggaaatcatattttacttgaaagaaatggtggtattcagcatgcttttatcttaaaatgtccacattattaaatcaaaaaagtagagaatcagaaatgggatagatcttctggcttttgatgtaaaaaaaaataaaaaatcacaaaaccaaaactggaaaaagtcagcatgaggctcctgactcatctcaaagtgcagtgggtctcagacacgcacagccagagctcatccaccttccgctctcctgtacacaggggaggctgtttctgtctctttgtctgtgttccgttcgtggaatgcagtccgattctctagcagagctgcatgtgtgggctgccaaccacatgtctgtaaagaggtggaagaaagctcagaaatggcgcactccatttatcccacagaaatgaagacttccattcatgtgggaactggtacacaaatattcagagcctttgttactttatttataatagctcaaaactggaaaccatgcagatgccctttcagaaggtattgaatacattagaaacacctcagcaatgaggagttaattattgatacacagtaacgtgggtgaacctccaggaaatcatgctgagtgcaaaaagccaacttggatgtgtactgagggattcttaattgtgaaataccacagtggagacggagaagggattcatgctggccaggtgttcgggatgcaggggagaggcgggggggtggggtggtgggggtgggtggtagctgtgaagggcagccaagggcatcccgtgctgatggtgcagctcagcaactgattgtgctggtggctctgcgaggccacacagtgacatgaccagaggtgtgcgcatgcatacacacatgtgcgcacacacacgtgcacacataactggtgaagtctgaatcagctcttcagctctttggactgtgccaatgtcactttttggtgttggcatcgcactgggttgcataggatgctggtgtgggaggaagagggttaggagtacatgggactttctgtatattttgtttgcatcctgttgtgaatctctaggaatttcagaataaaagttaaaaagagatcaggcatgagcttggcagcacgttcttggtccagcgtggagagggaacaatgaggtggcctgcgtccttggtggtggcctctgtctctcgcggctctgctgggggatctcaccttggtgcacagcagcctgtccagccacctgcctgtgtggagtcctggcactgtgaggaatgcagaggagggaggtgccacagagcttaaaatgaaagggaaaccagacaagtgctatgaaaaaaaaacacacacacacaaaatacattggctttcatgaaaccaatgacatttgtggacagccaagttcagacatggtcaggaataggccactcgtatagctgggtgttatcacgcgtgggcagggatggtcaggccacttgaatagctgggtgttatgcccagcgcctcatgtgcgctgcctcgtttaatttcatcctttcggggcaggtgttaaattattcccgttcctataccacgggttagaaaagtgaggccctaagaggttcagcggcgtgctccaaggtctaagctggcatgtctcccgccacgactcagccagcattccatttgggctcaggacgccagccctggggacggtgcctcctcgtggctcccccagggcccctgctttgctgcagttttggttgggttcgtcctgacctccagtcgccctggtgagttagggtgacgaggctccttccagcactggcgctcgtctgggaggaagtcgaggcgttctacagaaagacattttaatatgagtggcctgagaaatatattaaccagggatttttgaattgcttcagtgaaaaatgtttttggcttttgccattttggtatcctgcattagttccttctcatggctcatttaggatctatctcctgggtggtcgtttccgttgccttaggctcactttgattacaatatcagctttgacacgagacctagggctccgtgtgacacttgtgctcagaggcggggttgccgttggatgctggtcttcaggccctggtgacacgggctcctggttgttgggtttcacaggccgccctcaggctcctgtgtctcccagggccccagcctcacacactgaggtagacgttgcctcaacggcattgttcccggaagggcctgtggggttggggatggggtttcaggctggtggttcctctcttcctcttcctctccacgcggtgggaggtccctgacggggcttctcttgttctgtcagcctcttggggagcaagggacataaaatgttttgctccacaccatgtataaaacgtgtaattcggctgggcatagtggttcacgcctgtaatcccagcactttgggaggctgaggtgggcggatcatctgaggtcgggagttcaagaccagcctggccaacatggtgaaaccctgtctctactaaaaatacaaaagaaaaagaaattggccaagcctggtggcgggtgcctgtaatcccagctactcgggaggctgaggcaggagaatcactgaaacccgggaggcggacgttgcagtgagcggagatcgcaccactgcactccagccagggcaacaagagtgaaacttcatctcaaaacaaacaaacaaaacatgtaattcgtagctggtaggggcttgagcgttttttgcagtgtgttagaactggcccagatgactaaaaacgtttttaatcatgttttatttttaagattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggtgagtgggccagcctggcaggtggaactaacccacggcgcccatggacatggagccccatgggagctccagggtggaccctgtggggaattttggacacagattccctgacatgggagaacataagatgattctggaatgtaagtggtcaggcactttacaagttctgcccgcgctgactggttagctgtcctgagtgcagtctgggtttgcattcagcagaccttcttccgagtcaccatagaacttgacaaaacagtgtgtgtcccactcttgtaaatcctcgaagcacagtattgaggcagaatcagatgattgtagcatttcctagagtgtgctgcatctcatttgaaatgctgaaagggctttgaagaggtttcttttaacaaaaagtgtgtttcgtctttatttctgaaccagacacagctctgcttttctatatgtccagagtttagttgccctttcctccaaatctggctcctgtcctggccagctctccctcctccttgacttccgtccgtggctgctgaattgaaaatattgtgactcatttacaccgcatcagggtgaggcagggtacaaataaattgataaacgaccgctggcctacacagtccgttttcccgtgacagttcggacattcctagcttcttctcaagacaaggactggtagcagagatgcagggcatgtcctcatggcttctcgctctggcaggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacaggtagggttgagagccacagctcgctgggtacacaggcagcttcacaggtggggatgagagccacacctcgtggggtgcacaggcagctcacgttagcctttgagggtccagctgcgtcagcagagaatgttgtagtctgtgctgaccagggaaggcctcaggaagaggagcagctccaggccttcaggcttctcactgagagatgagagctgtgtccacctttcctctaaggcgagcttgtccaacctgcgggctccatggggcccacgatgcctttgaatgtggttcgacacaaattcgtcaactttcttaggacattatgagatttctttttctttttttttttcttttttagctcatcacctgtcgtgtcagtgtattttatgtgtggcctgagacaattcttccaatgtggcccagggaagccaaaagattggacatccctgttctaaggtcttttgcactctacggagtgggcccctggagagctggggcgtctcagtgggtgctgccggttttgcttctcctcccgggaacccaggctgctgggaggagaagtgaaaccaccccggccgagcctgggcgccagcgaggcagcagcatgcatcaggtttccagcgcgcctctagctgcttcacacgctgcactctgggccctccctgaatttcattcctgggtgaaatgcaggactcgggaaagtctagctgccctgttaaggccacagaaattgccagggggacacaaatagctgataagcaacctctgaatgaagtctttgtcactgagttatcgtgagtggcctgattgtaccggcacgtagatgagatgcttataatgttatccagagaagagagccactttgatgactttttagcatgtaatccctgaagtcgggagcccgctgcaatgtatgttatctagtcctttatggaactttcttttgccaccaaagctgtgatcagccccttttgacctgaaatctctgacccttaatttttttatatctcaaaataagatttttttaaaagcctaaagaaagctcaaaatgcatcacagaaagctgtgtatgttttaacatgtatataacatgacctgtagtgttgattccagctgtgggttattgatttctctgcttccaaatgcttggtcagcacagaatggtggtcctaatgtgtgtcctggagtcatttggggatttctttatgggtagacgccaggacagcaagccatcagctgtggcttaactgacattagacagaatcagccacttggttcacagaagtcagaatcatctgtgtgcacttcacatgcccctgactccacgtcaggggttacagtggctgggacacagctgccactgggaccctcaccgggcaggcttaatctgccatcttctggaaatctttcagctccctccaacttcattgcaacaagatatctgaatattccctgaacctagtatcttcacaaagtattatctcatttaatccacaaacaaccctatggggtaggtactattatcccacttttggaagagaaactgcacacaagtctggtgctgctccccaaggtgacgtcactggggagacaggctctggagtggtcgcccagcgctcctgccgcctccagctgactcagaccacagtggtttcggtgcaggttagcatcctgtctggcaggttgtagattaactgcatctccaataccgaatggtgattgggaacagagtactggtcaccatgtgtggacagggatttacacattaatggggctagacgatcaggttgatgctggttgctttccttatgtggacagaacacagaagatgacctgagggatgattttcctcctccaaagatggggcacagccgtcctaggtgctgaaagacaagtttgcatcattagacagcagctgtctcagagcaggaaggccggactcttcccatagactctgattaaggaaagcctctaagagtgagcatttggcagagtctgtttttttttatttttagttttttgagacggagtctcactctctcattcaggctggagtgcagtggcgcaatctcagttcactgccacctccacctcctgggttcaagcaattcttctgcctcagcctcccgagtagctgggactacaggtgcgcaccaccacgcctggctaatttttgtatttttagtagagatggggttttgccatgttggccaggctggtctcaaactcctgacctcatgtgatccacccaccttggcctcccaaagtgctgggattacaggcgtgagccaccatggccagccatgtttattcttattttttagacagggtcctgctctgtcacccagactggagtgcagtggcgcagtcacagctcactgcagcctccaactcctgggctcaagcgattctcccacctcagcctcccgagtagctgggactataggctatcctttattttttgtttttttaagatgtcttttttttttttttttctttgagatggagtctcgctctgtcgccaggctggagtgctgtggcgtgatctcggctcaaggcaacctctgactccctggttcaggtgattctcctgcctcagcctcctgagtagttgggattacaggcacctgccaccactcccggctaatttttgtatttttagtagagacgaggtttcaccatgttgaccaggatggtctcgatctcctgacctcgtgatccgcccactgtggcctcccaaagtgctgtgattacaggcgtgagccactgtgtccggccaagatgtctttttaagattgccttctaaagcatttctgtttgtggacacaaggtgacgatcagttcgtgccgtcagagcctcatgccatctgttgagcaaatggatggtgcatgaccaccgggttcttccagctaagcccccaaggcatacagagccgggtcagctctgctcccagtggcactctgacggtggagctgagcactggcccgcggtcaccctcagcctgccccgtttctcttcctctctccccagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtagcagtggggccgggccgggggccgagctgccgcctgcagccctcctgtgtggggcagtgcctggagacaggggtgtttaggagatgaacaggcatttgttgggggccacctctgtcatttaaagtaactttattagactcatgagatggtggaaatgagacagctattgaccttggtgagaggacacttgtcgtggacggtttgttatgaccagacacgggtcagtcctcgaccttggagaggccccttgccctctgcctgtacttacaaagaagcgccgaaattagaattttaaagtaagtttctggcaggctcacttgacagccacacctgatctgaggtgatgggaggctgtttataggcttcattcatccacttcatgttcctgttcacctggtctgctgctggaggtgttaggcgatgtgcagcatgtgtgctgttttctaaaatacaaaaagcgacagactctggagtgcatggggcccagctgtttcggttgcctgagcccggagcatggtgcccgcaggagtcttgggtggccctggcctgcagcccctcggaggtacagaggcccctcattcacctgcacgtttttgcccttggtaggaggcagggcaggtatgggctttaggtggggagatttttgggggattgtgtggggcacccaggggcagctgttttggcctctccctgggtgccccgtggtcctttctatgggtcccaagaaggagagaccacagaggtggatgctgtgaccttgtcccgagtcacccagggacttgttccagttctcctggctcctggaggacttagtttggttgaggaaggttgagcccatggtgtactctgtggcccagggcacggcagggcccgaggtattccaggctgcagcatcaggtgcagcctccagctctgtgcaggcagaggcatggatccctgtttctgatcagcctctgttgacagagttcatggcctctcttgggaattgacaccagggcttttttgtggcacaggccatggcctggtcattctgtggatgatgggcagttctgaggtatttgcaggagaggaatggattatattcttaaggcgacattaactttcgacagcgtggaagccagtgacaaatacatgctgacctcagagtcatcctgtttctaaacagcgtgagtgaccgactaggcagtttgttccagcttagcagctgccagggcctataggcagagggagatgcccacagcacagaggaatccagcttcagagccgcttcctcctcttgtttattttgttatttattctactccttcattcttctctttttttttttttttttttttttttagatagagtttcgctgttgttgcccaggctggagtgcaatggcgcgatctcggctcaccgcatcctccgcctcctgggttcaagcgattcttctgcctcagcctcctgagtagctgggattataggtgcctgtgaccacacctggctaatttttgtatttttaggagagatggggtttcaccatgttggccaggctggtcttgaactcctgacctcgtgatccacccacctcggcctcccaaagcgctgggattacaggcgtgagccaccacgcccagcccaggcttttttgttttgttttgttttttaactaaataaaaaagctcctccagactgttgtaagcctttaatttctagagttctgacaaagttgattttgatggttttgccagcattctcactgcttaaggagcagattttggaactcctttgcagtctcagaagtgcttcttcccatttgacggatgaggaaacaaacaaactgcatgtgtcgccggtggcctcccttgttcttgccggcagaagggcctgctttctcacagccattcccacagagcacgtgggtaggactaagctgggaaaagaccccgtagatggcctgtaccagatggtcgaacgggaagtccattaactgagtgaactcttactgagttggtgatgtctgcagtagtctatgagtctctagtacagagttcagtctctcgtgtggtgtgtgtggttagaccagctccttcagtttgtgaaacatctgtcattagtataaagtcttggttggaagtggtgctgctgttgtccagctgttgtgttctgttaattggcctgatatattccatagtcagcaagggtggaaatgttcagatatttacctgcattcttgtcaggtatcgcatattaggtaactgcagctttgacgcagaccagccgcattggtgctttagagcagacagtggcgaaccctggagggaaacagccatcttgtgcctcctcgccttcagtctcctaacaatgcgtgcgttaaatctgtcaccagaatttacagaatttgctcttggtgctaagttaaagaggaattgcaatttgagaatttttcttttccaaaaaaaatcagtgagtgagatgggagtgtcacggagcgctgtgtttcaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggtaacctgctttgaacagccagatcctctcctcgtgacatcgcctttctgctgaagttcctaaagtgtctccttctgaaatttaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtgggtctccacgtcgtcctatcacaggcgcaggctagagccactcagatgcccgcgcgtcacggccttgcaggagctgctgatgtgcctcacgggctctgcgctctccacagtggccagcacccctgtgtgttatgtcctttgctgtgagggcaagggatggttttctctttggttcactcttgtctgtagtgcttggaacgggcctgcctgacactcggcagatgccggaaggtgtcaagtgaacaaataaacagattgggcctcagtcgcagcatggctgcctttgtcatctaggtccgcgctgcccaacactgaggccttctggctgctgctccaagtggaggaaggggtttgtcccccagcggcttccccagcccgtcctgagggcacacagcctggcctggtgctgaaactcgactggcccttggtggccctgagcggccgctgtggttgagtcccaccttgttaggaagctgcccctgtgggctgttcttggttaaacacaagtcgtctcgttctctccctcacgcaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgtccctagccccttgggaaccagaggccccagagacagtgtgggctcctcagcgtagcctcttggtgacagcgtgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagtgaggagggtccagaccatgcagacaatatgccctttttctccaaacaccatttcaaggtaagtgctatgatcagacttctttttattcttggggtaagatatgtataacatcaaatttaccattttgatgaattttaagtgcacagttgagtggcattatgcaccttcgttgtgcagcaatcaccagcatccatctccagaacttttacatcttcccatctggaaaaatctgtcctcattaaacactcaatccccatcagccctcccctccgcccctgccaactaccattctaatttctgtctctgtgaatttgatga

SEQ ID NO: 16725 - DNA, 6604 bp, Human
ggagggagcactctgctaccctccctgctttgctccaaatcaggaacacagtatgattattatacagtatgattattataataacagcaactatttttcagagcttactctgtgccaggagctctataggcagccctctgtatccttggtttctgtgtccatggattcaaccaaccttggattgaaaataattttttaggccgggcgtggtggctcacgcctgtaatctcagcactttgggaggctgaggcgggcggatcacgaggtcaggagatcgagaccatcctggctaacacggcgaaaccccatctctactaaaaatacaaaaaaaaaaaaaaaaattagccgggcgtggtggcgggcgcctatggtcccagctacttgggaggctgaggcaggagaatggcgtgaacccgggaggcagagcttgcagtgagccgagatcgtgccactgcactccagcctgggtgacagagcaagactccatctcaaaaaaaaaaaaaaaaatatatatatatatatatatatatatatttttttttaaattgcatctgtgggccgggtgcagtggctcatgcctgtaagcccagcattttaggaggcagagattggaggatcacttaaggccaggagttggagaccagcctgagcaacatagcgacaccccatctccattaaaaacaatgttttaaaaaaattgcatctgggcagggcgcagtggctcacgcctataagcccagcactttgggaggcccacatgggaggattgcttgaggccaggagttggagaccagcctgagcaacatggtgaaaccccgtctctgctgtaaatacacaaattagctgggcgtggtggtgggtgcctgtaatcccagctactcaggaggctgaggcaggagaatcacttgaacctggggggcagagattgcagtgagctaagatcgtgccactgcactccagcctgggtgacagagtaagactccatctcaaaaaaaaaaaaaattgcacctgtactaaacatatacagacttttttggtgattacctcctaaacaatacagtataacaaccattcacacagcacttccgtcgtattaggtattataagtaatctagagatttaaagtatgtgggaggctgtgcttaggttatatgtaaatactatgccattttatatcaaggacttgaacatccatggattttggtatctgcagagggtcctggaatcaatttcccatggagactgagagatgaccgtactacccacttcgcaagcaatgtcttctttaatgtactgaaccatcccattgttcagaggagaaactgaagctcagggctttgaataactagaccaaggaggcacagcatgggagtgggacatgaagcactctacaattaaccctttcaggacaaggccctgtctcccacacccatctgcccaaaggctctccagggccccctcctcttgggtgtaccttgacaagagacctagattttagctcactatgctgtctgcagtcctggatggtcccactccagtgtctggtgctctgagatggagtcagcattagtggcggatgtggagactggggggacctgtcttcactggggtagacagaggagatgtggactttgccccccatgagcccggcacaaacccagagccgccagcagggcctcgaggcatcagtcccgggctcatgggctccctgaggtgtttctcctactgttttccgttcccctcctcccttccatgctgaggttggtggggtgggggtgggggtgcccacgcacggaacagccaccacttctaactatcgcctgagccctgatctgctgtcagcttccacgtagtctcagggtcacaaaagtccaagaggcctcttgggaatgtgtcaccttccagcgtggagtcacactgaggaaggaggaggggagggcagccaggggggtggcgatagggagagagtttaaatgtctggctggctctgagcttcagtcagttcccactgcagcgcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggtgagtagaagctgtctttggatggcactcctgggctgctgctctgagtagtgcaggatggaggctgagccaaagcaaaaggacacttctgagtgcccatcagcccccagctggacatgaggtctgcctggctgccaagtggctcacaggagagctggcccagtcccagtggtgggcccattggcattggtgctataccagtttcacatatccctgtggcttccaaaaagctaagctcagacagggaaaatggcaggttgaggcacccccaccatcatccagtctgcagctcagagctggagcagaggggccacacaggagacggggcctcatgaattgctctctgttaccacccaggagccagggctgaggtcagtgctgaccaggtggccacagtgatgtgggactacttcagccagctgagcaacaatgccaaggaggccgtggaacatctccagaaatctgaactcacccagcaactcaagtaagagggactacagtgtgcggtggtgacggggaattcttaaaggccatgcaatgtactggcaagggttgagcttagagacaggagccctgagcttaggatacccactgccctgccactaactggccgggcctctgaacctaggatccacatatgtaaaccggaagtttggaccgaataatccctgccatgtccttttgctttgacgttctagagtttgacaaatggccacatcctatcattcaggctcatggaagagagggagggaggaaaatgtcacgtgagctgatttctaatacgtttcagaaagacaggccccagtggaatcaaggggagggaggtgggaatatttgggaggcccctgggcacaggcaaggaaagcagcaccttgtgccactggaagaccccagcagaggtcaagaagacaacattgtgttacacaatgtgatcctatggcccagaacactccctctgggaaggacctcaaagtcccaccctctgcagacaaggaggggaaagcaaactgctggaggtgacatggtgggtagattctgagacaaactatgtgggagatcctgagatagaaattcagcatcgtaacttagtctgtgacacccatcctctccaatctgcaccaccatagggagggtgaactcggtacctctgagcactcacctgtcctagcacgtgtgcataaggcgagtggtatacaagcagacaaagtcttgccgtgtaaatgccaaatgtaacgtggcctccttgtgcccttccccacagtgccctcttccaggacaaacttggagaagtgaacacttacgcaggtgacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcaacacgcaggccgagcagctgcggcgccagctgaccccctacgcacagcgcatggagagagtgctgcgggagaacgccgacagcctgcaggcctcgctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccgaggagctcaaggccaggatctcggccagtgccgaggagctgcggcagaggctggcgcccttggccgaggacgtgcgtggcaacctgaggggcaacaccgaggggctgcagaagtcactggcagagctgggtgggcacctggaccagcaggtggaggagttccgacgccgggtggagccctacggggaaaacttcaacaaagccctggtgcagcagatggaacagctcaggcagaaactgggcccccatgcgggggacgtggaaggccacttgagcttcctggagaaggacctgagggacaaggtcaactccttcttcagcaccttcaaggagaaagagagccaggacaagactctctccctccctgagctggagcaacagcaggaacagcagcaggagcagcagcaggagcaggtgcagatgctggcccctttggagagctgagctgcccctggtgcactggccccaccctcgtggacacctgccctgccctgccacctgtctgtctgtctgtcccaaagaagttctggtatgaacttgaggacacatgtccagtgggaggtgagaccacctctcaatattcaataaagctgctgagaatctagcctcaactggttgccggatgaatcctccttgcagctggggaggtggggaggtaaccatgactgggcagagcttagcagcggcctggcaggagacacccaggattggggagatgagactgcaggagaggtaagggcctggtggactggaggcgagtacatggggagtcctctaaggggaggcagaaaaagatgtcacacattatcccaagacaaaatatgcaacctacttatattcatttagccaacaaatatgcattgaatgcctccgatgcgccagtcattattctaggcaccggacaaccagcaaacagcttttgtgcagccatgtgcccgactctgcctcacactgagggggacacctggaggcgagcagaacagggtccctggccctggggggctcacagtacactgggggagatggttcctccttgcacgagatcttcagtgcctttaacttattcatgtagtgtcatttaacccaccccaccccagttccattatgaaagcgattcatgcttatttcagaactttcttgactgctaaacctgtggtctccatccagaattggggattgaggcttggggaccgagacgagtctggggaggaggggcagagcaggtgctggagcctgcggggccctggtctgctctgtccaggggcctcctgccaggtggcctgccagtttggggctgagtttgcagccactgggattaggggcagagagtcagggggcctgagcagtctcatcagcacagccagctgtgggcagctgcagccttggagtggtctttcaccccacccttagagactcgaaaacctcacaaggaaagagccagttcaagcgtttgtctcaaacgactccacagcctgttacccgtggaccccagccctgcgagtctagccacctccctttcctcgccacagggggatgcaggcccttcagggctttcctggaagaggcctggaacatgctaaggaggagggggaagtccccttggagggtgtcctggggcctcctccttccctctcaaggtgccctcagggtagtggcccccagcatggtctggcccaggcctatacccctctggcccctggtgctggcctggtgggagggatgtatgcttgggaatcagacaagcctaggtttgaatcctggctttttgaccgactaccgggtgatgtggggcgaataattgagcttcttttggaagacatgggtaatgacaatcctctgcttagagaggagttgtgctgaaggtttgatggagcaacggagtcaagcacttaacatcaggcacggaataaccgtgcaatagctggtgctgcagtaaatgtgacttcctcatcccgctcacctccaggccacactctattaatgagaccgccacagctggccaagggtagacccccgggtctcccctgccccagctgctctcgctcctgcataccaggccagtaaggctgctgcggccactttgatacctacccccactagaagcacaggaacctatggggaaacaccttgacaaacccaccaggcacctggaggtttactggatggctttaggaaagggccaatgaggccaaacagagcaacgagtcaccaaaaggaagtgagatgcagggtgggccgggttccaagagggtctggaagcttctgagatgctctcagacctcacctgagggctgcctggtttagtgctgactccagaacccctgggggcctcagtgtctcccagaacttggttcttaatatgaaccctgggccgggcgcggtggctcatgcctgtaatcccagcactttgggaggccgaggtgggtggatcatgaggtgaagagatcaagaccatcctggccaacatggtgaaactccgtctctactaaaaatacaaaaaattagctgggcgtggtggtgggctcctgtaatcccagctacttgggaggctgaagcaggagaatcgcttgaacccaggaggcggaggttgcagtgagccaagatcgcgcc

SEQ ID NO: 16726 - DNA, 13908 bp, Human
gaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcatatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgatagaagtttgcctggcgtgactctcatttggaccatgtctgaaagcagtggcctcaccactatccccaaagcacacccatcacccactccattcccttgctgctctttctcatccacccactcccagtccaggtctgtcaaagggggtctggctgggctctgcttcagggatcctggctagacaacggctgtctgtcacacctggcaggagggcctgggttacgggcccttcctctgcacctgcactgttcactagcctgctcccccacaggacactgtgcatggaatgcaggctgtgtctggaagagctgtggccctggtggacctaagattcctgaggtgggctgcctcctttgttcctgctgttctagagtttgaatggcctctttttatgccggactctcttctggggactcccctcactcaggggcaccaatgctccctatagatcccctgggaactgaaactggggtgtggtggaggacgtggaaagggtaaacacagctccttgtctttggacttccctgtccggccccctttcctcccagctcagcctactgtccccgggttctcagcacctgcctgctccccaaccccatagcacagaccccacacatatgtaggctcatcatgcctgcaggctggtcttccctgacaccgtggattttgacaatgttggcaacagaactgggttgtggacccagcacctggagagaggaagtgctagaaaggtagaaataataaaaggtgtttttgttgttgttaggaaactggaaaagcataggtcaagggctatgatggggatgaggaggtaggagtgaaaatgagggctgtgtacttgaggctgggattggggaaggtagtgatgaggacagaatagggagtgggaagaacagaaagggacagagggattcagggattgtgagagaggggaagaggctgagccacccggaggggcgacctagcacgcaagcagtatgtggcccaacactggaaccaagcagcccggctccgggcgcaccttctcagggattcctcagggacaagtccagccccttgtcgtcaaggctcttgtagaccgacgtagggaccaatagaaccccgtgcggtggagctattgtgaaggagcaaaaaagtgccctggttctaagaggacgtcttaggggaagtgacggctgagttgaggtggatccggctggcgatgtaaggttcgagccatataaacccgggaaccgggagcccttgacgacattgttccccgagtgcccggagtctgcggctttttttggggtggtggcagctggcggaagtgacgggagaggggtggggccgcgagagcggcggaagtaggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatgtgaggcgggggcgcggccgcgagcggcgggtgggtagggcttgtgccgggacgagccgggggtcagacccagccaggtgggcccggccggggaccccgaggagcgcccggagatagtagggcggggaaagggagtttcattgatttttttccttagctactttctacttcaccagggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggtgagaggacctcagagcaggtacctcagtattctagagagagattcggtactggggtcagagctctggtccaggcggtcggatcttaaataaatccccctatgtctcctagccttagtttcttttgtaaaatggtactggtgttgtcatcagctcaagtgagataagatttgtgaaaatgctttgtaaatgttgtctgagggtatgaaatgagcagtagttgttatgaatagtattctcaccatttggacagcctggctcacaccacctgtactattcgaaaggagcagtctggaccctgtggagtggcgagagggagagacagctgggctgcggtctgatggaaggggacggtctggttattacttgaggagaagctgttctgcagtctctttgtactgaacgtattcttttcttcccaggacatgaacagagaagtggtgaagactgactctgctgccacaaggattcctgagctagattttgaaattcctgcctttagccagaaaggaggtaagtttaagatcagagtatttgggctgttcgcatgtagctagaatcttaccctctttcttgcaaaaccccctggtgccaggtctagtggtttgtgtatgggttctaccatgtaatcattgtaatcttcattagttaatcatgagtggaaagcttaggtaaaacagctcgagatggtagaaagtaatggtaataccatagtgtgtttattgtagaattttagcatcactattatcagacatgaatggaaccttgcacctggccttctcattttacagatgaggaaattaagacccagagagttcaagtgaattgcccagggtcatacagggacttgatagcagagctgaggctaagtcacacttgtcttttgttcttgttcacaagctctgaccactgttgaaggattgatcacccgtgctatctctggcctggagcaggaccagcctgcacgaagggtaagctggggttttctgattgtagcagctcaaggaataattgcttatatagagtgtcccatgtgtctgaagagtctctgactaagtgttggaaacttgctgggtaagcatatggtggtgctggagctgctagaatgttgcatatgttataattattgtcttttccacttccctccctcagtatatattcaggcctcatcagacaatataacattacctctgaagagcctttcctaatccccttgggttatctgtgtttcctgagtattccactgcatcttatatttattatgacagaagtaatatattatagctgcatctttagttatttgtctccttaattggttggggagtcccatgagaggactgatatatatactattatatctctaacgtggcatgagtgcctgggctaaatggttgaatgagtgagaaaaatgaggctcacctgtcaccacccgtcaacttcaggcttgtttgctacatctcattgtgaagcctgagtcactctgtttccactcacactgagataggtggtgacttcctaatggaagtaacatgggcatgacaaggggcagggcataaggtacaccaccagggctgatgctttactctctgttcatggcaggcaaacaaagatgctacagctgaaagaattgatgagttcattgtcaaactgaaggagctaaagcaagtagcctcccctttcactctggtgagtattgagaggctggagttgcccttgattaggggaggagggaccattaagactgctgggattttccactgtgatgcctgcgtggtctgatagtaggtgatgtaggattgtttatgattttcttttgcagtgactctctcttctcccatttgttagatcattgatgatccctcagggaacagttttgtggaaaacccacatgctcctcagaaagatgatgccctggtgatcacacactacaaccggacccgacagcaggaagagatgctggggcttcaagtaagtggactgaaggatccagaagaatgctctggaattatcgcgcactctggattgcttggagtcagtggaacttattttgctgctgctgctctgtgtgccctatctcagcttgtttgtgcttctcatcttgcttatgtccaggacttgggtaaacttcacagaaaggatggcagtggctgtgatcctatcttaagtcctgttcttcctttggttggggctttactttgtggtttctctaactgatgaggtggcacctgacataactgatgaggtggcacctgagcatttctcccactccagggcagggtgttggggacactgaggtatacctgccaacttgcgacctgcatctttgctattttaggaagaagcaccagcagagaagccagaagaggaagatctcagaaatgaagtgagtcacattggctactggtgaggaaggagcagagttgtgggctgagactgatgctgttcagcatctgtcttccttgtcaccaacatagatgaccactagcataccaactgagtgtctttagcctgaacatcccatctgggagggctcaccctttgtcctcatgttgtgttccaggtgctccagttcagcacaaactgcccagaatgcaatgcccccgctcagaccaacatgaagctagtacgtatcttttgccaagcagttgggttgctcttcatctgactcaggcatgaagattataatcaggctgggagcatccctttcaaggaaaacacatgctttatacccagtgataaggaagatattatctttgattagactgtgtaccttgggttttgtgttcaaagagaaaattaggccatggtcactaggctgtgtgtgtgtgacctgagccatgccttcaaatgtgtgaacagggattgccatgggttgggaacttgccctcttctggaggactctgtgggctgcctcttgtgaatatttcctgcagttctgggaccagcatatgtttgtgtggggtttggctttgtttttccccagatggtggtcttgttcgcctggaagtagatttccttaactccgttttccagaaatccctcactttaaggaggttatcatcatggctaccaactgcgagaactgtgggcatcggaccaatgaggtgggtgggcgccattatttgggaagaagactagcttaagggtaacccccttttaactatcattcttcctaagtacttcagtactcgggggcagggggtgtagagtagcttgggtctttttcttaggtctagtgcagggtgatgagcccttgaaggaatgggaattagcctagagaagaaaagttagagattctataacttgtttaagacatattaaaggttgatgatatggaagagagaagtcttttgacccactcctcagaggtgtggaagttcagggaggcagactttgacttcacaatgaagaactcaatagagctgtctgaaaatagaatgagctgccttagagaattataaattcccttcccctgagtgtatctgagtataagctaattaaattctttaaccagaatattataaaggagacccacacattggatgcagtggatgaaaggactgcaataaatgcttaaaagtctctttcaaccccaaaagtcttttttttttttttttttaaggtaaattcagagtttattggcaatttgggataagttttggcacgttaccagggttgggcactgttcctggccagctcttggtgtttttggtttgggcgactgctgtttagaaggctctttctttggtagctattaatggccctaactgattggatgtccaagcctacactccaggtctcctgggtaccaagtgaggctcaggtcttctctctgttgctcctgactgttatcgatgcaggtgaaatctggaggagcagtagaacccttgggcaccaggatcaccctccacatcacagatgcctcagatatgaccagagacctcctcaaggtaacagtctgcttgggaaagtcactgttgtcctcataagttagataaactgtctctatctaggggaagttgtcttttagaaataatgttcagggacatgaggtatctcctacttccctggctttgaggacccctgagcagagggagttaatctaagattggaattgcaggtttagaaggtgaccctgttagctctttctgatgacctggtagctttttggcctccagtgtctatctgggtcctcttctctgtctgtcccctagtgacaggatacctgacagctcgaagctatgactgagtttccctttattaagttggatctattcccgtggttcagatggacaggagtgagtctcaagctttaacaagggagtcagagaaaactgagacagctgcccttgtccgcagtctatcactgctggtattaattgggcaggaggcctctggttggctttctttgcttctgacttaaagcttaaactgacctctcatttcacagtctgagacttgcagtgtggaaatcccagagctagaatttgaactgggaatggcagtcctcgggggcaagttcaccacactggaagggctgctgaaagacatccgggaactggtgagtcacttgagtagtgtgtaaaccacctttgagcaatttggctgtgtgaagagggactggaagacttcagacatcctaattttcggtgctggtaactgtgggtttctttgccttaaagctggtttaagagacttaaatattactttggatggtgaagacaagtttatgggaaatgttgaatggaaattccaggcctaactttgggactttatagttattttgtggtcttggacaagtcatttattttactgtaaagttaggggatgagggtccttctagcacctaaaacttcccaacataaaaaacatacatgtatgggttgacttagcccaaatatttatctccttgatgaattatttcacttgattctctgttgggcattttgtatttgtaaattgtactttttctttgcatttcttctccaaattagtatcagagatcatattctaagaacatgtttcgattttgttttacattgccagttttgttatcttggcacattatcccatagactcctaggagtgactgccttggtcagaaaggtggtgtgggctaaatggaaaccaagtttccctgacagggcacccactgtcaccccctgcctagtttatggtcaggcctaacaaatataaagccagtattcacatagtttggattatcatttattgcaggtgaccaaaaatcctttcacactgggcgacagttccaatcctggacagacggagagactacaggagtttagccagaagatggaccaggtaagaggtcactggccagtcagtacttagaatcctggggctccagtgaacaggaggctgcatgctcatgtcttgccactttttgaacatctaaccatcatgttggggattcttcttctggttttcttttcttttttttttttttggagacagagtctcgttctgttgcccaggctggagtgcagtggcgtgatctcggctcactgcaacctctgcctcccgggttcatgcgattctgctgcctcagcctcccgagtagctgggattacaggcgcacaccaccacgcctggctaattttttgtatttttagtagagacagggtttcactatgttggccagactggtctcgaactcctgacctcgtgatctgcctgcctgggcctcccaaagtgctgggattacaggcgtgagccaccgcacctggccctcttctggttttctatattccatgtcttctttcttgtttttctcccttattttgttagagcatcttctccagtagcttcctgggaaaaagtgcatgggaaataaaatttctgggaccttccacatctgaacatgtctttattctgttatcacactagagtgattattggctgggaatacgattctaggatagaaataattttttatcagaatttcgaagactgcactatggtcttccagtttggtaaagacattgtactatagtcttccactttggctattgagaagtctgaagccatttgattcctggtcttttatatgtgacctagtcttgtgatctcttcgtttcctttgatgtgaaatttcagggtgtgccttggtgtgggtcagttttcatccactgggctaagcacttggtagatgtattttttcagtctggaaaactcatgtggttcagttctaggaagctttcatgaattattctattgaagattatcttttttctgattttttttttctgttctttctgaaaactcctgggttttagatattagacttacttgtctggtcttctataatttactctttttttggtcctatttttggtttcttggtttttttgttcttctttgggagattccctcaactttattttccaacccttcaattgaggttttcatttccactaaaacttttattttccaaggagctttttaaaaaatagcatcctgtcttaaggatgtagtattttttcttcttgaggattattattttttaaattttttcagcatgcagtttatatagcacttattgatactgatgttggatcttttttgacattttattctccttgcatcctttttttccccatttgatttcccatctttcagtgttaagggctttgctcagatgtctgataatcattgattgtcttcttacaagtagcgggctaaagacctgagtagggggtgagccttgttgacatggggcttattacaggggaatttaacttagctgttttgctgaggtggcctccaatgccagaattgttaggtctttcctcttgggctagtcagacaaagaggctatgcctgccagacaagaaccaacccaatttatattacagaatcctccaaagttttaagaattggtgaaattaggtagctctgaaagtagaggggaaaggatctaaaataaggactgttagaaaagccaacatcagcaagctgtggaccagggggtgctggcccagttgaaggtagagggaaaggactcaagaacaaggaggttaaatgactgtggctgctccatttcctggcctgagggtaaagacttggctggcagtgttctgagagctgtgggaagggggctggggtgtgtatgtattctgtttcccataagcttacattcatttaacctacttgttcttgattcctttccctctaccttcaactgggccagcaccccctagtccacagcttgctgatgttggcttttctaacagtccttattttagaacctttcccctctactttcagagctacctaatttcaccaattcttaaaacttttggggattctgtaatataaattgggttggttcttgtctggcaggcatagcctctttttttaaaaatttttctttactttcatttatttcatttctttttttatttatatatatatttattatacttaagttctagggtacatgtgcacaacgtgcaggtttgttacatatgtatacatgtgccatgttggtgtgctgtacccattaactagtcatttacattaggtatatctcctaatgctatccctcccccctcccccgacatagcctctttttaccaggggttatgtaaaatttacttgctgtgttctctctctcctttagatcatcgaaggtaacatgaaggcccactttattatggatgatccagcaggaaacagttacttgcaggtatagtagaccttccctgatgtttcatagagatacattttctgatcttccttgaatatgtatcatttccctagaaactgaaagacttgattctaaatggactgctttttaccaaggaggcagaagttagaagatacataagggagaaaagaggggggtgtgggaggggattttttttttaagtgtatgtaaagaaggaaaaaaaaaggatactctgaggccccttttttttctgtagtcaagctcttgtcccagttctggagttttcattttgcaaatctgattatggattgaggagaaatggtaccttgtccggaggccaagataggaaactgataggctttaagttgactgaggagagagtctggtgattgatgtacctttaccatttattggatacttaccatgggtcaggcaaaactcttctaagttctttccaagattaagaccatttgtcatacttttcataagaaggtgcagatataacaaaataggtggattgttccctgattctggggctggggtcttctacccctggcccatgtgggctctgttgctacccactagttcagtctagccatgggaaattggaggccaataaaaagaaaaaaacccaaaactcattctgttcttgggaaggtgggaattggaagctgcctgcagagagggggagtggcacagcggcactgattgtctctccttgaccttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggagtttgttgttggttttgagtatataaaatactgactttgaacaggaaaggagtctcctgaggggagaccgagtccagcacaagtgaaggagttaccattgaaatgatgactttcaaacagcactggcctctgtattgaccctatccttgtttgatatcatgctgttagaattcagcctcctaaagaaaattttcccgtgtatctactgtaatttggggattgcagctggcatttaattcattccttcagcagatgcttgcttatctactttatgccaagcacaccacagaacagaggacaaaataaatctctttcatggaacttgaagtctagtggggaaaaatgacaataaacagatgaggaaaacagtacatcagatggtgattagtgtcatggaggaatgtaaagcagggaatggggctgggttgtgcaaggaaatggggagtagggaagatcttctgaacaagaaggtgataatttgacatttgggcaaagctgaggaggaggtcagggagtgagctgtgtgggtatctgggggaagagatttcctggcagagggaactgcaaatgctagagctgtgaggttagagccagtgggggtacctgatcagttagccctactctcagttagaaatgttgaaacacattcatccagagagaaaggaggctctctgcagttcttctgaaagttaaggaccagtgaacactctgctgcttgggccctggacttcccagccagtgttctttgcactgtagtctcctgcctctcataaacaaaaggtgactcctgtggtgcagactgcagggtatttgttcaataaagaccagttcattgattaagatgttatcacaaaccttattgctttgtgttgcaaactttttttttttttttttggtagagacagagtctcgcgctgttgcccaggctggagtgcagtggtgtgatcttggcttattgcaacctttgcctcccgggtttaagcaattctgcctcagcctcccgagtagcggggactacaggcgcacgccgccacacccagctaatttcttttgtattttagtagagacggggtttcaccgtgttgcccaggctggtctcgaactcctgagctcaggcaatccgccagccttggcctcccaaagtgctaggattacaggcgtgagctaccgcgtccggctgtgttgcaaacttaactctgaagaatgagttagagatgatttagcaatcagacatctactctcgttgctctgttaaactactctcaaaggtcacaagtgattttccacttggaaagtgttatctatttctgtcacatttgatagtggaccatctcttcttaacccttcttttggctctcgagatactgtacccttggttttcccttcactttgaatatttcttatttggacactttgcctcctcccctcttactaaatttgtttctgagagttctgctttcagacatctctccatatcagattctttggcatcttactatcatgtgggactaacttccatacctgtatctctaatttctgtaagtgagggcgagagtaaggtgtttggagactcaggttagcaaatgactcattcaaactataaagcttcagtactttgggcaaacttctcacaggcaactattctaccctaagagattatctctagatatgtttccagctgacttgggaatctaagtttaccagacaaccctctgatctatcatttggtctcttaagtagacttccccatagtgtaggtgtgctctgttaagataaactgcagtatcaggttcattttccattgtgaaggaaaaaaaatggcactctggcttattactgaatctcttgtgagtttggttggtgtgaggcaatctcccagaatccacccagttcctaggaaatgatgacctgagtttctgaacttgaagactgaggaccaggtgccagactgggataacccagctaaggtacttcctgccctttgatgacaaggcattcttcagtttcatacccttctcttgaattatctttcagctcctttctcatttcataaagtgtgtcaggatgggagcttacatatagttaactgagtcttgctccacagcacccagcatatgacacatggttaataaaatctgttaaaatcctccatcatagattaaaccctattaggacactagggataacatctataggtaaaaagatagggaaagggtctcgctttaaggccagggtaggtgagtcaaagtgccaggaacatgtggattcagtttcacagccatgagtaacatttaagtggaaaaggtttg

SEQ ID NO: 16727 - DNA, 9932 bp, Human
cggtcggcccgcgctggggccaatggaggtgcgaggcggggctcgggcgggggcaacggtcacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccggtgagcgggccggggtgggatgcgctgtggcggctgaggcgccctcgcccgactccggcgctgtcctaggcgaggggtggtgaggcccggaggtggactgttccttgctcgggggctcgcagcgaatctgccggcgacagagctccagtccacatgcgcccccgtctgacagcacctcttctgtgccctgccagggacttgtgggctcctgcggccgacactcatgaaggccacatcaccagcgacttgcagctctctacctacttagatcccgccctggagctgggtcccaggaatgtgctgctgttcctgcaggacaaggtgcgcccgccccagcccactctcccccggtcatcgggaggcagccaggccccctccccccatgacactgacgcccattccccaagggaagcttcagtgaccttgtcccaactgtagggaggtgtgggtcgtctcatgggaaggcctgtagtaaacgcttcagtgggcatggcgacagcctcggaaatggcaccaacttgattggaggaagcgacggaccagaggccaggtacctactgagtaccaagcactttggatatctgacttagtccaatatggtgggtggggattatcgtccctgtttgtttatagatgagaagactgaggctggaggttaagtgacttgtccaagctcatacagctaatgggtggcagagttgtaattctagctgtgatgatcataataatgataattggaaaatgctcacctgtttagtgctttgtaggcacttgctacactgatgtcattatcttggtttcactgccaaggaaagtaaggtttgtcgagatacaatgtttcactacagttgatagataccactttggttccagcctgagtctgccaatcctccctcccaattggagctcataacccgcatgctgttttccttcccatccaggatctttgccccaaaagcaggcgtggagaccatgagatgactctaagatagcaagtctctgctaggccctcccttgttggtggcctgtatggctcattgcccttgtagtctcccttggttgctgtgtgggcagatggtggtggcctgaagtcttttcaggaggtggtaaataatatagtcaaataggaactgagtcctagttctaccatgtaaccagccattggaggcatgaaataatctttgtgaatgacagtttctacatctgtaaaatgaagacaccacctatatcagagggctgtgagtgggaaatcttttttttttttttttttgagacggagtctcgctctgttgcccaggctggaatgcagtggtgcaatgtcagctcagctcactgcaccctccgcctcccgggttcaagcagttctctgcctcagcctcccgagtagctaggattacagggcgcccgccactacacccagctaatttttgtatttttttgtatttttagtagagatggggtttcaccatgttggccaggctggtcttgaactcctgacctcgtgatccacccacctcagcctcccaaactgctgggattacaggcgtgagccaccgcgcccggcctgtgagggggaattcttataatccacataaaacatctagccaggatcccccagtcttagggcattcacccattcattcatttgcccaatatggaaagcctactatgtgccaggtattgtgaagtgttggggatatggcagtgagcagaagaacccaagcccccaccctcaggaagctgacattcttgtgagggtggccagtaaatactaagtcggtataggatatgatgtcagtgttacggcctttagggaaggaagcaggctaaggggacagagtgactgggatgctattttagataagggtggtcaggccaggcctcattgaggaggtgatatatgagcagcgatcttaatggagggagggagccgtttggggaaggacattcctggaacagcaaatgcgagggtcctgggcgaggtgtgctcttggccagctcaaggaagagctggtgtggctggagcacagtgagtgagagaaaggggtaggagatgtaggagatggtttgcaggtggctaggcgatgaagtaggaccttgtaggccatgagggggaaggtcagttgcagttcgaaatgtgtgagaaagccttgggtaacgtggagcagggagtggtgtgatttctcaattaaagaaagcccacaggacccaccagcagttcctgggctttccgactgagaaccccggtggccaaacagcagcaaggtcctgcccacaagggaggggaggctgggcgagtgtgtataccaaacaggttagggaagctgattaaaatctcctcagggcctaactgggaagggccagaggaagctggggatgggagtggagggtaggagcaaaaggacaaaggacatctgtaggttgtggagaaaaagggatggggtcggggccactgtggtcctaagagctcaaaagacttcaatgctcgatgcttcctccagcatgttctgagatcctcacctctccccttccgccaaaagcaggtggggggagggtcccgtccagactggacatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagaggtgagtctcccaccccacccccaccaacacacagttgtgctccaccatactgaacctgactctcagtgagactttgctggccctgagaatgcacggggaaggtggctgtcccctgccttggcccccatcacttgccaaacctcctcagatgtctcccctatttccctaatagctgagcattgaggatttcacagcatatggcggtgtgtttggaaacaagcaggacagcgccttttctaacctagaggtgagagtcctctcccagccaggggccatgggggacattctgtgctccttctcccagcataagaactgtactctgacctcatatcagggttacttgggtctgagtctcttctgggtcaaccatcccccccaaaaacaacaacaacaacaaaagccacctcatactcttagggagcagagacgctggctttggggtagaaaggcctggggcctgaatgtcaggggctggggtgtgggccattttcttggtgagcctttatgggtatggcttgccagaggagagctgccagagaggtgtggggggctgggccaggcccactggcccctggctaactcaccttttgcctctcccctgtccccagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccaggtactgcccgcatggcccagccaccagcctcggggcccagagagcagcaaggccctgggctatggcatgtggtggcaccgtttggctaaagatgccagtactccccaccccctcacagcccttccagaaggtgccctgtgtggccagaagaggaggggagggcctcttctgtgactcaggagttggtgcctagcactgagctgggcctccagagatgaggcagatgtgagccctgcgggtggggagccttctcacctagccaggcccttgtcacagagcaggtggccaggacttgagtgtgactgagaagcctcggggtgggatgggcttccaggagggggcactgaggtaagagtgtgcaggcttggtgcgtggggctagtggggaggagaagctggggtcggggaagggtagtgggcagtgcaggtccaggccgcctgaggactctggcgctctgtttgtcttccatagctctggtctgatggcacccagggaagtcctcacaggcaacggtgagtagaatcagggaggatgcacgtcctcatctagcccttgggtgggggccacagagagagctggcctgcagttcctcggcctcctcactcccagggtggcccgcctgcttctcggggcagctggcagtggagcagggaaatgctggctcccaggaccagccagggaccacctgacagaagaccctgtccagccagaccccacttggcagaggggggcggctctctgtgctggaggctgtggagccagtttctgtgcaggcagcgtgaatcctagagttatgggtttaataagactgcagacatttggaaaaacaattctggggactcatctatttgcaataaaggacagtcactccccatggaaaggcagtcgtgaacctttcatgggtggatgtggagttttctgtattgatatgtattttcttatgtcacataggtagggcttggcattagggaatcgatgactgaagccacagttgtctctgggggaggctgggaatgggggtgggatgagaagtagctgctcctaaggatcctcagtggaaagtaaacacaccactttcagatggtctagaaggtttctaaagcagacagtggggagtgtttctttatgcagggtgcctggtgacctgagtctctgctctccttgttgaccctcagatgaggtcatcgggcaggtcctgagcacactcaagtccgaagatgtcccatacacagcggccctcacagcggtccgcccttccagggtatgtgcccttccagcaggggctctggggcgtgcagggagaggcagtgtggtgagtctgcttggaggtggggagtgtatgccacaggtaggctgcccaggaggcccagcataggggaagcatgaggcacagaacccctgtggtgtgactatttggagtggctgactctgggggcagggctaggatgagcactcaagtcctgcctccccattccaggggcagctttccatctcgtcctgtgaggcttgtgggtggcagacttggacactaagtctaaatgaccctaagtttgagggactaggaatgtcatcagggtttagggggcatcagggaaggcttcctggaggaaaggtctcctctggctgatgggactttgagatagtggacagggtgtcctgttgggaggggaaggagggcacgacaattgggttcaagtgtgacactctcccagggctgctgaaagaaggctggttgggtgtttctgcaggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggcaagggcactaggctggggaggactgtgccaccacaggtgaccttcccatcactgtgggtcgcaggtggggcagggagccagggtcaggtctgtgttttggggtggggatggccatggtctggttggggtctgggcagcgtgaggatgtaggaggtgtcatggcatggggtgctgttggagggggagttgctcagacttctgcctccccatgcttgcgagtctttggttgggaccttggttgttaacacctcaaggttacctgggaacctgtcacctcccccttgagcaaaacctctgggactttgtgtgggcaaataccaggccagctatctgagccatttatggggcaaccatgcccttctgtttgctctcgcccccaaagcccagcccaggcaccttagtgaccctaagagggagtaaaaggaggggcagtgagctcaggggaaccagaggaaggacccccatgctggtggcaagggggacctgggtcctggcttccagctctgttccgaccttgcaatgtgactggatcctcagttttcctatctgtcaagtggggacactgcttcttcaggtggctgcaaggacccaaggcagcttaggtaggagcagagctgaggaacttgttcctctaagatgccaaaggccctcccagagcctcacagtgcgcctctttctctggccccacaggctctcactgacctatgaacgactctttggtaccacagtgacattcaagtgagtcctgggggtggttgaggtatgggtgggctggtgtggccccagcctccccagctcacctgacatccctgccaccttccccaggttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccaggtatggagcgggcgtggcccagcttcaggtgggggagcccaggctagtggttgagagacgaagagaggcttgggcttgggcatgtagttgagagtcctgtccctgcgctgcccctgtcccagttcttgctgggcctcccaacggtcctttctgacccgtgtctgtgtgtctgccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgcgttgggcctcttgtcgctcatttctgcgctgggctttaggcgcgtgctcgccggagggatgcgggaggatggagcctggcgagggggaggcgaagaggcatccgcggagaccgggaggggctttagcaagctgggccctaaccgctcagggtagggaggggcggtcgggccgagtcccggtgcgcttcggcgtctcaggaggccgtcgtgacaatggcagccttcgcgtcgtgagggggccgccccaggctgccgcagcggcgcgcgcccggccgcggggccgcgccgagactcccgggggggtgggcgggggtggggaggtgggcgggcgcgcgcggggcggggcggggcggggcgcggcgggtggggcggggcgcgcgcggctcccgcgacggattcttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgtaagtgcggccccggcgcccctggccctgcgtcgtgccctcgccatcccccgcgatgatgcggccgccggcccatcctctggtcactgccatcttctgcgctccgctccccgaaaagccggcgccgtgcccaccccgctgctcccccagcgacgtcgcctctgctcgttgccatgaccccatctccccgaagaggcccccttcctggccgcctcctgggctacccgggtccgacccccggcgccctcccatcttccctacccctgcccgctggaccggaaaacgcacccccactcggcccgatgcccacgaccccgcccacccatcgcccccacccatcacggcatccacccgtcgcccgcacccattgcccgcctagcgttgcctctcagcgtcccttcccatcttgcgctaatcccggtggggatgaagtagaaggacctggggtcagggggcctcgccagagtgggccctcagcccgcctcctcatcgtcttctggggccaggggatccagggaatgttccagaaggaacagcagtgggggcagtaagcacattcccgcaaccccacctcggttgcccatggagacctcaggctgggtagcatctgcagcctttgtccttgggctagtgacagtgactggtgagggtgtttatcttccccctttccccgaaaaccccgttggcctactcccctcagagactcttcttcctcggtccaggcccagatgcccctcctcagcggcaggggctcctgctatttgaagaaagagcagtccagggtggggcctacaatttcaaggactgtgctaagcctttcttttcctccctttcgagtgtcctttgcagtccagctgggtcttctctgtgccttattgtgttttatccgcctttttgtgcggctctgcgtaggtagatgcctctcggcgtgttggtactggaaggccatcctgtgtctgctggatgccctgcctccctcaaagcctccgttatttcactctccgccttgtgagggggacgggactcctttgcccagcaaggttgcaatggagagtgtggtcggatgaagccatcaccccaattttaggcgaggcaactagccagtggggatggtgggtggaaggagctgtccactgaggcaggtttgggtggggaacaaatcaggtctgctggtaggagcggaggcaggtgggagtgcagcggatggtgtcaccctc

SEQ ID NO: 16728 - DNA, 29966 bp, Human
tgggggtgatgacctggacagcctcagagagtttcccgtcaagggtagggtgggatttgcagtcatcagagggtctgggaagggcgtgtgcaggaaaatctgagggcctcagggggttcttcctgggaagtgcaggcagaggagacatcgggatgcaaccaattctaagtcaagaataagaaaactgagttgctccttaaggatggaatggcttgcaagcagtatatgctgtataacttacaatcccaacatgattgagttacgaggaaaaaatatcaacatggaaacattcctcagtgtctatgacaagtagatgattgttcactgagctgttaacgttatttttttatttgtatttttatttttatatttattatttttttccaagacacagtctagctctatcacccaggctggagtgcagtggcgcaatctcagctcactgcaacctccgcctcccaggttcacgcgattctcctgtctcagcctcccgagtagctgggattacaggcgcctgccaccacgcccagctaatttttgtatttttagtagagaccgggtttcactgtgttgaccaggctggtctcaaactcctgacctcgtgatccacctgcctcagcctcccaaagtgctgggatccaccacgcccggccttttttttttttttttttttttttttttttttttttttgagacggagtctctatcacccaggttggagtgcagtgacgtgatctcggctcactgcaacctctgccgcccgggttcacgcgattttcccgcctcagcctcccgagtagctgggattacaggcgcctgccactgcgcccggctagtttttatatttttagtagagacggggtttcaccatcttggccaggctgttcttgaactcctgacctcgtgatccacccacttcggcctcccaaagtgctgggattacaggcatgaaccaccgcacctggcctttttttttatgtttagtgacagggtttcactgtgtgacccaggctggagtgtagtggtgaaattatagctcactgcagcctcaaactcccgggcttaaacgatcctcccatctgtctcctgagcagctgagactaccggtgcacgtcaccacgcccagctaatttttatatttttggtagagatagtgtcttgctgtgttgcccaggttggtctcaaactcccgggctcaattaatccacctgcctcagcttcccacagtgctaggattataggcatgagccaccatgcccggccaatgttttctttaagatcagaatcttcttaatactaaacaaacttaactttctcgtccccctgagcgatcctgtttctgctgcccaccccaggccagacctggcagcgcctgatccatggcagtcaggttcatcccagggctcggagccctgcagtcccgtcccggggccctgcctgacgtaggcgcccagccaacacctgcaacgacctgttgcccccaccccaggaaacaatcccggcttgggacagacaccaggggctgtgactgtgggtggctccttggagaaggtggccttgggcctcggcctttccacctggggtgcgcttggctcccccagactcagacacgcaggatccttgtgattgggcctagacacgagccctgcagtccctgtgggcgctggaggcgactcccccacgaagccctccctcccccagggcctggcggccctcgccggcggtgagctcatctcggggggcggcgtcgccggcggcgggtcgctggagctcacggcgtgcccccgcacccccgccccccacgcacccgtcccgggctcctgggcaattttaccaattaaggctttctcgccgggccgggccgggcgcggggcgggcgcggggcgggggtgcggccaacaagaaggcgggcggcggcggcccattcgcgtggaggcgcgtcgcgcgcagcggacgccgacagaatccccgaggcgcctggcgcgggcgcgggcgcgaaggcgatccgggcgccaccccgcggtcatcggtcaccggtcgctctcaggaacagcaggtgaggtctccgcggcccggcttcgcgccgtagggtcgccgcgctcctcgtcggccgggggcggggttggagaaggcgggcagagaggccggaaaacgcaggcgccagctcgcgcccaggtccgggccaggttcagctgggatgcgtgagccgatggaggctcccctggcatctgggagtgagtgtccagagaatagcttccctagttgacccacgagccatgtctgtgcccacgaatgtgggagcctgaggccatggggggtccccgagagagagagggtgtctgggcacttgcccatgaacggaccactgcatgcctgagagagaagggccctgacaccaggaacttgtgtggactcagggcgagtggccacctggaaggacacttctcagccagtgtgcccactgggagggggacagcgtgtcccttgctggctcgagtccacagggcaccagctgctttgggcacaggggagctggttctggggctgctctactccatgggggccatggtgaggatgagaccaggccaggttccttggttgggccctgggccctatgccaggttggctctgagttggatgcgcactgccagccaggatataaccaacaatgtccccagattcccgtgccacctggggccaggcaaaataggttaaaatccactggcagacccatttgtaagtgctccgagtgcaccgtcaaggtgggagcttgggaatgggcgacctcacctgccgcacctggacttgccagcacaggtctcttctcaccttgccagtctgcggcttccttccctcctgcgccccctggctacgcaggcctggaaacagctccttagggatcccagctgaacagctcctgggcttgggctatacctcccagtgggagggtctggcctggggtctgagggccaggggtggtgtggtgggcggggtgtgcctaacatccaagaatctactccaaataagggaaaatatgaaagagctggattttggcttcccaggactgcccgatctggtggctttgggatcgggcgacatctggcggttgatactatgttctagggacaagaaccctctacacgcccattccttgtttcctctaaatagggaaaagctagggctggaagacacggcacccacctcctgacactctttctgctggaattgaccactggtcactctgactcagtttccctgagctctgaagattaaggaatgaacccagacaacccagctcaatggcccttagtggagagagagtcaattattgatggaattccgtgcctgggaacttgctttccagtggggcagggggaccagaaggacaacttcaagcccgtcttgaatggggcccgtgcagggaggggtctgtatgggttcccccttcccagccctccctcccacctccaccccagctcccagacgcccaggcgcacttggtgcaggtgtgtctcaaagtggtcaggagaggggacaatatacaggggttggcctcagtactggaaaatgccatttgcaccccctaacaccactactagtgggaaaaaccagtggggccacaggctgccccgaagtgaatgtgctgggcggatcacagccccaccacgtgtcatgtagacacccagggctacaggagagtcaaccatatttgggcatgacgtgctggccaacccagggcctccatctctcactggtctttagcagataaattaattattactagaattgaacaggagggacagatacctgccttcctagaaaaaaaaaaaaaacactcagaggaggaaacattctggagaggggaggtaccgaggactgagagggaggggagtgcacaatggggaggaagccataggcaggctggcttctgactgaagatagtagcagtgagcgtccccagccgtcccctggtcccagtctacatctcggcacagcagccactgcaccatctccagagttatctaccagaaaattttgagtgaagagcccccacagctctggggacacaaccccccaggcccctgatccctgtcctcaggcctcctctgcacctgccaccacacctgaagcccacccagacccaggtgctcagagcctgacaagtcttatgggaacctctgagcaggcccctctgggtctggaatgccactcccgtgtttgccccctgccctggccacgctgggctgaggggactttccgacaggagaggaccccccgcttcagctccccccagtgccccgggtgaactggcatgaagggttaggcgggcacacgtctctgcatgcatcgcacggcgccctctgcccgcgcccactggcgtgcccgtgggcatgcccggaccccttcgaaggctgcttgctcctggagtgccggcggcctcctggcccagtgccccatatcctcccgggtggagggaagcagagagggaggcggtgggaagcagcgggcacaggtgcgcgggcgagggccctacggactgggaaggcgggcccgtggcagggggtctgcggggaccgcgtaggcgcaggccttgccctgcagccgcttcccaggtgatgagcacacaaagcgccctcggcagtgcctggtccggggctgccgctctccaggggttcgctcttagggttggccccttcccgccgctgccgggccggcggacggggatgccgccggggaaccctaggccctgggggcccggggaagggggatgacggcggggggtagggatgtgcagggacggggcagagcccaagtgacttagggaagagagccaccccaccccccgcaggggccctggggaaggaaagtcccttgtaaggcgcgccggctgcaggccaagcagtcccgcgccagacactgctcagcctttcctcgctctagggcgcgtttcctgcagcgccaacgcgaggctgcggggctgggagcatccttgcccaccccactgcccagcgacccaccctggagcccgggtttcgcgtctgatcagccgaacccgggggcctagtgggggcattccaacgggcggggcggggtggggcaggcgcgccctcgaagccccaccccacggcccctccccgcaggaggcccgccctctggccccgccctcctcccgcatttaaagggctcgctctctccgcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcggtgagggacgccccgaagcgccgggcgggcgggggcggggactccgtgcgtccttccatctccccgggcggacccctccaaaccacccccttccgggccgcagcgcaactcccgaggcctccggctgctctgctccacgcgggcctgcagaacaaaggcgcgcgggctggctggctggccggccgggcgtgcgaaccgctacgcgcccccgcccgctgcgccccggctggccggcgcccaggctgaactcacatcctccgcaggccgcgcctccgcggctgtgctcgcggtgggagtgggcctggggggtcgggcactgggcaggctcctggccctgcgccccgtccccgaggaggaggaggcccgggctctccccccacagctgtttagagagggccctctggccttcagaggcccgttggttctgaagtgtgggttggagctcgtgcgtcccattgtctggggctctgggctctttgtgtccctggaggatgggtcgcccatcggagatggctccaaccaccagtttagatctacccccccacacacacacaggcaacctgggggccagaaagaagcatagttagcaaaactgcacccggggtgagttgggcgtggttgactgagagacctggcttgtagactacttggacgccaacttttctcttcatcttgggccaaactcttgcttccatgtaggccttgcttttctgcgtgtagcacgcaggagttggttggtagatgctccagcgtgcattgtgccagcccagtgtctgtgtcactggactggagaggctggcattgaccaggcctgctgcagcagcccaattcgttctcaagataggggctgcatgagagggcaggccccagaatgggtgactcgggggtgatgtggaacagggagaggagagggatgatgagtcttctcttcttcagaattgagaggccttccagttaccctgcagccctggaatggcccttgctgaacccaagaaagtgagggaccaagacttgggttcccccagccactcagagggcagatcccaagaaccaaagttctttctttggaatgccagttgaggcgaggggcaggcccacccccacaagtcccagcctcagtctagccaagctgagtcatctcagtcctggatggtagggggggcgaccggatgtggggaggcgggccacaccccagctctttagggggggtctcctccctcctcccagctcccctcctccttgtgagctggctggagcaggcctagttcccagagctttgccatataaggcaaaaaaatgttggaaagcagcagtgattaggggagggaggggttggctggcccaggggctggggaaaggggggtgggatggggcggggccatccagccagacagtctcccagccctgggccctggtccttccctctctcttttgggagggggatggggacggagtaggctggcctaacatggacctggtgggcctggttgctccccgtgtgggggtcgttgaggggtctgaggctggactggggtgggggcctgatgggaagccctggctggccttgttccctggccctgcacccttggtcctctccgagtccccctccctgctgccatttggggagagtgaaaggcagcctcgtggggccaggaccaacctgggaactggggaggccactctgagcggctcacctggccctccaggtgctgcctgctgggctgggaagcagctgccatggacagcccagcccctcctcataggcccgccccctagttgactcaccagagaagtattttgtctgattatgggggaggctgacagggcttctaaagatgagccatcctgccttgagcctgagacccagaagtagccttgggtggggcccagagcccagcagggttgccatggtgatggggggtgtcagggacccgccctaaccacttcccctgtggcgagcctgccgaggcccagaggcccgttaggtggcaagtgggtcaggcagtgggtggcaagggggttcccagtgtctcctgctgccaccccggcatctcccgatgggccccagtgagtcagggccatgtggcccaactgctggttcctttgggctctgggcccctcccctggctaggcctgtggcctcccaactccaagcttgagtcttcgaggtggtagaggaagtgggggtggtggcgggggtcacaatccctcacccaaagggcgtttgcccaactcccccacttcccctgcctcaccccacccaccctggaacaacagttgtatttcccaaccacccagggccacccaccttcctcttcctcagccccagccccactccaggtcatgggccctggattctgggccagctggagtcagcctcctcctcctggttccccataggcccctgaggtgtgtggcggacccctgctctggcagctgtggacactgtccagctgttctccagagctgcccatctgcaggctgggtctgccctctgcccttcctctgggcccagggcttctggcagtaatcataccctgctggcatcgtgtgtgtgtgtctgtgtgtatctgccctcaccccaaagtctccttcacctctgaacaccccctgggaccctgggcagagagggcctcatccacatcctaccactggccaagagggggtgtctacctcctccttggcccctgctaccccgtgctgccagaccctgaccccaaagcctgggatcggcccctcccgcacagccgtgtgcccagcgtggccactcttctactcacagacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggtgagggggcgcagaggcaggagagactgggctggggtcacccatgggtggcccttgagggggttctgcggcccccagactcacagcctcccttgcgccacaggcctgtgtcctgactgggactcttgggacgccagcaagcccgttaccaatgcgcgagaggccatgcagcaggcggatgactggctgggcatcccccaggtacacccgcccggcctggctacagctgtaggggaccggatcggcagttgggagagactcggaggcccgatggctcctgttttctgcctgtgacaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggtgagggagccccaccaggggtgcacccgtgtgccaacgtcttccccataagacagtgtcccatctaaacgtggcggtccccaggggtcttgggttacatggcggctaggtgatcaagccacccaagagtcagacaagagtgggtttttgggactagtgaaaacgacaagagaatgctaataggttcctccagtcacagaagcctgctgcgtggggtcctcggggaggtagcatccagcggtctttattataaatggagatgaaccaggtctcagtaacagggacctaaaacccagtcaaggctcacacaggaacaagggcccagtgcggtgagaatgaatgttccagaaaacaggctgggcctgtcccagcagcgagagcacagctgggtcccgaggccaggctctgtgccacagctcacactgaatgaacttgcccagtttggaatgtgcctgacttaggggccagcagggagggctgaagggtggaggggtgaggctgtggccttaacagctggcccgtggttggctcgccttcccctgccaggcatcgagcccacaggcaacatggtgaagaagcgggcagagttcactgtggagaccagaagtgctggccagggagaggtgctggtgtacgtggaggacccggccggacaccaggaggaggtagggccagctgctggcagcagaggccccgcagcgctccctttcagtggggctgctcttagcaaaggctcacaggctccttcccactgcaggcaaaagtgaccgccaataacgacaagaaccgcaccttctccgtctggtacgtccccgaggtgacggggactcataaggtgagcccttggccaggggggaggcttgtgacctcaggcagtggctggaggcccccagccctaccctcacggcccacccttctggggacaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggtgaggggaggctgccaaggcccagctggtctgtggggagagccgcactggggcctgggagctgagcaggtgcctcgtggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaaggtaggcccggccctgactgccctctgctgtggcactgcagtctgggcctcccacaggagggggaccccctgggccagtcccgctgcagcccgccccggggcccctactctttgagcttctactgtctgggcacatgctgtttttcctcccctgctggggcccttcctcctctcctctcctcgcccctctccatctctctcctcacgctttcaccttcggaagagctcgctccagctgtctagaaacctgctgctctctgctctgcccacagggtcaacggtacttggatctgtcttcttcttggaagggggagggtggggggctctgggctggtgtggagcaggtgggaggaggcctgccatgtcctggcccaggccacagttcctggggtcacagtcccttccagttctgtcttgcatgtccccctccagccaagctctgagggacccaccaatcctgacagcccggccctgtgggaggcaagggaggggtcgcccagccgagctgctggtgctcagctggcccctctgcctgcagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccagtaagttggcctggagccaggccaggatgggtggcggcagcccccgggttcactgctgggcaggcctgaggccctccttgtcttggcagagggagaggagcgcgtgaagcagaaggacctgggggatggcgtgtatggcttcgagtattaccccatggtccctggaacctatatcgtcaccatcacgtggggtggtcagaacatcgggcgcaggtgaggcccccaggcatccctctcccagctctgcacactctgcctcttctcttccttctgcctccccacctgatgatgaggggccacatgggctcttcctgcctggccgccacagtggggcccacgctggctcatgtggtgatcctcggtgttccctgtgtggctctcgcatttgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggtaagttggaggctgcagcatgggcacctggggacagacgatggcaaggacggcccaccctgaggctccagggcactgaggggactggtggctgttgtcaggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtaaagagcaggctgtgatggcctaagtctcgccctgctgctcctgcttggggtctggtggggatggcactctgtgtccctggccaccctgcctgggttgtagctctggcagcctggacctggccccctgacagctgggtggtctcccgctaggtgaaggcacgtgggcctggattggagaagacaggtgtggccgtcaacaagccagcagagttcacagtggatgccaagcacggtggcaaggccccacttcgggtccaagtccaggtagagcacccacgggtgttgggggcagggcaggtgtgggcacccaggcctgggcactgaccagcaggccacctgctcctatctgcctgacaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgagccaacctccaccggcctttagtccatctcgatagcattcacgtagcacacgattcgtccatttcaagtggttgtggcacaccatcctgactcccctgtcccacagctcctggtgaccactaacctgctttctgctgtggctttgcctatcctggacatgttctatagatggaactgtgtgccatgtggccttttgtgtctggcttctttcgctcaccacgaagttttccgtgttttcgttcatgtttggcatgtcttggcactttgttcctttataattattttgtttatttatttatttatttgagatggagtctcacactgtcgcccaggctggagtgcaatggcgcgatctcggctcactgcaggctctttctcccaggttcacaccattgtcttgcctcagcctcccgggtagctgggactacaggcgcccgccacccccccggctaattttttgtatttttagtagagacaaggtttcactgtgttagccaggatggtgtcgatctcctgaccttgtgatctgcccacctcggcctcccaaagtgctgggatgacaggcatgagccaccgcgcccatcctggttttttttttttgagccggagttttgctcttattgccaggctggagtgcaatgacgtgatctcagctcactgcaacctctgcctgccagattcaagcaattctctcctgcctcagcctcctgagtagctgggattgcaggcatacgccaccattcccagctaattttgtatttttagtagagacggggtttctccatgttggtcagactggtctcaaccgcctgaccccaggtggtccgcccaccttggccttccaaagtgctgggattacaggcatgagccaccacgtccggccgcttcatttatttttatggccgcataatactccattgtgtggccagaccacattccatttttccgttcacttgctaacagatattgaggatgagcttgcctttggtgatcatgaacagtgctgttaacagtgagtccaggtgtttgcgtggacatttgctttcatttctcttgggtagttgcctcggagtgaaccggagcatcacacagtccctctgtggtcaactgaggaactgccagactcttcccaaggcagctggaccattttgtgtgcctgccagtgtagctgagggagcttctgagtctcctccaggctgctcatgcccttgcccttgcccctgtgccctgcaggtgaatgtgggagctggcagccaccccaacaaggtcaaagtatacggccccggagtagccaagacagggctcaaggcccacgagcccacctacttcactgtggactgcgccgaggctggccagggtaaggcctggctgtgggtgggagggcaggtggctggggtgtccctgcgaggtctcagcctccgctcctctccccgccgcaggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggtgggtgctgcgctcctggccgctaagatgtcattgcggatgacgtctgccctcctctaaggccttctcctcccactgcctgcaggccacgcccaccagccccatccgagtcaaggtggagccctctcatgacgccagtaaggtgaaggccgagggccctggcctcagtcgcactggtgaggacaggtaccccatggcaggttgcggggcatcaagggtaggagggcttggggcagggtgcccctacatggtccctgtgtgttcctcaggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcaggtagccacaccctccactacagtcaccgagtccccagcctcctcatgcagcagcctaggggacagctccgagggactttctgcccactctcattccttacctgggagaggacaggcatggaggtccaggagggggttggggagcaattctggtgtctctaaatacccccttcccttctgcacccttcccagggtccagtaggcgtcaatgtcacttatggaggggatcccatccctaagagccctttctcagtggcagtatctccaagcctggacctcagcaagatcaaggtgtctggcctgggagagagtaagtagttggggcccttgtcgcaaaggcctttgtcacatccagggattggctgagctgggtgtcatgtctctctccttcctttcatcgtttccacagaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtaattggggtatgggaggccctaagggtagaacccactgtgctctctgagggccccaaaggtaccccatcttctccagacctgccctaaatccttttttttttttttttttcctgagacagactgtcaaccttgaccctgtttaagtgagagtaaaggggaggagggaaatagaaacccacaaaaagtcatcagggttgaagaatttccttttttttttttttccttcctttttttttttttttttttttttttttttttgagaaagagtctcactctgtcgcccaggctggagtgcagtggcgcgatattggctcacggcaccctccgcctcctggcttcaagcaatactcctgcctcagcctcccaagtagctgggattacaggtgcccgccaccatgcccagctaattttggtaattttagtagagacgagatttcaccatgttggccaggctgttctcaaactcctgacctcaggtgatccacccaccttggcctcccaaagggctgagattacaggcgtgagtgaccgcgccctgccctcctttttgtccttatgactgatggatggcccatctggcaggcagcctgggcccgcccgtgtccctgtttggtgagggcaggaagccagggcaaggggaggcaggtggaaagtcaagcaggaggtctgggatcggggcatagtgtggccttggctcctgaccccttcttccctcaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgagttgccctgccgtggggtatgtgacgggggacagggaccagaacccccgagccccaagcctcctctctgtgcctttgcaggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggtgcgtgctggggactcccacaggctggcagacggggtgggtggggtggcccgggctcctcctgacctggcctgcactcctccaggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggtaagggagcccccaggagcccgtgtggctggtgggcctgggaaccccaggaatgaccggctgtctgtttggaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggtgaggaggtggcggccagggcagggctgggactgtctgctcgtccccaccctgtctcatacagccgccatccctttgccccaaccctcaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggtgagtgtttgcatgcctggagccaggggtcaggagggcagtgtcctgtttgagggccgggaaaggaaactggaggcccaaagtgaggaccagagtgcagaggtggtgcaagtgtgtaggtgtttttggaagagcctcaggtgacagtgcagccaggtgggggacttggaggaggtagagcagatgggactggtcactgagcagatgtggcaggaaggcaggcaggcaagggtcccagctggcacccagatgggtgtctttcgtgccagagggggtcaaggccattcccagggtcgggtggatgaggataaagcgaggtctaggcctggggctgggtcctggccgtccagtgtggtggggtaggaatggaggcccaggagactagctgatgctctgtccctggggctggggccaggcctggtggagccagtggacgtggtagacaacgctgatggcacccagaccgtcaattatgtgcccagccgagaagggccctacagcatctcagtactgtatggagatgaagaggtaccccggaggtaagaggcagggcctgctgcctgtggggagtggcccaggctggatgctgagaacctgtctgactgctcacaacaccaatccctcacagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggtgagctccgggcacaggcaggggaggcaggggggcctgggcggctggagtgtgggctgcgggtggctggtgtctgatctccctgcggagctgcaccaaggagggcagggaaggacagggcccctgtctttggtttgctaaggttgtgactaccttaggatggtggtgacaggcacaggcttccccagacgtgcacttgctgctaactttgagcacgtcaccaaagccttctgtgcctcagtttccccacctgtaatattctcatggggcaggtataggatagaagcttgagatcaccccggtgagctcctcctagtgctggccaggccctggggctgaggatgggtgccaagctggctggccgcgcctgttgtcatgtgggaagtgtgggatgttttagtctccattctggactctgccaggtgcaggcagcccttttgggccatagcagttaagatgcctgaggcccagagactgtccctgtagcagcagcgctgggcactctgggagcgcctgaggcaggcccggggctactcgggcttgggccaactgcctcccctgcctctgccacacaggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgagcccgcccgctgttggccgctgcggcgctcggcacggggcttgggttgtgcctgtgtgcaagggctcgctgcttggggcggcgtgtgggagtgggggccgcccccttgagtgactcacctgacctttctccttgctctctgccctctcacctcagtgtcaatcggaggtcacgggctaggtaagctgcttgctggggccactcccaatgcccctcctgcccagaggggcagcttcctttcctcttggggccgattcccaggacagttccagctgcagctctaggcagggacagagttgggtggggtgcagaagatgaggccgtgggctggagggcgagggcccagggaggcttccggagctgagcatgaccgctccagctcttcccctctctgggcctttatttccccatctgagaactcgggttgcagctgagagctttggggtgaggtgcatcctgagaggcaccccactggggactttggggtctcgggatcttggcacccagggaggcacaagggctcctgcgtgggctgagggaacaaggggtctccccaactcaatgggagccccagccctggccagatccacagacccccatccccaccttccaggggcctctgcgtcccgggccgggggaggtgcatgagcgggtggggctggctggtagtgcagtagcgccagtgtcgactgcttgggcggccagcatggcggggcccggcccagcctcagagccccaaagtgcattctgtggcccgtctccctccttcccccttcccctatcccccagcagtgacgttattcagacattccccaacaggcatggagggtcacctgccccagccagggacacccagggatgctgatgagaggctacaggcctggcacttgggcgaggtggctaaggaaagggtgagagggtggctagagttttgcggcaggagcgagatggctttatagagcaggccgtaggatccgatgtgtgtgtgacaggcgtgtgtgcgcagggcgggggaggctggggagtactgattgcagggccttgggggctttgagggtgggagcaagactcagtaacctcagtttccctggctactgtttgcagaatggagacagggagcccggggtggggaagggggcgctgaagttgctctctggcaagcttgacggccacggggcttcagtgagagccaaattaggaggcatactttgaggatggagtggctgagacctgcggttggctgggagccgggcagggaaagtgggggcagtcgggtacctgtgaggttggggcccaagccactaactagatggcatggggtgcacatgagtgaagcctcccagggcagcgtgggcagccggcagccaggtctggagcctgggagagctgcctggccgcggcaggccagcatggagcctagtgcagcaggagccctcggccgatagtgggacttggtggcagggcccctcgagcttggccttcaagtaggtttcgtgctcctggctgcttccctggcaggaggccaggctgcagggggcactctcactgccaggcctcacagcccacagccccccaagcctccacggcggagacccagatcataacgtcactgtctctcccctttcctcgggcactctggggccctggagcctgctcagctgctctgccctcgcaacccagcagtggtggctgtagcttgggcctcctgttccctgtctccctgggtgctatccccgctctgccaagcctgctgcgctgcgctactcgggtgctaaccccgctgcctcccgcttccccgctcccactcctgtctgcaccgggctgcttttcaccgcgagccttctcagttgtcaggaaactccggtttcaccatcaggcctggggggtggggaggcaagtgtcacatccccccacgctgcagcaggactccgcctcaccgcgtccacacacagcaatgggggccggggccaggccagaagggcgcaggcagccgtgtgcccagccagatgctggcgttcagcagtgtgggccatggtgctggacgaggctgagtaggcaagggagtggctgtcaacacttaggctggagtgggcccttccttttcctcccaggcacctgggtgctactgtcgggcctctcccacatgggcacttgaggtggtcaggagaaaccttcctgccttctgagaaaccactcgccatcccagcttggaggggcagggcggggcaggaggcctggcggcctggctgtgcttggtggtggcaatgagaggcctgtgtgggcggcaggcggacgggaacaacctgaacccgagctcacacgctggcccccctttggggacccaccctgccccaccaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggtgaggaggggtggggggtaggtcagcaggggtgtctggcaggtcccggcctgttcccctggggcccctctgtgacaacagactctccagcagctctctgctttgccctgcaggctctggctggggaccagccctcggtgcagccccctctacggtctcagcagctggccccacagtacacctacgcccagggcggccagcagacttgggtacggcctggccagctagggacactggggctagccagctgggtgttctgtgagcccctagtttaccatgtgtgaggagggaccccagatcctcccactgtccctcacccatgccctgtgtctccactgcaggccccggagaggcccctggtgggtgtcaatgggctggatgtgaccagcctgaggccctttgaccttgtcatccccttcaccatcaagaagggcgagatcacaggtgagtggggacttgggaaggagctcgggagccaaggaggccagactgtgccaatgagctgccctgacctcagccccactgccccacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggtgggcctgccctgcctctgcccactccaccgccaccacctcacagagagatggggctgggggacacacgaggctgccattccacaaggcccttcttcctgcctcaggaagccccttgcagttctatgtggattacgtcaactgtggccatgtcactgcctatgggcctggcctcacccatggagtagtgaacaagcctgccaccttcaccgtcaacaccaaggatgcaggagagggtgagcaatagctctggtcttgacctgctctgtgcccgggatgccctcaccggggtaagggctggactcaggagatactcctgaatggggctccctgccctgctgccctggccatcggagctcctcagtgcaggccaactggagtgtccccagcatagttcccatgctcacccacggctctctccagggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgggtggcactgggagcagtgacagaaacgggtggcagggtgggcatggtctcccatggctggacgcacactgatggctggcctgtccccaccaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtgggtaagcggctgaagggtccagggggttcagaaaggaggcagcctgtggggagccatgccctccctgactgacagccatgccctgtgtccagggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggtaggcagtggctgcccaccagctggggcgggagcactgtgcatagcaccgaggctcaggggtatccatcccctaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggtgagtgcagcagtgcctcggcagcccccctcactacaccagggcccacaggcagtatgtgactggaggggcgtgggccgtgctttcttcctgcaggcagccccttctctgtgaaggtgacaggcgagggccgggtgaaagagagcatcacccgcaggcgtcgggctccttcagtggccaacgttggtagtcattgtgacctcagcctgaaaatccctggtaggggctgtgggaagcctggggaggggtcctggggctcaagcagccccaagaggaggggtggagcccagggctgctgctcactagcccatccccaccctgcagaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccaggtaggcctgctcacaccccgagtgctcgctctcctgcgttggccagggtggggttgggggtggaggaaagagccggcaggcatgtctaccttggctatgcctggagggggccgaggctggtgaagcagccttcagtgaggacaaactgttctcccacagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtactgggaacccggctggggttggaggaggtggggcctgagtgtgggtattggacccagggctggcacagatagccctgcctggcactcactcttcactttgaggtcacagggccacccaggctgttcgtgggaggtgggaggcccaaaggctgatgagccggtcttacactctttccctgcccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattaggaaggccttctaccctgcagtaccatgccatctccacagggaaagactcaaagtccagcctcagtgctgcccggcccttcagccacggccatggtacttgtgcacaggcctggggcagccttgtgggtaggaggagcccagtgggcttcatttcacggcctagtcctgcccttcccagctgcatgacctgaagcaagttcctgcccgtctctgagcctgttaacatgcaggggatatggtgttcacggtaacctttcttaggaggcagcaaggcctgggtttggcttgtaaaagatttccgtcccaatgcaccctgacggtgggcagcttgagtgtctaaaccttcggccctcaggaggtctgctgcggggtgcaggtgcccagcgtggctgggctcacactgatggaccggcaaaatggggagggccagggttgaggctgttcctcacagacaccatctgctggtttgaggaggggccccaggcccacagcatgactccctgctcctcagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacaggtaagtctgtcggtgcggctgcacgtgtgcacacagctgctaggcccttgcctccaagctcttggtgacaacaggaggcacctggaggtgacaagcctgtgctgggtggccgaggacagggaggcaggccagtctggctctgcctgacctcctgtgctcccagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggtgagcctggggccaagctattggcatctgcccaacgcccggcaccacagccacctcttagccccacccactctgccttgcaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggtgggcaacccgggcccccggcccaccttcccaccaaaatgaggccagaaatcacaggatggccagtgtctgggagagcagggaccgcctttggggcgtggctttcacttctagagccacctccctgccacctcctggacccctcaaacaaagaccagggaggagctggaatctgctaagctggcctgggttggggaggtgctggcagctctttaggaagagagaactgtcaccccagaactggcttagggacaggagaggagagcaggacaccagcgggaggaagggggctgggacctgggactgaggacccctcttgcctcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattctcctttgcgtggctgtagctttgttggggttgggggaccagtcaaggccaacctgacaggggtgccaatgagcagatcaaagcatgggctgagcacaggtcacctccctccagggctcctgcttcaccccaccctgactccagaaggcaccatctatctttgcttcctctgcctccctgagttcaagccaacgtaaggagaggaacatgtagcaacctggaatggagcccaggcagcaaggaggcaaagagctgggcaggagagcccattactgggtagggtggtgtcaggaaggctccctggtggaggtggccagataatcaacagcaggcccggccgggtgtggtggctcacgcctgtaatcccagcacttcgggaggccgaggcaggcagatcacaaggtcaggagatcaagaccatcctggctaacacggtgaaaccccgtctctactaaaaatacaaaaaattagccaggtgtggtggcgggcgcctgtagtcccagctactcgggaggctgaggcaggagaatggcgcgaacccaggagacagagcttgcagtgagccgagatcgcgccactgccctccagcctgggcgacagagcgagactctgtctcaaaaaaaaaaaaaaaaaaaaatcacagcaggccctggccatctgccaggtaacttgaacatgccaccatgccaccattcccccaaacaagggactgggatgaggccccctcccccaggctctgggcctcagggccctttagttaacaggtggcaggaggtggatgcattcaaggtgccaatcccaggtaccctgggccccctgctgaatatcccctcattggtacccctgccgtggattcccacaccaacctatgtgtctcccactgtaaagattgcccccaaacacataacatcccaagtcgtcctggctcctggtgctgcctgcatgctatcgggacatcccaactgcagcacccaaagctgcctgctccctgggccaaaggctttggccctcgatcaaacccctgacaaggacaccaccacctcagacatctgcagacaagggccaggaagcaaggctctcgggggcaacgctcagctttctcgccacatcctccctcagctccacagcgtctgacacgaccaggccgtagcctgcagccatggcacacgtcaaacccagaccttctgagacctcaacaccacgcgtaccctccttgacccctgttgagagggcaaagtagaaaaggcagcggcagttcaggcaggatggctacttttatttctcactggggctgggctgctggccccaggctcagggcggccactcactgggagacacggggcaagcaagacacagaaaggggaagtcccacccccagccgcagccactctactgctccccctgggcccaatggcatagaggtaaaggggccaagcacactctggaagcctctaaaagccaccagctgaacggggctgtgaggcagcagagccaggcccagaaagatgcagtgccagttgggaggacgggaggtccccctgaggctgcgacttgtccgctcagcccactgtgtgcccaggattctgaacctctggggcactccctcctgtcccgagtcacccagggtctcctgccccctccctgtgtctgctccatcacatcccctctcaagccccatgcctggcagggccaccgccctagggctgggctaggtgaaccaagggcaccggtcccccaaacctgccgatcgtccccaggctgcagggagggacacatgtggggcggcaagggcagaagataaactagggggatccgggcccctgaggacagccctggcgggaggccacaggcctcacagggtggtgagctggaggccacccaggcaggcaggcaggcagcagggaaagagactggcacggtcctggccagggccccc

SEQ ID NO: 16729 - DNA, 19866 bp, Human
aatcccagcactttgggaggccgaggcgggcggatgacaaggtcaagagatcaagaccatcctggccaacatgatgaaaccccatctctactaaaaatacaaaaattagctgggcgtggtggtgcacaactgtagtcccagcggctgaggcagaagaatcgcttgaatccaggaggcggaagttgcagtgggtggagatcacaccactgcactccagcctggtgacagagcgagattctgtctcaaaaaaaaaaaaaaaagaaagaaagaaagaaaaagaaataaaataataatgggagaggattgcgagggatataaacaaaattagtcagaagttgataccttcaattgttgaagttggtagctgtgaatgtaagatttactatactggccgagcgcagtggctcacacctgtaatcccagcactttgggagtctgaggcaggcagatcacctgaggtcaggagttcaagaccagactggccaacatatagtgaaaccccgtctctactaaaaatacaaaaattagctgggcgtagtggcgcacgcctgcagtcccagctacctgggaagctgaggcaggagaatcgcttgaacccaggaggaggaggttagagtgagctgagatcatgccactgcactccagcctgggcgacagagcgagactccatctctcaaaaacaaacaaaccaaaaagatttactatactcatttttctactttcgtacatttttgaaatttccaataataaaatgctcaaagcactgtctctgagctggattactgcaattacctcttaccacgccacccttcttttacccttgcccactatggtctggtctccccaccactgctagaacgatcagtgtaagacgtaattccgatcacattcctcctctactgagaaccctaccatggatccccgttgccttctgcgtaaaagccaatctccctacaacggcctacaaggccctgtaccatcgggttccccatcccttcctctccaactgtgctcccctccctcactctgctccagctatagtgacctccgtgctattcctctaatgtgccaggagagcccattcattctcagatcacagaaacagtatgacgataggcagatgttgtcttgcaaaacgagcaaacaggcatatgaaatcagatacctagctgccaaactatatgtgaggcatttccgaagaatttaacgacctcgatagagcgcagtcaagtttggtgaacagaatatgtctctgaactagaggagtcctcacacaaggagtagggtcagaccccgcagtggaggaggagggaggagtagaaacagtccagctcgccgcccaagtaacctgggtcctgaatcggcccgccttggccagtgctccagaagcgcggagcaggaacgggctggggcccaaaaaagaggggggagcctgaacgtccgggggaagtttcggaggcggcggaacgcccacggatggaaccctgtctttggggaaaaggaccacacctgtcagcagagtccgtcagacgtgagaagggtgggagcggcggactgtgaacgctggtagggccccggcgctccgagaaagtcccagtttcgcggtcgcccttccctaccacgcttccggcttccggtgtcatagctgtgggatccggaagtaaaaacacaagccccgcccccgagaactcgggaagccggcgagaagtgtgaggccgcggtagggccgcatcccgctccggagagaagtctgagtccgccaggctctgcaggcccgcggaagctcggtaatgataagcacgccggccactttgcagggcgtcaccgcctacacgccccctcgtctctcggacggcggcgtctagcctcggggcgctcggccgccccgccctctccgggggaggaatcaagaagagactgcccaatagggccggcttgacccgcgaacaggcgagggttcccgggggagtggcgcggcagaaggccccgcccaggagccgagggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcaggtaaccggccgggcgggcgccgcgcaggcggaggagcgtactgtcccgcgctgcgccgcgcggcggtaaaatacacgctgtttgttgtgcttgagaaccgagcagaatcgagagggtcttaaccaatccctttataccccgcacctcctctcttgagcccctgagaccccgagagcgaaggggacttgccgaccggggtcacccagcttggcaaggggagggctggagctgaactccagcatctgcaccatctcccatgctccaggtcattgtggagttcccgctacagtcgggaatgagatggtcctgggcacgcagttccatgccccacaaggattttactcggttgtccagaattgatgctgtagtcggaatacaccaatgctttgagtaattttgtaatgtacaccctgaatgaaggctgcctaggagagagtggctggagcccagagccagcagtttctaacccatcaaccactccccaatgcccagccgttcacaaggagtgatttgggcaatcaggtgtcaccctggtgtgagaccccagaggaactctcaagaaaggggctaacttctcaatgctctcctgttcttctgccttgttaacgagcctttcttccaccagacagcgtcatggcagagcaggtggccctgagccggacccaggtgtgcgggatcctgcgggaagagcttttccagggcgatgccttccatcagtcggatacacacatattcatcatcatgggtgcatcggtgagtatctcccaggccccaatcttaaaagccaggaagtgcctgctccatgcctcagcttttccaactaattgttgcagggccccacaggctctgctaagttgagctcctcctcccgctcctgctagtgcgccaggatcatcccggctctacctggtgtgcatatgcacttgcaagacttttttttttttttttttttggagacggagttttgctctggtcgcccaggatggggtgcagtggcgccatcttggctcactgcaacctcggcctcctgggttcaagcgattctcctgcctcagccccccaagtagctgagattacaggcatgcaccaccacacccggctaatttttgtattgttagtagagacggagtttcaccatgttgaccaggctggtctcaaactcctgacctcaagtgatccgcccgcctcggcctcccaaagtgctgggatgacaggcatgagccaccacgcccggctgcaggacgtttctgaaccctgtgcctagccgctgaatgtagcccttaatcctggagttgcaggctctttagggactgtctagatggacttcttggggaaaacagggaatgctattcattctgtagttttttcagacctgttcatgccttaacaaatgagttccaaaggcaggatctgaggcctgatctctgcctcttcactaacacttcaagttccgtcgatacaaacacttagcttttctttgaacactgtctctttgcctcaatttcgaaagcctaccaaggagctctgcctcaccccacctggccccaattgtccagcttgtagaaccgccattctgcactcataggaaagacaaaagaatagtatagcatgaggatttccatgggaggggagggaggggtggtcctaggacagccatcgcccgagactagagcaccctcccctgtgtcccatggggcagtgagactgtgcaggggctggtggaacaagggcttcatctcaaattacacgtggtctcagttttcacttttaaccctggatgcactcaagaatctctctgctcattactgtatgaccatctttgccattaacttaccttgtaaccttgagcaggagctctatcaaaactagttagttcttccacatcgtgcgcccctcagtgctggctgagctcagtggttctttgttcacatagaacaacgcgctgtcacactttgtcaaacctactccttgacacctttgtacttctgatcagaacttagaaaaggagagccaaaagggaatgaggaggcagccgagggagaagggctctgccagtggcagagtaaggaggggccattgtcctctgactccccataagcctgagacccaggagaggtaccaggtggagcccacagtagattgggcttggcctcagccccagccccagcctggtcccctcagaagagccatacctggccgggcacggtggctcacgcctgtattcccagcactttgggaggccgaggcaggtggatcgcctgaggtcaggagtttgacaccagcctggccaacatggcgaaacccagtctctacttaaaatacaaaaattggctgggcgcagtggctcacatctgtaatcccagcactttggggggccaaggtgggcagatcacaaggtcaagagatcgagaccatcctggccaacatggtgaaaccccatctctactaaaaatacaaaaattagctgggcgtggtggtgcgtgcctgtagtcccagctactcagtaggctgaggcagtagaatcgcttgaatcagggagtcagaggttgcagtgagctgagatcgcgccactgcactccagcctggcgacagagcgagactctgtctcaaaacaaaacaaaacaaaaaggccgggcgcagtggctcacgtctgtaatcccagcactttgggaggctgaagcgggtggatcatgaggtcaggagattgagaccatcctggctaacatggtgaaatcccgtctctactaaataaaaaattagccaggcctggtgtgggcacctgtagtccagctactcaggaggctgaggcaggagaaaggcgtgaactcgggaggcggagcttgcagtgagcagaaatcgcaacactgcattccagcctgggtgacagagtgagactccatctcaaaaaaaaaaaaaaaataacaaaaattagttaggtgtagtggcacccatctgtaatcccagctacttgggaggctgaggcaggaaaatcgcttgaacccaggaggtggaggttgcagtgagctgagatggcaccattgcactccatcctgggtgacggagtgagtgagactccatctcaaaaaaataaaaataaaaagagccatacctgcatcagccacaaaccttaacagccaggactctgaccgttaaacccttagtccaagaagcagactggaggagaaggtaactgaggttgctttctccatccccaccccatgctgtcacaaggcactgcaacagagcaacccaggccacaatgatagcttatgactcctggccttcagctcttattagacacctcattgagagcatccaagcttgctgtgtgagttggagcaagtgtcttccttttcctgaacctcagcatttcgtgtagcaaatgacagcttttgaaacgagggcccagggtccttaggcttttccaagctgattttgtcatttcactgcctccgcctgtggccagcttcgggttgggcaactttgttttgttgaaatcagtagggttcccctttgctctcctctgttctgagagtgacaacctgaggctttcaaagcagaaataggaagtgccagctccagcactgtgggtaggggacaaggggtcctctctctgaagagcctcgtggtttgttttttcctcttcctgctgggggggagatgggaggtggcgtgctcaggcagcacctggaacagctccggctcccaggcttcttccacgcctgatgcctcactcggtgcgggaggtaggcagggtggcacttgagggcacgtgatcctagaatctgctgttccaggaaagcagcccattctccgttcattgagcagacagcgattgggtacttctgggccacagcagccagtccctgccctcctcatgggacctatgtgctattgcggccagggaaccacggcaagtaagcagaccagcaagagttcaggctgacgtgtgtttcagaagatacacatgggccctgtgtccccagtcccccaaagcgcatagatcccacaaagagggccgggagagcacaaacacagaaggaagagcaaatgcccggagccccgagttgggaacaagctcagcatgacctagaaactgaaagcaggcaagtggctggcagacccacagcctgggcaagcaggacaccctggggcaggctggacccacgtggccttcctctgtcccttcctcctccctggccagcttacctcacacttgcccacacacccagcttccttcctgggggccctgatggcacctcagagttaccaagtgggccacttcctgccttctcaggactcccacccctaccagaaagggagccgaggtacttactgcccccttccagaaagctctggccttgtagactagtgtgcgcctggaacagcatctttccccacctgatgggacctcgatgatgctggagagcttcacagggagtgaggggaagagactgggattgatagtctgcggggtcctcacttctctgggccttagtttccccacctggatcacaagggccatgggcttgatgggcgttcaggacgcatcccaatgatgggcctgtgggagggatgacccagcggcccccgcctcccctttcctcagaacatttctgggctgacttccccattggtctgataagattcttgctgtgtcatgatgatgttggcactcccccaaagccccggtgactcatgagcccccgggtatagcagggaggcccttttgttggtttttcagctgaactaactcagcagcccccaggttctctggccccagtggccaggaaccagctgggcccctgccaaggcccagggctccacccagggagtctgggcaggtccttaaccccagtgacccttggggatgggatggcccacccccgctggccctccagcaggcatcgtgctctaccatgaaaccctcatgccaagacaagggctgcagcgatttcggtttataaaacagacaggtcatggcccaggtccctttgccctggcctagccagatgttggtggctagagatcttcatcatgccctgcttctactaagtcaccttgtgtccttgggcagatccctcccctgctgtggtcctcaggaaagaggagggcgtggggaagatgagaagctcccaactgcttttcactaaggaccccttgaattgcccccacccacatggcacgagtagactcttgaccaagctgtcaggtttcccgatgtcttcccatgtttgttcctccagaaagtcccactagagcatcgcagccagctgggagggcagggctacccctgagtcctgaggagagcagctcagtccggctcagctcagcttagctccctgtcaccatgggagagagcggcctgccttaccccacccctactgtccgtcttacctcacctcgcctctcaggtgacttggagcccagcagacggtcggtcggttgcagggcctgagctgaaacaaggtgagccggttcaatctctagttaatcccaaagggagcagcaggaacaaacggcctggagcgtggggttgctgtgactcagcagaccagtcccctgccaccagtacctttctggagtctgtcccgatgcctcccagtcttccggaatttggtcatgagcaaacatgacctgctttgagtgaggcttagaggtatttgcaggctgtggttctttccgtttatttcagggtccagttagttcccagtaagctgaccctttctgtgtggggccagccgtgagttgatgtgacatgggcaacgttcccctccccagccccactgatggcaggtgctgtgaggagctgagtagaggagctcctaccccagggcgaggggttgtctgctggactttgaagggtgcagcagtgagaggtccgtgtcgctgtagtcctggcaccgagctcacctgaggagcatcagaagtggagcagggcccctgaagagcgcaagcacacaaggcacccacaccatagcagttgccctcctggaagccctgtggtggcttcctaactgcctggctctgggtgagggcgtttgacctggtggcatggcccccattctgtaatggtttgtagaaatggacccatccatggttgcagtgcctgattgcttcgaagagcatgtgtttttttttttttttttttcgtgacatggagtcttgctgtcacccaggctggagtttggtggcgcaatcttggctcactgcaacctccgtctcctggattcaagtgattctcctgccttagcctcctgagtagctgggattccaggtgcctgccaccacatccagctaatttttgttttttcttttttttgagatggagtcttgctctttcaccaggctggagtacagtggcgcaatcttggctcactgcaatctccacctgcgaggttcaagcaattcccctgcctcagcctcccgagtagctgggactacaggcgcgcaccaccacatccagctaattttttgtattttagtagaaacggggtctcaccatgttggccaggatggtctcaatctcctgacctcgtgatccacccacctcaacctcccaaagtgctaggattacaggcatgagccaccgcgcctggcctgtatttttagtagagacggggtttcaccatgtttgccaggctggtctcgaactcctgacctcaggtgatccaccctcctcagcctcccaaagtgctggggttacaggcatgagccaccacgcccagactattagtttttaccatgttttattgaaatatatgtcatgggccggccacggtggctcacgcctgtaatgccagcactttgggaggccacggcaggtggatcacaaggtcaggagtttgaggccagcctggccaacatggcgaaaccccatctctagtaaaaatacaaaaattagccgggcgtggtggcaggtgcctggagtcccagctactcaggaggctgaggcaggagaatggcttgaacccaggaggtggagatttcagtgagccaagatcacgccactgcactccagcctggccgacagagtgagactccgtctcaaaaaaaaaaagaaatacatgtcatgaagaacacagatggtgcaggtctagcttgttgatgacttttcacaaactcagcacagccacagaaactgctcctagatcaagaaacagaatatgctctgcacccaggaagccccctcacctggggctctcacagtcactggccctcaaagggtcatttctgacccactccccaccctccgctccattgttggttttctcgccgtcttttgttggtgcgcaaatcttaactgtacaattggctgtacaccctcatcacaataaaggccatcgtcatctccccagaaagttcctgggtacccattcccagccaatctgccctgctccaggcaaccgctgatctgatttctgtcacaatgggttgcatctctgatgctgagatttcccagtgttgctgagtagtatccgttgtatgaatgcacagtttgccgggtcacatgttaattcaagtgtttgacttgtttccagtttggggccgctatgaaccaaggctgctgtgaccattcgtgtgcaggtctttgtgtggacttgcactttcatttctcttggggtggaacggccaggtcacaggataggtgtgtgtttcacttgatcagagggagcacccgcaccacctcacagctcaacttcagccattttcattttcttgccttactgcacttttcttgttcctgattgcttaaagggatgattaatatttcagcatttcctataagtgtgatatttgtagtatttgtaaggatgatggtttgggggtttttttgttctttgttttttggtggtggtttttttttttgagacgacgtctagctctgttgctcaggctacagtggtgtgatctcggctcactccagtctctgcctcctggttcaagcgattctcctgcctcagtctcctgaatagctgggattacaggcatacaccaccatgttcagctaagttttgtatttttagtagaaatggggtttcaccatgttggtcaggctggtctcaaactcctgacctcaagcgattccccgcctcggcctcccaaagtgctgggattacaggcttgagccaccacgcccagccagaatggtgttttatagatgccctttatcaagttagtgaagttcccttgcattccccctctgctaagagttttagcgtgaataggtgatttctgaaacacttgatctacatctgttgggttgagcaagattgctagatttaaaaaatcaaaacatagcagtaggcagagagttcttagaggttttttttaatctcttaatatggtgaatttcaatgatttttttctgttaatatcaaaccaactttttatttacagatgtatttattctgtaaataaaaaacctaccgtttttaacattgcaggatttggtttgctgatgttttcttctttttttttaaagagacagggtcagtgggtcgtcgtggctcacgcctgtaatcccaacactttgggaggctgaggcgggcagatcacttgagcccaggagttcaagagcagcctggacaacatggggaaaccctgtctctacaaaaaatacaaaaaattagctgggtgtgttggcatgtacctgtagtcccagctactccagaggctgaggtgggaggattgcttgagcccagaggcagaggttgcagtgaactgagatcgtgccactgcactccagcctaggtgacagagtgagaccatgtctttaaaaaaaaaaaaaaaaaaaaacctcctgatttcaagcaatcttcctcccaccttggtctcccaaagtgctggggtgtgtgagttgtgcccggcctgctgatatttcgtgtgggatttctgcatctgcatgtgtgtgtgaatgaggcgtatgggttttcccatgtgcctttctcatcaggtttccgtaccaaggctctgtaggccccataaggtggcttgggaagtgttcccctttcttccttctgcaggaagagtttgcttcaggctggaattctcttgtgcttgcattttggtagaacccactggcaacactctctatgccagggggttgtttctgtaggaagatttgtggccactgtcccctctcaggtccattgctctgttttttgtttgtttgagacggagtttcgcttttgtagcccaggctggagtgcagtggcttgatcttggctcactgcaacctccgcctcccaggttcaagcgattctcctgcctcagcctcctgagtagctgggattacaggcatgggccaccatgcccagccaattttgtatttttagtagaaacggtttctccatgttggtcaggctggtcttgaactcccgaactcaggtaatccatccgcctcggccttccaaagtgctgggattataggcttgagccaccgcgtccagctgtttagttgtttttttgttttttgttttttgagacggagtttcactcttgtcgcccaggctggggtgcaatggtgcaatcttggctcactgcaacctccatctcccgggttcaagtgattctcctacctcagccttccgagtagctgggactacagacacccgccaccacgcctggctaattttttgtatttttggtagaggcggggtttcaccgtgtcagccaggatggtctcgatctcctgacctcttgatccgcctgcctcggcctctcaaagtgctgggattacaggagtaagccactgtgcccggcctatgcccttttaaaaaagcaaccatgccagggggttgtctgtttctattcgtctttttcaaacaccaatttccagctttgttcatcttttctttgggttagcttttaattttattaattttacttgtcattatttcctattttcttcctggtaatttggcttgcagttctatctttttctcactttttttttggagatgaagtctcactcttgtcacccaggctggagtgcagtggcacgatctcggctcactgcaacctctgcctcccggattcaagtgattctcctgcctcagcctcctgagtaactgggattacaggtgcctgccaccacacctggctaatttttgtatttttaatagagatggggttttgccacattggctggtcttgaactcctgacttcaggtgatctgcctgcctcagcctcccaaagtgctgggattacaggtgtgagccaccgcatctggccctttttctcacttcttaagtggaatgcttagctccttatttttgaaccactcttttttgctaatgtaagcacttgaggtcacgtctcacaaatgtggctacatggtacttctgtcgtcccttggttctactgaattgaattttcaggttttctcctggaacgcaggagatgcgtttatgtcttctgggtcagggatggagggctggcacaggcttgaatctcggggctcttctgtctgtatatcaggcaagacagacatgcttgtggcccagtagtgatcctgagtagtgcccagatcaccaagggtggaggatgatgtatgtaggtcgtgtccccagccacttctaaccacacacctgttccctctgccacagggtgacctggccaagaagaagatctaccccaccatctggtaagtgtgtcccaccactgcccctgtgacctcccgccagggacaggcctggtcctgccctgcccgcactggttacagctgtgccctgccctcaggtggctgttccgggatggccttctgcccgaaaacaccttcatcatgggctatgcccgttcccgcctcacagtggctgacatccgcaaacagagtgagcccttcttcaaggtgggtggtgtcagggcctcccccagcctggttctgccctctctaccagcccccagcatggccagcttcggggacctccccccatcccatcccgggatgctctcctcctctcctgccccgccccgcctgctctcgtacttccttgagacccccattaccagcccccgtgaccaggacccacaggtcccctcctgctgtgctctgctgcgttttctccgccaatcatagttgggtgtcatgattttggagagagagctttctccagtgtatttctcccaggtcaaaatatcctgaaatctggcctctgtcctaaggcacaggggtcccagcctggggcagtgtctgtgctgcctgctttggcctccctccctctggatgtgcagagctgctaagatggggctgaacccagtgtgggacggggacactgacttctgagggcaccctccctggacctccagggaagaccctccactcccctggggcagaacacacacggactcaaagagaggggctgacatctgtctgtgtgtctgtctgtccgtgtctcccaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagatgtaaggcttgccgttgccctcccttcccgcctgccaggctggcccaggcagtgctcccaccactctatgagcgtgtccggggccggggatctgggcagcatccatggtgccggggccatccccagcgggaccacaaggtggcagcgttgctccacgaaacaccgcctttccgctctgcttccccaaaggcccggccaggccgcagggtggcagccttgctctgcgaatgcagcatggcccgcgctgggtggtttcccaacccagccagaggctcttgtcctctggctggttttgaatgcgggggtagtaaagcaaaggtcctcttctcattttcaaaaccaatgaggaagccatggcttggatgcctcctccccctgctcccctacaggccttcaggccactcagacccaccggggacccagcatgaggcaggaggggaacgggcccccggcagcatgccagcaatgccaccctggcacccagggtgggaaggcttcccggaaggtgttgagccagagggtcatctgggaacacaaggcacgggaggtggccacgggggcgaggaggttctggcctctactcccctgggagggcgtctgaatgatgcagctctgatcctcactccccgaagaggggttcaagggggtaacgcagctccgggctcccagcagaggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgaggtggggccaagcctgggccgggggaccagggtgggggtggtactcaggagcctcacctggcccactgcctccccgaggacgaattcctccagaactcagacaagggtgacccctcacatgtggcccctgcaccacagaggcccaaggtcagttcctccaccttgcccctccctgcagatttgccaacaggatcttcggccccatctggaaccgggacaacatcgcctgcgttatcctcaccttcaaggagccctttggcactgagggtcgcgggggctatttcgatgaatttgggatcatccggtgagagctcttcctctctcctgggaggctggcacagggtggcagagccagtcaccctgcagggctactcttccctatcttgggggagctcctcctcaccctgcagttcaaaacctaagtgtctgagctatcagaccgggctggaaagggctggacccctacacagccaagcaccccacggttttatgattcagtgatagcatcaccatgtccttccttgatttaaggggacctggaagacaagggggatcaggaagtgagtcttgcagcttgtcactaggaagccttgtttggggtccccatgcccttgaaccaggtgaacagggcggggagctaaggcgagctctggcctcttccgtccccagggacgtgatgcagaaccacctactgcagatgctgtgtctggtggccatggagaagcccgcctccaccaactcagatgacgtccgtgatgagaaggtagggggtgcaccccagtccccaggagcatgccctgtcgcaggcccatctgtgacgaggcactgagctggggtgtgcatgcagagcaggtgtcctcaaccccggagaagtcaccacctctgagcacagcgtggcctcccggaggtgacctggactggcagtcatgaagcccaagttgtcatgtcccaggcctgacagtcactatgtgaccagggaaggccattgcctctctgggcctcagcttgttcatcagaatagactcgagatggaccagggtggtcctggagggtcctcagggaggggccctgagctgggcctctggcagggtgagcagagccaagcaggggcctcctcctgccctgagggctgcacatctgtggccacagtcatccctgcaccccaactcaacacccaaggagcccattctctcccttggctttctctcaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggtaggtgatgccttcgaggcccagcaaggcagaactgggcatgccctgtgtgcgggcactggagctcccactgagacactcacgcactggtccacaccctgagagagctggtgctgaggctgccctttccgccacgtaggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaaggtgccctacagagaaggagcagtgtggagggtgggcggcctgggcccgggggactccacatggtggcaggcagtggcatcagcaagacactctctccctcacagaacgtgaagctccctgacgcctacgagcgcctcatcctggacgtcttctgcgggagccagatgcacttcgtgcgcaggtgaggcccagctgccggcccctgcatacctgtgggctatggggtggcctttgccctccctccctgtgtgccaccggcctcccaagccatactatgtcccctcagcgacgagctccgtgaggcctggcgtattttcaccccactgctgcaccagattgagctggagaagcccaagcccatcccctatatttatggcaggtgaggaaagggtgggggctggggacagagcccagcgggcaggggcggggtgagggtggagctacctcatgcctctcctccacccgtcactctccagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcccctcctgtccccttgtcatttgcttccctgaggacccacttccttgtcccactccccaagtcacccgggtgcttcctctgtggccactgaggagcctcctcacttctggttctgaccccatgtccagccatgaccatgtttggtgtcagagacacctcctgagtcctcctccgctccacgcatattgtcattgtgagaccagcttgaggtgcaaggatgtggggtcaccttccgctcttactgtccatgtccctgccccacccaagatgacttccagcaacactgccagtccacagaagtatttaggaaggagaggggatgggttttgtgactgatgtcagaggccaagggagaggggacagtccacagtgatgcacagccaggcccagccaccccttccaggcagaagggccacacactgggcagctctcaacataggctgattctcccagttctggaggccagagtccaagatccagcactcccgccagaggcccaaggggagggtccttcctgccctctccagctcctggggaaccaggcatcttgggctggtggtcacctcactccactcactctgcctgtcttctcgtggcctccccatggtgtgacttctatgtcctaactcagcgacatctgcagacctcctatttccaaataaggccacatcaggaactcccaggagacatgtatttgggggccgctgttcagcccctgcactgctccccacacagcccctgggtgtttcagtgcagcatgtgtcctgccagggagatggcgaaaccagacactatggtccctgcacttgtggcccgggttctaggaggtgaggccggcagggaacaaaataaccaggtggtgctgggatttgtcctttgcggagagcaaaccagtggcctggaaagtggccagggaggagtgttccacccgcagcacaggtgaggacgcgcaccctgggcgctgcaggtagcagggcccgatgtcgtagaacgaaggaggcctctggtgagacctgtggcaacagggacacatgctgcatcccggtgttcaattcttgctcttcctgtgccctgaatggggagtggcacctcttgagttttcagagggaggaagtatgccaagttcacctggaccctagatagggaaaggagcttgatgggggccaaggacaggtcacaggctcagtgggctctgtgtgcacaggattgggggccaggcttcggccacaggggcagtggttttagtcctcttgtcctggttcctgtggcctccagaaggggctgtggcaaggctgagagtcgggttgggctgggggctgatggggtgtggtaaggctaagcagggtaggttccagggcagggaacaacacccaagtaaggccaggcgcagtggctcaagcgtgtaatctcagcacttcaggaagccaagatgggcagatcacttgaggccagaagttcaagaccagcctgaccaacatgacgaaaacatgtccctaccaaaaaaaatacaaaaatttgccaggcgtggtggcgggcacctgtggtcccagctactcaggaggctgaggcaggacaatcgcttgaacccgggaggtggaagaccatccactggcacctgaacccatcaggcaactgtcccttcagctctgggcgcctacttgggtggaggcaggaggtcccaggtgaggacagcactgggtccacaatgggagagaatgagagatcaggtcagggcattccactgtcacctcagttgcgggtgtccacactgagacatggacataagcccgagaaaacaacacgagctgtaccctgaacaagaaggcagtcctccccagccccttggagctcacaggagcactgaggcccttgcctgtgagcccagatccaccctggcccattccatagggtgactcactcagcctccctgacccctgctgaccggttcaaggctggagccctgttttcaccccttctctgcctgcaatgccaaagaattcag

SEQ ID NO: 16730 - DNA, 38479 bp, Human
aaaacatgtaattgcaaggtgatccgggaatagtaagcgaaaagcaacaattaaatactattttctcatccaccagaacgccaaaaattaaaaagcctaacaatgtccagggctggcgagaatgtggcagaaggtgatgtcacataccctgcaagtgggaatctaaacagattcagggttttggtttttttttaatcgcaattaggtggcctgttaaattttttttcttgagacagagttttgctcttgttgcccaggctggagtgcaatggctcgatcttggctcaccgcaacctcgacctcccaggtacaagcgattctcctgtctcagcctcccaagtagctgggagtacaggtatgtgccactacacccagctaatttttttgtatttagtagaaacggggtgtctccatgttaggctggtcaggaactcctgacctcaggtgatccacccaccttggcctcccaaagtgctgggattacaggagcgtgtgccactgtgcccagccactttttttttttttttagacggagtcttgctctgtcgcccaggctggagtacagtggcgccatctcagctcactgcaacctcgcttcccggattcaagtgattctcctgcctcagattcccattagctgggattacaggtgcccaccaccgcctggcatggtggctcacacctgtaatcccaacactttgggaggccgaggtgggcagatcacctgaggtcaggagttcgagaccaacctggccaacatggtgaaaacccgtctctactaaaaatacaaaaaattagccaggtgtggtggcggatgcctgtaatcccagctattcaggaggctgaggcaggagaatcgcttgaagccaggaggcagaggttgcaacgagctaagttcgagccactgcactccagcttgggcgacagggcgagactccgtctcaaaaaaaaaaaaaatgtaaacacacattccctttaacccagcagaacatgggaacccaagggcattcagcctgtggcgcgaccaggcggcctgacttgagctcacgtagaaattcggcatttttgaaccaagagacagcacttgggatccggaatgtctggacttgggcacggcgctgtggagctggcgccgttgggagccatgcgagttctgggtcggtaggtcacctcagaggtggggagaaggttctctgagaccgacatgggggctagtgctggcaccaccggacatggggcatttcagacacagggcgagcacattccctagttaccagggttcattcgagtcagtcacgtcacaggctggcaatgggctaactcctcctcaacaatcacacggggcttgcctcatagaatgttttaaaaaaggaaaggaggctggcgcaggcgccaaccgtctcagaaccctgagcactgccccacccccaccctgcccgccatagcctgggctgttgtgggggaggggtgaccatttatcacgaaacaaaaaattgcgccacagcagctccctccctcccccacctttacggttgcagctgcacgtcccacgtgcagcaccaccccctgacacgtgcggcaccaccccctgacacgtgcggcaccaccccctgacacgtgcggcaccaccccctgacacgtgcggcaccaccccctgacacgtgcggcaccacacagctagtgccggaactttttgtgcagagaaagaagaccctgcacccgcgcggagggagcccttttgagattgcaggagagaagatgagaatgggactattttcaataactgtgcacatgcaagtcacaaacattccagatcccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccgggtaagttctcctcattgaagtctgggtcatgcagggccacgggcccggtggcttcaggcctggtggccatgaggccgtgtggtgaagggagagccttcagaggcacaatgggctgtgtcgtaatgccctgtcttgggctgttggggcccggtcgagcaccctagatggcagcgaggcactattcccgccaacccaagggtcggtcggttggttggtcagccgcgggttctggagcccgcccctcaatttacccacggccaaagttctggaggtcgccaagatctccagttgggagacaaaggatccagactggactgaggtggcgggagaatgtcactgggatcagattgggctagctgtggttttcattttagcggggagcagggcttccctggtaagcagttgtactggatccccgagggtgaatgagcgactctaacccaggatgtgaggataaaaagcaattaaaattccagcctgggcaacatggcgaaaccccgtctcttaccaaaaaataaaaataaaaaatgagtcgggcatgggggcgcacacctgcactcccagctattcgggaggcttgcttgtgctgttgggtttgctggtatgcagttgatggtttttgcatcagtttgagggatattggtctctagttgtattgtagtatttggttttggtatcaaagtgtaatgctggcttcataggatgtttcaaagtgttccatcttaaattttttggagtggctgggtgtagtggctgccacctgtaatcccaagcactttgggaggccgaggcagacggatcgtgtgagcctagaaactagttcgagatcagcctgggcaagatggcgaacctctgtacaaaatgttacaaaaattagctgggcgtggtggcacgtgcctgtagtcccagctacgcgggaggctgagaggctcaggttacagtgaactgagattgcgccaccgcactccagcctgggcaagagcgagaccgtgcctcaaagaaaaaaaagttaaacccagctgagggcggtggctcacgcctgcagtctcagtacgtggggcctgaggagggaggatcgcttgagcccaggagttcgcattcagcttggcaaacagtgagaccctgtctctaaaaaaataaagtaaaagaaaccgggaattgagtacgaattggaacaaaaatgagctgttgaatttgctagtatgcggttgatggtttttgcatcagtataagggatattggtctacaggttttttttgttttttttttctttttttgttttgagacgaagtatcactgtcgcccaggctggagtgcagtggcacgattttggctcactacaagctccgcctcctgggttcacgccattctcctgcctcagcctccggagtagctgggactgcaggcgcccgccaccacgcctggctaattttttctgttttttagtggagacggggtttccccgtgttagccaggatggtctcgatctcctgacctcgtgatccgcccgcctcggcctcccaaagtgctgggattacaggcgtgagccaccgcgcctggcctggtctatagttttgttgtagtatttgcttttggtatcaaaagtgtaatgctggcttcataggatgagtttcaaagtgttccaccttaaattttttggagaggtcgggcgtggtggctccaacctgtaatcccaggactttgagaggccaaagcaggcggatcgtgtgagcctagaaagttcgagatcagcctgggcaagatggcaatcccctgtgcagaatgttacaaaaattagctgggcgtggtggcacgtgcctgtagtcccagctacgcgggggacagagtttgcagtgaactaagattgtgccactacggcctggggaacagaggaagcgagaccttgtagagaaaaaaaaatttttttttgaggagtttgaagaagactgttgttaatttttctttaaatgtttggcagtaattacgaatgaggcttttatttattgggcgttttttttattactgctttagtctccttactagttagttgtaggtctattcagattttcttgtcctgattaagttttgtgaggctttctgtttctaggaatttatccatttcttgtaggttagtccatttgttggcatgcagttattcatagtacactgtcactctttttatttctgtagaagcggtattaatgactccactttaacttgattgtactttttttttttaagcagggtcttgctctttcacccaggctggagtgcagtggtgcaatcatagttcactgcagcctcgaactctcgtgggctcaagcgactctccttcctctcagcctcttgagtagctggaactacaggtgcacaccaccatgccctgcccatctattaatagctagttttgttgaccttttataaagaaccagctttggctaggggaggtggctcacgcctgtaacctcagcactttaggaggccgaggcagctggatcacttgagctcaagagttcaggacaagcctgggcaacatggggaaaccccgtctctgccaaaaatacaacaattagctagacatggcgagcacctgtagtctcagctactcggaaggctgaggcggaaggattgcttgaggctgcagtgagccatgtttgtgccctacactccagcctgggtgacaaactgagaccctgtctcaaaaagaaaaaaaaattggtttcattaaattttttctattttcttagtctctgttttatttgtgctttgatcttttttatttcctttctcctgctagctttgggtttagtccttacgttgtaaagttaggttgttgatttgaagggttatttatttattattattttttgagacagagtcttgctgtgtcgcccaggctagagatggggtttctccttgttggccaggttggtttcagacccctggcctcaagtgatctgcccgcttcggctcccaaagtgctgggattacaagtgtgagccaccgcacccggccagatgtgaggggttttaaaaaatgtgtttacagctagaaatgtcccacttggcactgcttttgctacatcacataggttttggtattttgtacttctgttttcatttgtctctaagggatttttcattttctttttctttcttttttttttttttttttttttgagacggagttttgcttttgttgcccaggctggagtgcagtggcacaatctaggcttaccacaacctctgcctcccaggttcaagcaattctcctgcctcggcctcccaagtagctgggattacacgcatgcacctccacgcccagctaattttgtgtttttagtagagacggtgtttctccatgttggtcaggctggtctcaaactcccgacctcaggtgatccgcccacctcggcttcccaaagtgctgggattacaggcatgagccaccgcacccagcctctcattttctttttttaattttaatagtgttaggggtataagttgtttttgcttatgtgaataaattctatattggtgaattctgagattttagtgtacccatcacccaagcagtgtacattgtccccaatatgtagtcttttatccctcacctccttcctaccttcccccttcattctcctccccaaagtccgttatatcactccaaaacttagctccacttacaagtgaaaacatacagtatttggttttctattcctgagttacttcgcttaaaataatgacctccagctccacccaagttgctgcaaaatacattgttttttatggctgagcagtattccatgttgtatatacaccaccttctttatccactcattggttgatggacacttaggttggttccttatctttgcaattgtgaattgtgctgcctataaacatgtgtgtgcatgtacctttttcatataatgactttttttcctttgggtagatagccagtagtggaatttctggattgaatggtagatagatggtaatctactacttttagtatttttttttttttttttttgtcttgagacggagtcttgctctgtcgcccaggctggagggcagtggcgcaatgttggctcactgcaacctctgctgtccgggttcaagcgattctcgtgccttagcctcccgagtagctgggactacaggcacacgccaccactgccagctaatttttgtatttttagtagagacggggtttcaccatgttggccaggctgatctcggtctcttgacctggtgatcgcctgccttggcctcccaaagtgctgggattacaggcgtgagccaccgtgcccagcccgatggtgtattttgatgggaattgcattgaatctgtagattgctttgggcagtatggccattttcacaatattgattcttcctatccatgagcatgagatatctttgtttgtgtcatctgtgatgtctttcagtagtgttttgtagtttttcttgtagctgtctttcacctccttggttaagtatattcctagggtgggttttatttgttgtttttgctgtttacagctgttgtaaaagggattgagttcttgattctcaagcttggtcgttgttggtgtagtgctactgatttgtgtgcatttattttgtaacctgagactactgaatttgttcatcagatctaagagtcttttggatgagtctttaggattttgtttgtttgtgtttgtttgtttgcttgtttttgatggagtttctgtcacccaggctggagtgcagtggcatgatctcggctcgctgcaacctccacctcccgggttcaagcgattctcctgccttacccgagtagctgggactacaggtgtgtgccaccgcacccggcaaatttttgtatttttggtagagacaaagtttcaccagaccatggccaggctggtcttgaactcctaacctcaggtgatctgcccatctcggcctcccaaagtgctggaattacagatgtgagccaaccgcgcctggcctagggttttctagctgtatgatcgtatcatcagtgttacagcactagtttgacttcctcttctccaatttggatgccctttatttatttcgccattggcttttggttgtgtaagagtgtgttgcttaattttcacaaatttgtgaattttccagttttccatctattattgatttctaacctcatcccattgtggttagagaaaatacttagtgcaatatgtttttttaaatcttgttggccaggcgcggtggctcatgcctgtaatcccagcactttgggaggctgaggtggggtggatcacctgaggtcaggagtttgagaccagcttggccaacatggtgaaaccctgtctctactaaaaatgcaaaaattagccgggcgtggtggtgcacctctgtaatcccagatacttgggaggccgaggcaggaaaatcacttgaacccggaaggtggaggttgcagtgagccgagagagtgccactgtactccagcctgggcaacagagtgagactgtgtctcaaaaaataaataaataaatcttgctccagagcctgggctagatagtaagaggacagtgtggatgcagttaagaaccatatatgtctgaattttttgtacatgttcattttgttcccttcaccttcaaaattagtaacagatggctgcattttctcaagggatctgtgtggcttttaaatctaaatcatccacttacaggacatttgcaaagcaagaggttttagtccccattttctttctttttttttttttttttagtagagacggggtttctccatgttggtcaggctggtttcgaactcccgacctcaggtgatccgcccacctcggcctcccaagatgctgggattacaggcatgagccactgtgcccggcctaagtccccattttcttttttcttttttttttttaaatgagacaattatttattttaggcagatagtcaacttaaaaatcattcagcgtgggcactcctgaaactgtcaggatcatgttggtttcctcgctgtttgccggctattggcatttgtgtcatcacacacagtccgatgaggtgacaacagaaaagcatatctcacttctatcgtaggtttccattcactttcgggttctcaatcgccctgtgtttcctcagtgatactccagactttccagatgttctggttgacccattcctctttcttttttttttgcaaaacaaagcaaaaagcaagaagagaactttacattttgtccaatagtcctaagaaattttccctgtagagaatgtcatctaagtcaaaacaagggttgaataggggcacccaaatcagttatcacttagggctgttataagaaatgccaagactgggtggcttaaacagcagatattcgtctctcactgtctggaggctacaaatccaagatcaaggtgctagcatggtcagttctggcgaggacctgctactgggctcaagagcactaccttcccccccgtatcctcacatggtcggtctccagcctcttctcataaaggcgctgatcccattcatgagggctccactctcacagcgtaatcacctcccaaaggccctgcctccaaatactgtcacactggcattaggatttcagcataggaattctggggggacacattcagtccatggcctcccgtacctgtgaatgtgatcttatttggaaatagggttttgtaggtgaaattaagttaaggatcttgagataagatcatcctggacttagggtggaccctaaatccagtgactagtgtccttataagagaaagaaaagagagattggagacacacagacaccgtggagaaacgcaggagaaaaggtcctgtgaaggcagagaggcagggacgggagtgacccagctgcaagacgaagaacacctagggccagcagtagctggagaggcaggggcgagggcgatcctcccctaggacctagggagagagcgtggccctgctgccacctggattctggatttctgttttgagccatcacgtttgtggcaactcaccctggcaggcttaggaaacgaatgcgttaacccattgcattagcgcacaaaataacaccctgactcgtttcctgcgccagcctcctaccttgccttctacttattagaccctacctctcattccccattttttaaaatttttatttatttatttatttatttatttatttattttgaggcagggtttcactctgttgctcagcctagaggtgcagtggcgtgatcatggctcactacagccttgacctcctgggcttaagcaaccctcccacctcagcctcccaagtagcttgaactgcaggtgcatgccaccctgcccagctaattttttttttttttttttttttttttttttttttggaaagacgaggtttcaccatgttgcccatgctggtctcaaactcctgggctcaagcaatcctcctgcatcatcctccagaagagccgggattacaggtgtgagcccccacgcctggcctttccctcctttttatcattccctcttccctcgtcttccttggctttcctcctcacacctcctgcgtttggcccccttccattttcttttctgcttctcttttcccaacttccccctcatcatgccagggggactcctgggctgcgtgccacccccctggaagtcccccataatgaagcaggatttatgcctcacacttcaccatgggagagcagaaacctctcacttgaagcaaaaggcactgaaaataagcaaatagttatgcatttgtcactaccgagtcctagctggcttccaccctaccccccgccccccaccatcttcttgctcattcaggtcatcgtgttctctgatacccagtaacttccatcattttctacatgcatttctgttggtcttctgagaattgtgattttccaaagtagaaagggcacatcgtctttttggagcctcaaaggtgcagacactgatgcgttgggggagatcacagtgtgacaaggatggggtgggagtgtgtcacccccctttctaccgaccctcagcagtggggagagagcagaggagatggaacctgagaggaagaagagatttccaattacttccttctcggtcccttctccactgaagcctgttactcctctgctgccggggcctcttgagttttctctcactgagccaggaaagagcttagtgaataaagaacaaggtatcccagcaatgcagggaagatgtccaggacagtgagtgtgaacgaggggtcctggagaatgtgcacgccagccctgcaggagaatgtccacgccagccctgcagcctggtgggctctgccatcagcaccccaaaaccattcatcagtcaccttcgacaattgcacgtgcaaaagccctctttttgtgtcctttgaagctttttttttatcaggctgggtgcgtggctcatgcctgtaatcccagcaccttgggaggccgaggcgggagaatcacttgagcccaggaggtcgaggctgcaatgagctatgatcatgccactgcactccagcctgggtgacagagtgagggcccatcccttcgcgggtccccattaagaaaatgggggagggacagtccccattttcttaatggggactttcttagtgaaatttgaaatgagagattattaatatgagctgggcctaacatctttttttacttgcagttggggcagagctccagggagttggttttgtcccctgctgtcttgtcccctccccctttttaattaattagggcctggctggactcacatgcaggccgctttctaagagcagcagttactttggcagcattcagaaagggcctcagttactctaccatgacaaatttctcagtctgtcaccgttcacttcctaaaagaaattcattgtagaaggtagaatgggatcttcatggcatttctgattcacaatgctcctgaaagttcctcggcatgtggaaaggccacagatgaatttaagcatgtgaaagaatactcatgtcagaggcacaaaggaaacttgccccgagtccacggtgctctgcggttaggagctggcctcactgtgcacagggggaggggtggtgagcttaccgggctttaaagcgcccttccaacctgtgagccctgcattccttacccttggttggattcttcccgggctgggagaaatgaccgcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaaggtatgccggtggggagcccagggctgctgtggcgcctgctggttaagcccagtttgaacagccaccgtgtgggaacaaggcctgaaatgggcctcgtttattattttggttcttctttctttgcatcttaaagctcgagtgttctagtgagggccacttggagccctgtgatggcatggtaggaagggtggcttgggagagctgactgtccttcctttcctttggtcacaccctgcctcgccccacttagcacgaacgcttcccccatggcagggttatgctgctcccaccctctgtgctgcctgaggagaggcaggcagcctcagtgaatcccactcactgagcctgggggaacttgagtgtaaccgggagggacatcccacccctgtcagttagcttcctcttctatgtttctgcacatctgacctgaaactgatgggcacttctcatgagattgggcaaaataccagccacttcatgaagtatcatgggtgataggaaagaaaaagaaccttaaaaacaaggtcagtttgagaatgtgtggctggtttgatgccatctcaaagtacactgtgtcccgaagcaaattaaaacctggctaggggccgggtgcagtggctcacgcctgtactcccagcactttgggagactgaggtgggtggatcactggaggccaggagtccgagaccagcctggtcaacatagcaaaactccgtctccacttaaaaaaaaaaaaaattagctaggcatggtagcacatgcctctaatcccagcttttcgggaggctgaggcacaagaattgtttgaagctgggaggcagaggttacagtgagccgagatcgtgccactgcactccagcctgggcgatagagcaagactccatctcaaaagaaaaatctggctgggtagagtactgtgtccaaatagaaatgccagattagcacagtgggaagtgaagacaaaaactgggcatagctgaagtaagtgcctaaaggtcataattgtgacccttgtcttggtgtctgaaccataacatcaaatggtttggcaaaaaataaatagaatttacatgtgtacgcgcatgtgtggagagagggatgaagtaaatgccttccattgctttcagttggttattggaggtaagcagtatacaggaaggaaatcattgtgctaggctttaaacatgtctataaacttgaactttttttacatctttttttgttctttttttggggaggtagagtctcgctcttgcccaggcttgagtgcagtggctcggtctcagctcaatgcacccctgacctcctggcctcaagcgatcttcccatttcagcctcttgagtagatggcattacaggcatgtgccaccacgaccggctaatttttgtattttttgtagagacatggtctcactatgttgcccaggctggcctcaaactcctgggcccaagcgcccacctctgcctcccaaagtgctgggattacaggcaacaagccaccgcttccagccctctttacaatgaaaattgaaaaaaaaatagatatataaacgcaatatgggtgtttagatttctggtttaaaataaggaaaggctgggtacagtggctcacaccagtgctttgggggctccagcaggaggatctcttgagaccagcctgggcaacatagcaagaccccagtgtctacaaaaaatacgaaaattagctgggcgtggtggtgcgtgcctgcagctactcaggaggctaaggtgggaggatcacttgagccttgggagatagagcaagaccctgtctcaaaaaaaaagaaaaatctagactgtcatataacagctgctatcagagccattggccttaggggatgaagaggctttctatcgggcagcagcacaccaggccctgttcggctgccagaatttgtgtgttcatcagatttagctggctgatgaaattggaacaaaagagaaaacacatgaagcatagtccattgtggtttgcctgggaacggggtaaacagctatactccaggcagagcagatctttattctagcctttcacctccctgaatcgtctgccccgcagcataagggttcttgagaaagacagcacccatgtgggagcacttctgccataacgggcatcatactgatgcctcaccattttctcaatctatcctcactttatccttgacctcctgtcacctaagggggctctggtctccattgcacccataaagtctttgagatgggcccactggcctcacacttcacagccagagggaagcagagttggtctgactgctgagcccaggctcggtccattatgttataggacttccaagggcatgcaaggcgactgggagccagagcttgttacgtgagtgtggtgggtgccatagggagggagatgtggctagaggcatagtcaaaagagacttgagttgagtggggcagttctgctgggctggaaatgcagaaccaaaagggagtctctggggggcacaaagcatgcagagaattccggggaaggtcaagagcaaccagagagtagcagagggtaggaagcaagaagcaggagatcagagaatcgtaaataccatccatccatctacagtagtgatgacctcgctcatctctgctcgaatggcgctgacgtttgagcagaggagggtgacaggcaggaaacaaacttttaagtcaatagatggagtgtcaggtggggccaagcatctggaatcaagtaaaagtggaggaggtaggaggcactggttgaaaaagagtggtccagaaagacctcagtgctgacgcttgagcagggatttggaagaggcaggagagtgagctgtgcccacatccacgcacaagcactccggtagtgggtgccatgagtgctaaggccctgaggcaggtgtatgcccactgtgttcaaggagcagcaaggaggccagggtgccagagcagtggaagggagaaatggaggtgatgggggctggggtgggcagacaggtgcaaacagttgagctctacttggtgggaggtcggaagaccttagaaagttgagcgatgtgatcagtcaacttcagttttaacaggctcccccttgtggctagattgagaatggctgtgggggaggctgggaggccactgcagtgacagaggcaagggatgtttaagaccaggtcgaaatggtggctgcagaagctgttgggtaaattcagtatgcttgcaagttgggcctctccagtcagtgcagcagctctttggcatgaccttgtggcccacagagggccacattttctgcttgggatagtgatgaccctgtgcctgcaaacaggatgttgggggtggggtagatgctagtagaaagggattcatttctagcgtgggcacttctagatgagcacgtgtaagatctcagttgacctgagttttataaaccagggaaccagagtattctctttctggtttctgttttaagaatccatatcctccataggattgaacatgtgatttgtgcatgaccgggaagggccatgggaaaatgtcaagaatcatactttacgttttctgctttgtacttgggctccccgtctctattcccaaagctccagccacccttgccatactgtatggattacctatgactccctgggcagggacagtggatgtcttcgtcaccttagtcacctgagtttccagcccaggctgagccctgggcttgacccattttccacttgtaacgttgatcggaagcttggggtgcatatgggtgtggggaagaggaattcacccagcagggcgggaggggctgttcggatgggacgctgctacagagctgacaggagcagcctgcactcagtgcgtgagtccacctgataccatgtcctgcagctgcgtctgggctcactgggtcccttctcttacagagactgtcgtttgtggatgtggcaacaggatggctcggacaaggactgggagttgcatgtggaatggcatatactggcaagtacttcgacagggccaggtgaggttcttccccagaagccatttaactgccctacatctacatccccttcctagagtctcggggggcagccacctatctccgtgatgtggagagccctgaagggccagtccccatcacatcccgtggtgacccctctggaaggccttccctgtgccttttccccacctcgggcggctgccccactttctctcccacaggtctgttgaaaggtttcagctgctgttgcctttccattcttatcctagggttgatagcttttttaaaacttccagcactttagtggggtctgggatgtgtggtttgtttttgagactgagtctcactctgtggccaggctggagtgcagtggcatgatctcggctcactgcaacctctgcctcccagtttcaagtgattctcctgcctcagcctcctgagtagctgggattacaggcatgcaccaccatgcccagctaatttttgtatttttggtagagatggggtttcgccatgttggccaggctggtttcaaactcctgacctcaggtgatccacctgccttggcctcccaaagtgctgggattacagatgtgagccactgtgcctggccagatgtgttttcttgatgcgaacactcacgtcgttggttgtggaggaatttacttcacagcagaacacgtttccaaggtggggtgttttgattgttgtgattattgtaaataagttgtaagaacagaactagcaggtggcggcgggaggcggtggctcacgcctgtaatcccagcactttgggaggccgaggtgggcggatcgcctgaggtcaggagttcgagaccagcctggccaacatggcgaaaccgcctctctactaaaaaatacaaaaactagctgggcatggtggcgtgggcctgtaggcaggagaattgcttgaacccgggaggtggaggttgcagtgagccaagatcacgccactgcactccagcctgggtgatggaaactctgcctcaaacaaacaaacaaaaaaattagaaggtggcaatgctttaaaagggaacttaccagaaaaatgaatgtgtaaatgtttggggaacttaaggatgctgctttcttccccttcccctctggccctgtttgcttattgataaggaaatgtggcagaagaacctaaaagttgctttacagctagaacagaaaactagccagaggtaaagcctgcttgtgagcccccaggcttttcaagctcggctttcttagctgctgggctggggcagagttgatgagggagattgtgggaagcgaatggtctggagcagcagctccagttgcgtccgtttctcctcctgaaatgcatttgtttggttggcccagatgatcccccacagggtcctaaacctctcttgtcttgctccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtaactgtattctcttgtgcttgatttccattctgtcctgcccccttcatctcttgtaacccagcctgctcctctgttggcaggtggaacacttatgtggtggacggccgggacgtggaggcactgtgccaggtattctggcaggcttctcaggtgaagcacaagcccactgctgtggtggccaagaccttcaagggccggggcaccccaagtaagcaagcactttcctcctgctcctggttgttaaaagcatctgtccgctcagcagcagaggcgggagaggcttagaggggcctaggcagatgactcatttagtgaatagcagttctgcctggagtatatgttggaggctcctgctctcttattttcactagctagtgtctgcttaggataggagatatcaaaagccctagcaggtgaacagtgatgtgctgcctgcacaagggagtggctaggagtacagcccatcggaggactgacagggaacaatctctacggttagtagaatcagaaagcgtgctgtgtgtatgagcaggtgcaagaaataagagtgcatacctacacacgtgcctaggcccacactcttctggaagaaccctgggaattggggaagacgggagcttggaatcaccaactatcacatttcaaggctgacagctgaaattgtttatctcaggtttaactcatcacaaagagtgcggctcctggatttttttaaaagactatagacattttagaataaaactgttctgtgactcctaccgaaaatatagttttactctggtaccctccgttcagtaaattattttaccagtgtgctcctggcaggaccctgggtgttgtccttgcctctgcctccccctcatatgcccacacatagacccagtcccctagattacatcttggacccattcactcctccccatctctactaccatgactgttgccacacccatcatctctcccaaagttccagctggcctccctccacaccagtctctacactgctgccacagtgatctttctacagtggatctgatcagtcactttccccactccaaacccttcaatggtttccaatcttgctttggataaaactcaaacttctcatacccacaagacccaccctccatggtctgccctacctgtctctccagccttattctcattctcccttccactcaccagtggccctcaggggcatagctaggtgcaatggcttgcacctgtaatcccagctacttaggaggcggaggcgggaggatcactcgagcccgaggagttggaagctgtggtgagttatgatcacccactgcactccagcttggggaggagtcatagcgtgagacccctgtctcaaaacaaaaagcctcagggcctttgtccaagctgttctctctggctgcagcagcgtcccaggccctctgtgccaggtgttcctcctgtgagtcctagggtgacatctttttcatcggggtctgtttttcaggtgacctcataggcactcactaaatatttatggaatggatgtcttttgtttgtttcattacaggtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaaggtaggcagaaaggtggataattgaataaatcagatacgtcaactgctttgttctctaatgttgttcgtatgtacacaggattcttcatttattctggtctccatggacgaaccaattactagagtgacatgtaactaacagttcgtaggcaataaagagaggtttgccatttttaaaaaatacatttaggggtccaaagtgcagctgtgtcacgtggatagatactgtgtagtggtgaggtctgggctttcagtgcacccagcatcggagtagtggacattgcacccagtaggtacttgatctttcaccactcctggctccccttctcttttattaggtctgatttttatttttggctttcacatgtgtgtctgaattttctgattggtcaattgctatttattagctcctggtgtggtgtgcctttttctagcttcctaactttggtttgtgcatgaaactgccacgactctgtgtctccgctaagaagactggccccaggcgggctgaccttttgaacttactctctgaattacacagaggagcaggccaattcatcagaaacctcaaaaaggaatcaaatgatgcacaaaactcttgagtatcaagtccttttggtttttagcacctttacatcctgccttctggtatatcatagcagacctgacataggcaagttctttatggcctagaggaagtaaggcggcgagcctagggaggaaggacacactttctgatccttctttatttggagaaattttgagtgttgctcatgttttcttagcctggtaatgagggttaaaaataaatgaattttgaatacttgagaaatcaaaagacaaaaaccagaagaaaggagacggtatatcaacaaagggtgggccaggcacagtggctcactcctgtaatcccagcactatcaggaggccaagacaggaagaccacttgagcccaggagttcaacactagcctgggcaaagtagtgagaccccatctctacatagaatttaaaaattatccaggcatggtgccataatatggttccaggtactctggaggctgaggcaggagaatcacctgagtccaggagtttgaggggatagtgagctatgattgggccactgcactccagcctgggcaacggagcgagactctgtctcaaaaaaaaaaaaaaagtttgagaaaactatataactccatagttgcataattggtatgaaaatgtgtaaaaagcggggggaccatttttaggaatacataaaatatcaaaattgactaaaagaggtataaaaaccttaaatggatcaatagccctagaaaaaaatggagaaaattatccaagtgctatacccccaaagcaccaggctcaccaggttatataagactgactcatttttaacctttatgaaaagagtaatttctaaactgtttcaaatttttccaaatacggaggaagatgaaaatgtcatcccgatttacttatgaagcgaaaatgtgacaaagctagcctaaagaaaactgcagagcaactttctttatgaataccaatataaaaattctaaatagaacattagcccatctcaacttcattagtacattaaaaaaattaaatgaatcagtgagctcaaattagtaatgcagatgactcatgccaggagatgtaggaatagaattcagtgttctagtgttaggttaaaggaaggagggaagtgtgatcatcatcatacacactaaacaaaagcaattcataaaactcaacattttttttttgagatggagtctcgctcagtcacccaggctggagtgcagtggtgcaatctcggctcactgcaacctctgcccccggattcaagcgattctcctgcctcagcctcccaagtagctaggattacaggctcccgccatcatgcccagctaatttttgtatttttagtagagacggggtttcaccttgttagccaggctggtctcgaactcctgacctcaggtggtccacctgcctcagcctcccaaaatgctgggattacagatgtgagccagcacacctggccaagtaatttgaaaaatataatgagaaccattaatgtcggaaatctcactcttgagctgtggagtgtttacctgcttaggaagtgggggttgggggagcgggggatgttaactaaaaagagcacaatttgagaaaaacttgggtgccacatcagccatttagtatggatttaagattggctagcagtccatgtttatgacattaaaggaaatttttggtgagtcacgaatttactttcttcaagatagatgataatttgtcattctacaatatggtaccttccttctgtagtcgttccttctaaatgcatttgaagaaactctaccacctgattgtctctgtcttctagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagtgtgtagtgtctctcagggcttcttagaatcaatggcccactggacacaggaggcccagcctgtgctagtttttctttccatttatgaaagcaaaaggactggaaaaaaatttcctgggaagcaggaggcaagtagccaggtggagtctgagaggtggcttctaggtctgctaggagggccgtaatagactactcggcacttggagtctccaagttggctgagggcagcaggcccaaggccacagacagtgggtcctctgagcctcgaaccatctgaacccagggctctgggcctgaagcatcccaggctccctagtagctccttctgcccaattctgcaaccacccagaggcacactggctgaggagtcacagggaatgcagagtttccttctctccactgtagaggggcctaatatagcacagaaatgcaaatgttgcacttacttcaatcacaagaatatcaatgcttagagctggtgccttaggcaaagccattctgcttatctatgcctcagtctctccccagagtgatattaatgcagggagtatctcaagcacatgcacacaagcgcacccctctggagaggaaggagttatggccagtaaaccctttgaactctaaagctctgcgcgtcatagaagatgatgcccagctcctgtcattaggccagaaaaccacaggccagcaggtcttatgtgaccaccagtgactttatttataacaagtagtatttttaaaaaaaatttttttagacgaagtctcgctctgtcgcccaggctggagtggagtgctcagctcactgcaagctctgcctcctgggttcacgacattctcctgcctcagcctcccaagtagctaggactacaggtgcccaccaccacacccggctaattttttgtattttttagtagagacggggtttcactgtgttagccagagtggtctcaatctcctgacctcgtgatccgtccgcctcggcctcccaaagtgctgggattacagacatgagccaccgcgcccagccagtattttaaattttttaaaaattagttgccagcatttaaaaatcagattataggtgtagtggcaccagcctgcagtcccagctactcgggactctaaggcaggaggatgcttgatcccaggacttaaacgctgcaatgtaccactgcattccagcctgtgaaacagcgagaccccatctcaaaaaagaaaaagaatcaggaggtcttatatagaatacatatttctggattcttttgaaaaatgggaagaactactaccatagggtggcattccctcctgacgccagttgactgaagccaaacagcacccctgttgagatgggtgtccccacagctccccatgctctgctgggccatttgggttttttgttgttttgtggtttttggttttttttttggggtttttttttttttgagatggagtctctctctctctctcaccgaggctggagtgcagtggcacgatcacagctcactgcaacctctgcctcccaggttcaagcgattcccttgcctcagcctcgcaggtagctgggattacagacatgcgccaccatgcctggctaatttttgtgtttttagtggagacagggtttcaccatgttggtcaggctggtctccaactcctgacctcaggtgatctgcctgcctcagcctcccaaagtgctgggattacaggtgtgagcccccgagcctggctcattaagctgttttcattttgaatagaaaacaatgcgatccgtaattttctggattaatgctcctgtcaaaaattttgctccccacctcactgattgcctcagcacgcagccatgtagtctactccgtccctgctgatatgttctcacagttggaaaaaagttgtaaagaaaaggcgagcaggtggtatttagtgccatgttgaaagaggtggctacaatgtagagcttgaccaggggcagtcagggacaacctctcagaaaaggtgatacttaagctgagtctcaggtgacgaggggtcagccgtgtacagatgtgggagacagcatttcaagcaaggggcatggccaactgtaggcaggcccaggcttggaatgtttggagagcagaggaagggccaagtggtaggagcatggtgaacgcagaaaactctccagggcccaggtcatacggggtcttataggcgcccttttcagtatctctggttctcttgcagtttgctgggaagccactggagggctttaagcaggaaagcaacagcctgcgttttccaaaactctgaagactggagaatggcttcacgtaggaaagggaggagaaggagagggtgacttggaccagggcagtagctgtggagtcggagggaagcagacttgtcacatattgccttggcaggagagtcagcaggatgccaacggcaggtgtcaggacaggacccaaggctggtgcttgagtgtgggtggcagcacctgggggaaggtggtgtcacctcttgagattgacaagactgggggagaagtggactggagggcaccatcaggagctctgtgtgggcctggggggttggggcacctgttagatgtacagaggggagacagtggtatcagatggctgggcagtagatcagtcagtcattttcacatgtggccgctccacaccactaaatgcagttttctaaactacatattcgttggcctagttttaagctaacatcttttttttatttttattttttgtagagatggagtcttgctctgtcacccaggctggaatgcagtggcacaatcatggctccctgcagcctcaaactcctgggctcaaggggtcctctggcctcggcctcttgaggagctgggagccgccatgcttggccacatctacatttttaatcataaatttaagtcgttgcaaaggatgtagttgttcatatattgacatttttgatactttaatactcaaatcatgccattaatgatgacactggctgggcatagtggctcacacctgtaatcccggcactttgggaggctgaagctggaggattgctggagttcaagagttcgagaccaggccgggtgcggtggctcacgcctgtaatcccagcactttgggaggccgaggcggacggatcacgaggtcaggagatggagaccatcctggctaacatggtgaaaccccttctctactaaaaatacaaaaaaaaaaaaaattagccgggcgtggtggtgggtgcctgtagtcccagctactcgggaggctgaggcaggagaatggcgtgaacccgggaggcagagcttgcagtgagctgagattgcgccactgcagtccagcctgggcgacagagcgagcctccgtctcaaaaaaaaaaaaaaaaaaaaaagttcaagaccagcctgaacaacatagtgagacctggtctgtaattaaaaaaaaaaaattcatgccaagccacttttctttgtcagaaattaaaaccctttttctacttgatttccaatttccattccattcatttccccaatatatctttatgcatgaaagccttttattgattgtcctatcatttttctctgcaacaaaaatatgcatataaattgataggtttttaaaaaattataatataggcttctgagcattaggtttttttttctggactgagatagaattttgattattattagctggtatgttagtggatgagtatacttgtagtttgaatgtgatagcattgagaacagattctattcctgtttttcatcttcatgatgtgctatgaaaccttacttacatgaataagtagatgggaagggaagttttgttagaggaatgtcactcagttctttgaattccttcccagttgtaagtcaaaaaatcacatagtgatctttcatgtaaagttgtttataaaagttatttacagagttgacagtttcattaattaagttcttcactttctctccaccagcatagttatttcaaattgtcctctttacttgggtctggaggttctgcactccaggatgatccccctgtaagagtcaggtggctgagagcatgccctttggggatcaggttgctagaaggtgattgttaaaagagacagttgggagacccaggggcagtggctcacgcccgtaatcccagaactttgggaggccggccgaggtgggtggatcacctgtcagttcgagaccagcctgaccaatatggtgaaacctcgtccctactaaaaatacaaaaattagccagacgtggtggcgggtgcctgtaatcccagctactcgggaggcagagacaggagaatcgcttgaacccaggaggtggaggttgcagtgagccaagattgcaccagtgcaccccagcctgggcaacagagcaagaccctgtctaaaaaaaaaaaaaaagaccatgaggggagcacagaccctccttttggcagatgaatgtagacagagttgatctggagtttgggatcttgagtgtaacacccacagccacatcccctttggaaagcctgtgtgtatccgcagagaggtttgtattctagtttgaagccttctggggtatttgagcccggacttctggggaaggggggtaaggaatggcaatgtaaagtggggatcattaccagaatgcacatcaggggagcattgggccagatgcgacttcccgagggtgcacagggccctgaggacttgccccagcagcgcccatgaggcgacagcagtgggccactgccacactgcagaaaccgagaggaggaaatgccttgagatcaggggccaagtcaagtcacaggccacccaaggtcaggcagcctcttggttttgtggcttcgaggtcccttgtggggatggtggcctagatgaagtaggctgggaagagcgtggaaaatgagaaagcaggggcaatgactataggcaagttttgagaagtttgctgcgaaggagaacacagatgtaaaagcaggacaaggcggagatggggctgtgaagataaaaggtgctggcgcacacctgaatggaaatagaatgatccaagagaaagggaagtagcacaagaggggaggaggagctgcatggctggagacccctgtgagaaagcaggaacaggacagattcaggatgtcctgtcggggcatggaccctggaaagctgcggacaccaggagggcaggcaagagagtctcatctcttgctccctaggagctatgagttgagggcgccgtctgagcaggagggacggacgggtgcccagggtttgaggaaagaggggtgtgggaaggacgcatgctagaacttcagagcagttcagcaggtgcagaatgggagttatcatggggactgtgggagaaggggcggtgggggcaatgcccagggatgttctgattcatgttctctgtgctgcaggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtaagggttctaaatgccatcatcttggtagccttcctccttcacagagaaagattagcatgtgattggttaaaccacgaatttccttatggttccatgaagtttgattattcaagcctttttcttgaaaaagccatattgtactttaaaagtgtcagactctcagggcaacttttgaagtgcatctctcggtggtactgttgtttcagacagtgagaaacagttgcttatcccgagtgccccttgtgtgttgagctgcgtgcaggttatggacaggactggcagagtcatggagccttttctgccctcgctgtggttgcagtctaactgagggtgaacagcatcacagaggacgaggagcattctggctggctgcacagcctgctcaggtgggaggggggctgggaccaccatcaccaccttcctgcctggggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgtgaatgacagaaatgacatgggaaagatgagccagctggcgtgcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctcagtttcagttttgaaatagtcacatggagaaagtgactctaggttccatccaaagaagaactggaaggctgggcgcagtggctcatgcctgtaatcccagcacttggtgaaaccccatctctactgaaaatagaaaaattagccaggtgtggtggcacgcacctgtattccagctactcaggacgctgagacaggagaattgcttgaacccaggaggcagaggctgcagtgagccaagatcacaccactgcactccagcctggcgacagagagaggctttgtcaaaaaaaaaaaaaaaaaaaaaagccagagcggtggctcacacctgtaatcccagcattttgggaggccgaggcaggtggatcatctgtggtcaggagtttgagaccagcctgaccaatatggtgaaaccccatctctactaaaaatacaaaacttagccagacatgttggcacatgactgtaatcccagctacttgggaggctgaggcaggagaattgcttgaacctgggaggtagaggctgcggtgagccaagatgacctagtgcgctcaagcctgggcaacagagcgagactctgtctcaaaataataatagttaatttttttaaaaaaagagctgggctgttgaggttagacagtggtcctaggcaaggcagtgtgcatggtgacaatccccttcctagctgagaaaagctaagctgcccagtgcacattaagatttctctttcacatttctggtgagaaactacgttcccagatacaccctaaagtaccctgtagcaccctcagcatgctttgaaggtgtgttaactacttggaaggcctggagaaatgaaaaagaccactttggtatgcaaaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttcacacccctccttcacttctttcaacgtctgttgttggaaattcattgtttgcttttctaaaccatggctccatttatgccctaggggatgtgcttcattcggaccacccgaccagaaactatggttatttacaccccacaagaacgctttgagatcggacaggccaaggtaagggcttacgcgctcctgcgttattcagtatcatctcctgtaaaaagaacacttctgaatctatcaccagctatcttcagagttgagacatcatcctttctttgctctcatttttttaaaaaacagttgtgacctttacctgcttttccttgggaaggaacattctatgaatttcagcttagcctgaacttttctgctttccaaatggagtcttttgttgttgttgagttcaaagatagtaacatgaagccacttgagcggtcgtggctataatttatcttggccgcaagctaaacaaaacagaagccagcgctttgggaggccaaggcgggaagattgcttgaggccaggaattccagagcagcctgggaaacatagcgagattcccatctttacaaaaattttttaaactagccgggtgtggtggcatccacctgtggtctcagctactcaggaggctgaggaaggaggatagaggagcgcaggaattcaaggcagcagtgagctatgatggatcacaccactgtactccagcctgggtgacaagagtaagaccctatctctaaaaacaagacaaaaaataatagaaatcacttgaaatgaataatctgttaggttcagattttacagatctaaggccaggaataaaagggaacatgatctctggtattctcacaaaagccctgagaagttcagattatcagtcctatctgtagatgaggattggagaaagtaagtgtcttacttaagggtttacagcttgtgagtaccaagaccagaatccaggcctgagtagtgagcccagtctccccaggtctgcccaccacgctgaccatcccctgctcagcctgcctgtcagggccatgcatagagaaaagcagaaacgtctatggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtactcagaatggccagagtgctgccataaagcaggtgtttccagaactgtccactgtgtgccataacgtagctggaaaacgccaccaaatggaaaagttagtgttcacctttggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaagggctgggctttgaaaagaggacatggatatgtgtgcatgcgtgtataagtattttaagaggccaggacatccttaaagaatggggtggctcagaaaccctttctgtactatcagcaatggttcttaagctacagggaaacctatacagaggggaagtggagaataattccagatgcctccgatgggtagctttggaggcaacaatctatgaaagaagcccaggaactctgtctttgcttgcagaatagtacgttgtcgagagcgagggctttgatgtcagccccgcctggctgtgggtcccagccctgccctgggccacttcctcctgctctgagatttgctttcctcagctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtatgtggcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgccccaggccaggcgtggtggcttacacctgtcatcccagcactttgggaggccgaggcaggtagagatcacttgaggccagaagctcaagaccagcctggtcaacatggtgaaaccccatctctactaaaaatacaaaaattagctgggtgtggtggtgcatgcctgtagtcccagctacttgggaggttgaggcaggagaatcacttgaacccaggaggtggaggttgcagtgagccaggatcataccattgcactccagcttgggaaacagagtgagactctgcctcaaaaaaaaaaaaaaaaaaaaaaaaaaaaaaaaaaaaaaaaaaaaaaagtgtgccccgacgaaagcaggtatagcagagaacacagcaaatgcagaaaacagtgtgtcagggagaatgggctgggcagtgtttgcgcctggaaaggttaggtgggacagatgatgtgatacaaggagcattgagtgttcatgcggcaggggccctctgagcctgcacaagcggtgcctgatctctcgaaggactcctgggacccagcacacagttgctctcacacctgaggttgatgacagggaaagggtgcagggggggatccaccagggcaggaaccatgggccaggtggagttgaaagaagtcctgccccagcctccccttggccccacaaggggcatactgagaagtgcctcccacgcaggctgtgttcctgcctaagggatgcctgctagagacttggcacctcaagtgtgtactgggggcaggtcctgttggcaccctctgccaggcaggtacccaaatccctggctcccagcaggaaagcaggtgctcatgtcaaccacattgttcctacagacagtccaggtgcatgaccgccctgtctagtggggaaagtgttagagtagcaagggaaccttcacgagccaagagctaaccttgccaaccaacagcctcaagccagctagtcacttttctgcactgttaattcattagttctaaccattttcaggtccccaacagctttgagaatcagagtgccacagacccccacactcaggcagcccttactgtaggttgaggcagagcagtttggaaactggcagtttagaatgagaactccgcaggcccatcggagtggctgttcacatgaatcagattttcccctgggaagctgcagattcaaaggcctctatgtggtgaggctttaaggctgacgagctgctttcacaaaagggcctaacatccttgtttccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccagctgctttattcagcacgtgccttctgtgtgaatcagtttctcagtggtcagttcctaaataaggaaagagcttttatccaaaccagaaagagtgagccatggcccccaccagtaaacctgggaaagaataatgggctgcagaggaagcactcgctcgaggacagcacctggcctgaaaagctgtccctgagctgacgccttcctgtcagctataagcacataaagtatgtggctagaggccaggcgttgtggctcacgcttgtaatcccagcactttgggaggccaaggcaggtggatcacctgaggtcaggagttcaagaccagcctggacaacatggtgaaaccccctctctactaaaaaagacaaaaattagccagacatggtggtgcacacttacaatcccagctactcgggaggctgaggcaggagaattgtttgaacccaggaagcggaggttgcagtgagccgagatcctgccattgtacgccagcctaggagacagagcgagactctacctccaaaaaaaaatttaagaagtatgtatctagaatcaaagtgtcaaccagaaaaagatgaacctgagcttcaaaactagatttaaaattctactagatgtgtctgctgtgtcacattcctgttttggctttggttttgttttgagacagggtctcactatgttgcccaggctggtctcaaactcctggcctcaagtgatcctcacgcctggaccttccaaggtgctggggttagaattacaggcgtgagccactatacccagcccattccttatttttattgcccaaattaagtggtcagagatctttggagtcatgaccagtgtgactgaggaattgttctagaatgtgcgggatagagatggaagcactggcctggggcttggagtcctcaggacctcctcctactcctgcccttgtaagtcactgagctggtttcctggcctgtaaaatgagcatgatgatggctctgcttatttcataagatttcaaaatttattttgtaaaaatagtttctatagggtgattgcagaaaatttagaaaatgcaaagaggcaaaaatgttttacctcacttatctcactacttcgaggtaatcacagcttctcacactccagacaattttactcatttaaggtatacaattcagtggttttcattctttttatggccacatactattctattgtatggagataacacattttattcttccattcagttgatgaatgtggattagttccacttttgtctcttgtgaatagcgttctgacaattcacatattttgtgaagatgtaggtttcacaaaatatgtgaaagattttgtgtagatgtagattttcccttcttatggacatgtatactaggagtggaattgaattgctgtgtcgtaggataattctgtgtaccctttcaagagtgtggtggggggtggtgtttaaataccgttttgtgaggagtagatgcagtgacactgaaggtggctgtaaagcattactttagaggaaggcattctaacagacaagccacgcttgcttgtattcaggtgcaaaatgtcaggtttggtgagaccacaggacacataagcgcacggtggcaacaaatggagcaacagattccatgattaaaatgtgcaatttctaaacacaggaaagagcccccaaagcctcacttcagtcccctagaaggttctaggcagaaacagtagggcagatcaaaggaatgagagcataggagccatgatcacccagcgaggggagtgagccctgttgccagcttggcctggctgtggcttctgagtaaacacgtgtgtttgttaactgttaagaacctggtaatgaatactccctggaagatgccatggaccctggcctctggccagtcccctcgcccttgagtcctcctaacatcttattgctctgattacttcccatggagaagccagccagcagggactcgggaaccatgtgtcccaaaacctg

SEQ ID NO: 16731 - DNA, 5046 bp, Human
cgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaagcttgggtcccttctactctttgccctttggggcctgggcgtgggggtagaaagagtgtgctgggtaagtgtggaccagggtggagggccagcttgggtgacacggtgacccctgcataggctttccctatcagccctccccgggggtgtccccactctgggagaggtgggaggatgagggcagaggcgtagcccccctgccccctctcaagctcagtggagcgtttcgcagccagaccagaaaggaggaggtaggaagccaccagacagggagcgggggcgggccgtctgtgggtatgcagggccaggcgccgccagcagtcctggcgcgtggggtgggccaggcagtccgcgggggcgagcgtaccttctggccctcccttctccatgtcccagctcccagatgacgccaacctggcccgactggttcctgctcccaactcccccgcgtcgttgctttgggaggggtccgccggccagggcggtcgatgcgcgcgtgctaggcgggaccccggggggactcctcccggggcgcaattgggccggggggcggggccggggcgcggacggggcaggagggcggggccgggaagcgcgggcggcgggcgcgcccctctcgctgcttccggcggcggcgggcggttccagcgcgcgcccggggcggcggcgcgcggcggggggtggttggggtgcgcgccggcccgagtggacgccgtcgcgaccgccatgcagctgacggtgaaggcgctgcagggccgcgagtgcagcctgcaggtagggtccccgggccgggccgccgggtccggcgcgctctctcgcccgctcctggcagggggaccggcagggccgagggcgggcacggggaggccgggccgagggccgggagccgggagagctgccctcgggggcggacgcgtgggcttcgccgtctgggggccgcgggctcaacccttgcctcccaccctccgcgcggccaggtgccagaggacgagctggtgtccacgctgaagcagctggtctccgagaagctgaacgtcccagtgcgccagcagcggctgctgttcaagggcaaggccctggcaggtacccagggagaggagacgcccggggagccccgcaggaagcgggaccggggtgcgcgggccgaggccagcagccgtgtgtcgggtcggggtgcgggcgccaagcgccacatgaccccaagggaggcggccgcatgcctcacagccggatgccgcagcgctccgctcccgcgcccgaggcggcctcgcgccccgggccacccccacggcggtggaggaggaggaacccatcgatctgtctttggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggtgagaagggtaaccctgggcatcctcttcaggcccagttgctcccagcccctacctctgttgcagtgtatgccccccccccactggcagcccctgaatcttcctgcccttctctccccaggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcgtcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagcgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatgggctgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatgggtgaaggctttgaagagcacacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaacaataaaggcaatttgtttaatcagttaacggaaatttcttggcttatgaaagtgaaaagtccagtggtattggcattggcagcaggtgagcaatttcacccagtgtcttctgcctccctctgcgttggtatctgctacatcccaggccaccacctccgaggatgaaaagatggctgcctgcagcttccacggaatccctccctcactgccagagcagcatcttctctgtgtaccacctctgctgtctcagatgcccccagcaaataaacactcttctcgttggtcagaactggattgtgcgtccaatcattttggctggggtagggggtaattctccgtcagggctggctccctggagctaggcatggggccacttccctggacacacatgggctatgcaagggacagaaggctctgggggagggctggatgaatggatatcctcaatggtggccgcaaatggcagct

SEQ ID NO: 16732 - DNA, 33230 bp, Human
ggattacaggtgtgagtcaccgtgccaggccaaagctcacttctttttttttttcgagacggagtctcgctctgtcacccatgctggagtgcagtagagggatctcagctcactgcaacctccgactcccgggttcaagtgattctcctgcctcagcctcccgagtagctgggataacaggtgggcaccaccacgcccagctagttcttttgtattttttgtagagacagggtttcaccatgttggccaggatggtctcgatctcctgaccttgtcatccgcccgcctcggtctcccaaagtgctgggattacaggtgtgagtcaccgtgcccagcctttaaaaaactttttattttattatttgtttttgaaacggagtcttgctctgtcgccagactggagtgcagtggcgcaatctcagctcactgcaacctcaaaactcactccttactgacttctagcatactgtacatatctcacctattttcttgggcagggatttttgtctgttttgttcactactgtacctcgtggcttagaatagggcttggaacacagtagcttctcatagataattgttgaatacataaagtaaataaaatgtgcagtcaaaactatcaggcctgcaggcatggtggctcacatctgtaatcccagcaccttgggaggccgaggcgtgaggatcgcttgagcccaggagttcgagaccagcatgggcaacaaagctagacccccgtctctacaaaaaagcaaaacaaagcaaaaaaacccatgctatctgcaagctatgtggaataatatgaacgagaatatatcagcgtgacctcagtaggtatgtatgtcttaggaggggagagaagggctggacaaccaagccctagacgcagcccagttagatgtggagtaggctcctggtagctgaactcaatctttagcactccaccctggagaggaagaaggggttctccagggtcagccagcagacagctgcatcctttctggaaatcaaccactgtggccagccggtatttgtcgttcgtccatgttttcacctattcaggcccaagagcctcaaggtggggtggggggtttaatggaagctcgtagggggtggaggtgacagtccccagggtctggccccttaattcggccatcccgcgggcaggcaccacactgagagtctggatctacaatggacgcgcctcctgtccttcccccaccacgacctgctacgtgatctcggaaacagggtctaggactgaggcccctgccccctcctctcgtaatttcccggagaatatggggcggggcggtgaatcagcactcgcagggactgatgcagccctgatccccgccaggggtccccagcggcctcgggattcgaagcacccccccccgtcctcctgcgcctgcgcgctatgtccgctgggagttgtagtcttgaccgcccctttgtccttggtctcctcagcgcctcagtgcactgcaggttacactacaactcccaggggcccatgcgtccgagggctggcggggcgggaggctcaagggggaggcgtaagggggcgactggagaagctggggtgagggaactggggagtgaagtgaaaaaaggggagagtgggggcgcagtgggaaaggacggggtgcccggaagacgcgcagtgagcccagctggggagcggggagttctagccgcggccgggctcgggcggggcatgggcggggcttgcggacgggtgggcggggcctgccttcgtcatgcggcgtgggcggggccgcagggggttgtccgtcagtggcacgcacagcagccgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgagtgtctcctcccctcccccgccgctccctgcccctccgaagacgcggtccttggcgtggaaggcccggggcttcgtcgccctgtcgcgatggcgggttgaccgccccgtctcgctcactgaggggggctggggagggtcccgagaggcgacgggaacccgggctgtgacgcggcctcttttcggagtccccgtggccccgcggcgctgccattcaggcccggcgcgggcgcgggccggggcgaggtcccgcggggctggacttgggagcggggtctccggcccccgcggctctaggggtgcaggggacccgagcggggaggcgtgcgcatcctttgtgccccacttcccccctcctcctagcctgggcgtgggggcgggggaccgcatggatgcggttcctctttctctccctggtgtctgggcggcgcctttcccattcactcagcaggtctcccggttttccacctccccagcccccccagaatcttccccactgtctgtcccgacacatccctgagaatcttcccagaaacattgtatagggtctcttgaaaacctgagctccgtggtgcaaaatcgaaaccaccttgctcacgtttttcttaacaaaaggctcttctttctccattcgcccaaagcaagtcctccggcttttaggaagggagaacgtttgtctcgctagcgttttcattgatcattctcaacatgtcatctccattttattccctaatgtttttgtattgaaaagggtaggtattgcctgtaaaattaaaaggtggtgaatgtagctgactggttcgattcgtgtgacatatgccgtttcttttttgaatacaggcacgcgtctgttgaaattcctataagttgggggaaaaaatattctgtctgatctgatagtgcaaacaaagccgtggtgagaggcagtatcaagtcattccagaagattctgcatttgtcatattgcagagagcctagactgggtggaggctgggaggagttattttaaaggggaaaaagtctttttaaaaatttttggttgttagatgcatctgaggcttttttttgtttaagcgagtacatcttcatgctgatgaaaagagaataccgatcgccagttgtcgcattttgtctgggttgcagattcatccctgtattgcaccattttgtcagtaacaccacatttatctaatgggctgtcaaccagtttgatattagaggagggggaagtattgagcattatgaaatgaaaggtagaaaattaatctaatgatttcgggcccccactatcttaatatttaatttcctgccttatgtaacaaagattttcaaattcatctccattgtgaagtggatgctggagtgtaccttgcgtgttacatcttttaaatgaagcattattgatattacagatcaattcttgaataaatttactggttctcaaaagaggacaatgctgatacctttatatttaaagcagctatgttaacaaagaaaggtttttgtcttattgaagagaactgattctgaaattcggaatactgctgtggccacagttgctgtcttacaaggttttaatgcttaaatgatgtaagttgcacttctaataggtatcagtattggaaatatcttcagttcgtgttatttagactcttataatttttccatatttcttttccatatttctagttccacaggaaagcgagtgacctcgcacctatatccatagcaaccaagtgatgtcacacacaatgacacagaggctgcaatgcacctaagggctggtagggagtgtgcaaatggcatttatccaaggtaatgcagaaattagccgataagccaggtggaatcgagcacttcatattccactagatgagaattagtccaaaaaataaggatatcatttacccttagacatgcaaatctgtgacctctagctaggccttgttcaccctattgctagctttctcacaaaagtttataagatgcttttttatatttttaaacattcatctcatttatttaaaatactgggcaatgatggaataaaagtagaaattttaaacgataatttatggaataaaagaaattttaaacaagaatatagtttatgacactagtgcacagatgggatgtatacttgtgtttattgcagataattaatttggcaggttttaataaaaaccttaaaaaaatgatgacttcctactgagtcattttcagttactagtagggaatgaaaacccgttccaaaaccttttaagttgagatttgggaagtttgttttttactagatttgtgcttctgctccttcacagtatagaggaaagaacagtttgtaaaataaaaaccttttttcaaatctgtttcctgtgactttaaggaaataggctctgtccctcattttcctcatctgtaaaatgggacaatacttgaaaaagttgtgcggattcaataagaaatgtagtaggtgttccaaaatggcaactacctaagaaattttcttcctgtttataaaagtcatcgtggagaatttggaaactgcagagaaagaaaccaatcttaccactcaagtgagctctcttttaaggccgaaatcatcctgttgataaagggattaaaatttatttgagtttaatgaaattatcctagtgctaacactattgggatctgtgcagaatgatagttctttgtgggtaaccaggacagaagtactgtattgtgcagtattttgaaaagaaggaaagaggaatgttaggtcttttaagacagatgtttagtcttgtattgaaggagagtgaacacctagatgtatcctacgtattagacaatactgtcttgtcctttgacttttactagtctcttgagaagttaatattttaaataggctactggtacttgccttggggagaaaaggttcagggttactaattttgttgaagttactgagttaagcagtttaactcaatgaggggtgggagggcaaaggtggcaaaaggctatcataatttttctaaatattcctagtgggatcaatagactttcaaattctttctatcttaaatattccattccccctcccccccaggctcttccaggagatcaatagctattatcactaatggagtaatggtacctctgtagactcttcagaggtggagttctgccaaccattattctaagtcatgtggcttgaattgttctcttcttgggcgtggaaagaatacagatcatacagcttgcctttcatgtgttagccttcccagtaactgaagcagatattaagtgctttttctgattattttggaaatctatgtgttttttgaattctactgagattcaacatggcgctaaatgttcatcctcattgcagtcctggattaactgcaaacctaagagtaggatttcatctcttgtactcagggaagccttatttattaagccaatctttaaattattgaaaagagtggagaaaacgatgtgtttttatcgaggtaaaagttgcgtaacataactgtcacatagtcacatcagatttcaagtgcaattgagtggcattgggtacattccgtgttgtgcagccatcacctatgttgaagaagagagaaagtggttatttttaaaaagtgatgccggtctggactacagctggctggaattcagcacctattcaggaatgtgtcgataatggagtgcccacaacagctcacagccagcgataattgtctatccctttgtcttcatttccaagcgtctgaactgaaaaaagggaattagctttagctacgtttgtactgtatttccacttaaaaagttatggaacttgaacactgtataatgttcacccaaataaataagaacaatttacttgaaatctgagcaaatcgttaactctttggggattatggaaattttgctggtgttctagtgactcgttttcagccctaaggctggctttattatcagtgatttgccgcctgtgtggtagtggtttcctaatgagtaggatgcagggttgagactggggagctcctgcagcatgaggctcttaactgatgggacgccagcacaagacattcagtacattgtggctgtcaggagctggatgggaaaagtagttacttttcccttctttgcccattcccaatatcagcagtcctaaccttattttattttattgtattttattttaatttttttgagacggagtcttgctctgtcacccaggctggagtgcagtgggcagtggtgtggtatctcggctcaccgcaacctctgcctcccaggttcaagtgattctcctgcctcagcctcccaagtagctgggattacaggcacccaccaccacgcccagtgaatttttgtagttttgatagagacagggtttcaccatgttggccaggctgagctcgaactcctgacttcaggtgatctgcccacctcagcctcccaaagtgctgggattacaggcgtgagccaccgtgcccagcctcaaggaccactttctatgctcggtagtcaaagggaaatactacttttaaatgatataaaacgttatcttctctttgccttcttttgaaagttacttagtgttttaccagatattccagtctataattatgtgtgcgtttgattgcttgtttttttttttttttttttttgaggcaaggtctcactctgtcacccaggctggagcatggctcactgcagcctccacctcacaggctaaagcgaccctccagccccagccacccaagtagttgggactacaggagcatgctaccacacctggctatttttttgtaccgttttttgtaggaacggggtgttgccatgttgtccaggctggtcttgagctcctggactcaagcagtctgcccatcttggcctcccaaagtactgggattacaggtgtgagccaccacacccagcccggtctataattataatgcagctaaatgttgcctttctacaaaggctaccaataccagctgccttatggcctctcctctcagaattatttttctgtatcttccccaaattccattttaggtgtcagctatcattttgattaactaccaaaacatattattttacttaaaattgtcatttgtagaaatcttgaaaattttgatattttgctaaatgaatttatgaatttgagtggtagaaaattagttacacgaaaactgatttaaaaaattccctgggtcaggcacggtggctcacgcctgtaatcccagcactttgggaggctgaggcaggtggaccatgaggtcaggagttggagaccagcctgaccaacatggtgaaacttgtctctactaaaaatacaaaaaattagctgggcatggtggcatgcacctgtaatcctagctacttgggaggctgaggccggagaattacttgaacctgggaggtggaggttgcagggagttgagattgcaccactgcactccagcctgggtgacagagcaagactccatcttgaaaaaaagaaaaaaaattcccaaaagaaagctttaattttaaggtaaatagttataaataattggtttgctaccatgattttgtagaaaaaataaaaattgtaaatcttaaaagaccatgtgcatgagtcttttctttctgtttaaagaactggtgaagtcttagttaaattgctcccagcatttcacttgttaagtgtgtgtcctacagaaatagacttttctttacctgagttgaatactactaatatgtgctgcatggcattaagttttggttatgggccggatgtagtggctcacgcctgtaatcccagcactttgggaggtcgaggtgggttgatcacttgaggtcaggagttcaagaccagcctgctcaacatggtgaaatcccatctgtactaaaaataacaaaaattagctgggcatggtggcgcatgcctgtaatcccagctactagagaggctgaggtaggagaatcacttgaacccaagaggcagaggttgcagtgagctgaggtcataccactgcactccagcctgggtgacagtgtgagactctgtctctaaaaaaaaaaaaaagttttggttgtgaataggaaagagagtgttcttacataatttagatttttaacataacattaaaacaataaaattattccaaataaactcttgggcttcttaacctttggaagggtacctgtctttggagagagaaagcccattttggtgagtgggacccaggtacccagctttcctctgagcaggggtgtccgagttgggagtatgacagtgacagcagtggccagctgaacacgtaatgacagtagctgaagaggagtcactgatccacccccaacctgccgcaagctgagtatgaagagcagctgccgtgggcagggaagtgaggaatggctaagggagcgaggggaaggctttaaaaagccaggtttcttttgaagccgtagagatgatttacatttcttgagctgtctgaaaggaattactcatatgactctaaagctaccatatttaaaaaacccagatctgggaaacaaaatgcctatggtgctagttctttaagaatgtagaaatcagcttgaatttttgactgtttctatacagactgcttttgtagcaatctaacatgaagcagtgagcatgtctttgcagtggaggtgcagcatagtgagtagccatgcggataaccccatactcattggcagtatgttataatgtgagggcccgcctggcctgggtaggctaaagagcagtggtccccaacctttttggcaccagggacccgtttcatggaagacagtttttccatggactgggtggggtgaggggtaaggggatggtttggggatgaatcaagcacattgcatttattgtgcactttattattgctacattgtagtatgtaatgtaataattatacaactcaccgtaatgtaggatcagtgggagccctgagcttgttctacaattagatggtcccgtctgggggtgatgggagacagtgacagatcatcaggcattagattctcataaggaccatgcagcctacatcccttttgtgtgcagttcacagtagagttggcactcctttgagaatctaatgccaccgctgatctgacaggaggcggagctcaggtggtaattcgagcagtggggagtgacagacttcctgctctgcagccaggttcgtgacaggccatggacccgttggggacccctactatagagaatagatgttattattttcaaaccttcacattgggtcttgtatctgtgtaatagaggttaagactggaagttatttttcctactaggttgaaaagaccctactcagaaaggcgagaagaatgaacaggagaggagaatacgaacaacagaaaagggcattccaaggcgaggaaagctagtggggacaagggagtagggaaggaatattctagaatatcttggatcttggaatgccatgcctatttaagggagtctgtagtctttggaaggctgtgaacaatgggattgactactgaagacaaaaatgttggtggcctttcaggatgctagaaatttcggggggaaatgacaagaagaatcaccataatgattcacatgcagggatatttccatcgtgtctttttctacagtttatattcttttgcaccttgcttttttcacttgacatcatttcaatgatattctgtcattattttcagtagctgaataatcctgtggatatatcataatttaattatttttttgcttagtattcaggctgtttccaaatttacattgtaaataatattgatgtgtgggtatagatggtccctgatttcagatggtttaacttaacgatttttcttttctcttttcttttttttgagacagtcttgctctattgctcagggtggagtgcagtggcgcgatctcagcttactaccacctctgcctcctgagttccagcgattctcctgcctcagcttcccaagtagctgggattacaggcatgtaccaccacgcccggctaatttttgtatttttagtagaaatggggtttccccatgttggccaggctggtctccaactcctggcctcaggtgatgtgcccgccttggcctctggaagtgctggggttacaggcatgagccactgcgcctgaccttaacctgacaatttttcaactttatgatggtgcaaaagcagtaggcattcagtaagctcctccacttaggatggtcatgtccccataaatgagttgtacatggaggagtatctggtatctttcaggcacaattcgtacgttaagacagacccaagaggggaattgctggaaaaccagctaagaataatgtttaaggtcctcactagtacaggaccttgaaagttttgaaagatgtgtttgaataggtattatgtatacatgtttcagaattcaaaaggcacccattgccctttgtcctctaggaaggaaaatgaggttgaagcaggggtaggctcgatgccagcttatttgaggcaagggcccatctcccttatgcttctttggagtgattgccttttttttccctttgactaatggaaactttcaaacatacaaaataaagacaaatagtacagtaacccccgtacacccagcttcaccatttttcagcacatcggtcttttatctgtattttcttactcttctggcctcctcggggattatttaccaatttggaagatggctttttggagacagtcttgctctgttgcccaggctggggtacagtggtgcaatctcaactcactgcaacctccccctcctggattcaagcaattctcctacctcagcctccccagtagctgggattacaggtgcccaccaccacgcctggctaatttttgcatttttaatagagaccaggtttcaccatgttagccaggctgatctcgaactcctgacctcaagtgatccacctgcaggcatgtttttgtttttcatcgtttgctggccatgtagaaaaagacttcagatgtttggaacttgatctatttattgaggaagggcaaacaatatggcacaacttcaaacaaagctatcattaacagattaaatttttacaacttacatagaatgtatttctaccaacattatttggagctgtggcatgtagattctcaaaaacacttgctgagtgaattacaactacctgttactttcattttttggtaccctgttgcattttgatcttggttttctcttttcatcatctggctgtgtgtgtgtgtgtgtgtgtgtctgtgtgtgtgtgtgtgtgtgtgtgtattaataaatgatgaccaaaacgcgtctggaccgcaatggaaaacttaacggtactttttggtatttttttttttttttttgagacagagtctgctctgtcgcccaggctggagtgcagtggcgcgatctcagctcactgcaagctctgcctcccagattcacgccattctgcctcagcctcccgagtagctgggactacaggcgcccaccaccacgcccggctaactttttgtatttttagtagagatgaggtttcaccgtgttagccaggatggtctcaatcttctgacctcgtgatccacctacctcggcctcccaaagtgctgggattacaggcatgagccaccacacccggccgggaagacgagattttttaaattacacacttagatgaaatattgtaatatagtttgacgtttactgtcaccttgggaagcatttttatgtacttttcccatttaatttcacaacagttttataaagtgataatcttctgattttaaaggtggaaatgtttaatttgccttaaaattttttttttcaaagtctaaggctcatggtttgtaatcccagcactttgggaggctggctgactcacgcctgtattcccagcactctgggaggtggaggcgggcgggtcacctgaggtcaggagtttgagaccagcctggccaacatggtgaagccctgtctctacagaaaatacaaaaattaggccgggcgcggtggctcacacctgtaatcccagcactttgggaggctgaggtgggtgcatcacgaggttaggagatcaagaccatcctggcaaacacggtgaaaccccgtctctactaaaaatacaaaaaaattagtcgggcgtggtggcggtcacctgtagccccagctactcgggaggctgaggcaggagaatggcgtgaacccggggtggcgcagcttgcactgcactccagcctgggcaacagagtgagactgtctcaaaaaaaaaaaaaaaaaaaattagcgggcatggtggcgtgcgcctatagtcccagctgcttggaggctgaggcatgagaatcactagaaccagggagacaggctacagtgagctgagattgtgccactgcactctagcctgggcgacacgctatctccaaaaaaaaaaaaaaaaaacgaagtctaaggctcttgttttaagtttttgttttttctagaaaaggggtcatgggtaaagtggataccagctgttgtttcaattgatctctttcaattaattttagcatatgttccattgcttgcagatgcatggaaaatccttttaaactgctgcatatttaataatttttccattggttaaccttgaggtggtggcgtgtcatctaggtttaaatacagaagaactcatttcctttaggacagttgaaagatgtattactcaatacaagtgtaacccggtttcttttagaaaacattcgatcccacgattgcagtgtgttttttgaatgtcatttaacaaaggagagcttgagatttttaacatgaggtaagtgctgtagttttgctgtttggagtcttagagatattgccaggaggcatgagggtaccactcagaaccgaatggaagcagatacctcactcaaaagaaacagatctgggaggaagagaaaaccttttgtatagcaagtaaaaaccagaataatatagttttatgtggaatttgcaaactggagtttggagcatgttttgaggatttgggtgaagatcaaaggaagaaaagagatgctagttatttatattgtatataagatattttcgtagacatttgagtgttttttttgtttgtttgtttgctgacactgattttccctcttatttcccaggctggagttcaatggcacgatctcagctcactgcaacctccacctcccaggttcaagcgattctcctgctgcagcctcccaagtagcacatgccaccatgcccagctaatttttttgtatttttagtagagacagggttgcaccatgttggtcaggctggtgttgaactcctgacctcaggtgaaccacctgccttggcctcccaaagtgctaggattacaggcatgagccactgtgcccggcagacatttgagtatttggatgtaagcatttgaatattttgtagacattttaggcaggtgaaagaaataaatgcactgatctaaaatcctaggaaagatacggttgtgatgggagtcctgttgaacatctgtggggatcttgattccacaaaagaaattgaagtaagcctagggtgctgtgctactggagacggacgcttagttgacactggtcgtcagggagggtttcctagaggaagtgatgcctgcgcagtgtctttgggaaacttgagggagggggagaggttggaggaaggaatagccaggcagagggcataggacgcttagtttcaggatggaaaaggagaactggtggcgtgatttgtttagtccttgttggtggcattcagggaatgctgtggtggtgcgctttttgagggagtagcaggaaatgagttgaaagaggttaacaggaaacagttcacgaagggccttctgaggtttgtttcttcttaagccatggtgagtctcttcaggctgaagaggaccataatctaatttttggtgtggcgagatcccaggcagcagtgtggaaactgagtaggacagtgaggcagagcaaggggaggctgaggagtagattgtcaggtctagtcttcagggacctggacaagaacggcaagggcaggttggagaggcagaaatgggtggccagagatagaagaagaaagaggaggagaaaatggtggaaaagatgaattctggtgttctgctgaatttgaggaaacacttaagtggaggcaaattaacttggctacaggtcaatttgaccgccattcgtaacagtgccctggcacagtgtaagcaaagaaacatttaggatccactaataaccaggctggcctaacagctgcagaatataatatcctcttccctggtagaactgacattcaagagggagccgctttgtatccatgtgtgttggaaccatgcagaacaaaggtcacccagaaaaaaatgtagcatctgtgtcacagtgtaaagcgctagggagtggttggcacttaagtagtgactggaacgaggaaggaaagaccaggaaagaaggctgacaaggggaggagagcctcaggaaagagcggtcatcagggttagatgcctctgtgagttcagacttaagatgaagaccaagagcactggatgcctggggtcggaagacagtgacgactgtgtagggctgtggggttgaggagggagtgaaacattgaagaaatggtaacaattgtagacttaattccagaaccttgattttgaaagaaccaggaagaggtgggattgaaatgcatcatttattttttattttatttatttacttacttatttttaaatttttttttgaggcggagtttcactctgtagcccaggctggagtgcactggtgcaatctcggctccctgcaacctccatctcccgggtcccggttcaagcaattctgctgcctcagcctacctagtagctgggattacaggctcgtgccaccatgcccagctaatttttgtatttttagtagagacgggtttcaccatgttggccaggccggttttgaagacctcatgatccggccacttcggcctcccaaagtgctgggattacaggcatgagccactgcgccaggcctcatttttttaaatcttaactttcactgtatgttaatggggaagagtaggagagggacaatagaagaatgtaatagaatgaccagtgggaatccatggagggggaagaaacatcttttgttggcactcaacaaaggaggcagtgatcaatgcagctacttttggaagaaaggcttggccaggtacggtggctcacgcctgtaatcccagcactttgggaggccgaggcgggtggatcacgaggtcaggagattgagactatcctggctaacattgtgaaaccccgtctctactaaaaaatacaaaaaattagctgggcattgtggcgggtgcctgtagtcccagctgctcgggggactgagacaggagaatggtgtgaacccgggaggcagagcttgcagtgagccaagatcgtgccactgcactccaggcctgggcaacagagcgagactccgtctccaaaaaaaaaaaaaaaaagccttaggataggcttaactaatggtcacgttcctctatgaagaagaggtggcaggcaataacctaggattgccaggccgtttgtagtgacttcaacctctagttctctctctcagtgtccccctccctcacctaaatcttggctgcaagagtgggaggaggggcagggggttggattgatctgggtattttagggatggtgtagcagaaggacaagacagtgatatgcctgcagaaagaatggagttgctgggtctccatgaactttgcagggaaggactaaagcctgaagggaacgtgctaagagagaaaggacagtattcaagagtaagtcttataggtaagagtggggactgggaggttacaagagtttgactttaaaagtgaatgattctgcataaggtcaagagtgtggtttggggtaagttgtcccaattgatgagttcaactaatgtttataattcatttttgagaatagccttgggataatggaagtggtagaggtctggacacagataaataaccccatttaaagtgagcatgacattgattccaggagaaattgtagaagcaaagatcagacctgaaagagatgatcatgtaggagtcaatatgggtgtgtttaagaaccttttcaactaattttgatcgaactaattttggaatagggtttttgactgccagccatgggagtgctggaacatagtatatctggattttttcaaggcatttgatgaggtgtcttcctgatatggagttaggtgagctgtagaggcatgtcatgtgccctaattgttaaaaatgttttaacaagcctaattctgaggtgggctgatcacctgagctcaggagttcaagaccagcctggccaacatggtgaaaccctgtctgtactaaaaattcaaaaattagccagacgtggtggcatgcacctgtggtcccagatacttgggaggctgaggtgggagcatctcttggacctgggaggtggaggctgcagtgagccgatatcgcaccactgcattccagcctaggcaacagagcgagactctgtctcaaaaaaaaaaattcctaattgtttgcttaaagtcctgtaccctgatccccaggttcatctgttccattacacttggtgcaggtgttgcttaacagtaacacttgcagagaaagatagatctcgggctttgactgacatctcaataggaattgagtatgatttgcttttcgtaagtcagtttagtttggagctgtgaaatacggtattagtgtttgcttgtctcaaactaccccaaacaaatatttgttaattctcacaatttaacactggatgaactgcagtggcctcacccacagtctctcacctccaggttaacccaggcttcttcacgtggtggtggaaggtcccagcagcgagtcccagctcacaggcacttttcaagccttgcctatctcatacttgcttaggctccattagtcaaaaccaagtcacatgaccaagttcagattatggaggtagagagataacccatctcttgatgagagtggctggattcatattggaaaggaggtgggtggaaggaatgacagaatcaggaggaattactaggaccctttttgaaaacaatctcagatgggtacatcatgtggagattgatgtcattcagcacactttcagaagtgactgttgagttaaggtaccaccatgattcatgggtgatgctgattcatatggccaagcccagattctaggggtggagtatgagcgttatattaatgtgaagaagcagagagaggtgtgatgggaagagtctgagtctggtggctggggtatcgagaactcacagcagggttcttctgcttccacaatatgtgcattcggagcagatgatcctttgctaatgtggaggccatcctgtgcattgtagggtgttcagcagcatccctggcctccacccagtagataccttaataaagctgatttttaaaaacggctgcagtacaccatagtttacaacagcttttacacataacaacctaattttttttcttgagatggagtcttgctctgtcacccaggctggagtgcaatggtgcaatcttggctcactgcaacctctgtctcctggtttcaagcgattctcctacctcaccctctcaagtagctgggattacaggcgcctgccaccacacccagctaatttttgtatttttagtagagacggggcttcatgatgttggctaggctggtctcgaattcctgacctcaggtgatcctcctgcctcggcctcccaaagtggtgggattacaggtgtgagccactgtgcccggctggttaattttttttaacagtttaattttttggtgggaaagtcctctctccccgccacttccaagtcagatctatgataaaactagtaattaattagaaatagtcactagtttgtttgatgagttcagaaagtagcccagcggaggttcgaagcctgatatactaaatagcaggctgaaaggtattgataagcaggagcgcatttaggggaagattgggacagggatggaaacagtgagtaaagttagagaagactctaggatatgagaaccagtctcgccagtttcaaaaatgcattctggcccccaagagagaaagatcttaaggccagcgaatggcagttgtagggaaataagcagccttgatatgaagaagtcaagtacttgttaacctctgaaggtggaattcaaccaagttctcacaggagtgtgcaacatagggtcagagaccgtccttcacccagcagggtttgtaagaaggaagggagtgctggtttggggaggaaggtgtggattatctgcatttcagagtgagttctcttagtgtgtttcttctttgactttttcctccgtattggtgggatcgaatgcttcataatgacagatacccatggcaggacatgtacatttcctgtcctttttcatctttcttttatgatagctgtgcataaatctaaacaagccctttcgttcacctttttggagaggatattgagaaatataacctgcactacattactagatgttggtaggaggtcacaagaggaggattaaatgtaagagccagaggtctgtgctccattacagtgagttttctgtgtgtaagtccatgtattaagaagcatcaagtatttcgaattttatatttcaaacaagtgagctgatgatgtttgattgctggtgtgtgtgagagtgctatataaactgtcgtatagtgcagcaatttttcagtagctttgttgagatatagtttacataccatgcgattcacccatttaaagtgtgcaatttaatggttttcagtatgttcagacttgcataaccatcaccacattctagaacatgccatcaacccaaaaagaaaccccatattggcagtcattccccatcacctcccctcccaacccagccctaagtaaccactaatctgctttctatttctatggatttgcctattctggacatattatgtaactggaatcaaacaatatgcggtcttttggactggctgcttccatttagcaaaatgttttcgagatcatcggtgtagcatgttatcagtgcatcatttgtctgtctaaataatattccattacatagatcacactacgttttgttcagccgttcctcatttgatgtacatttgcattgtttccaccttttggctcttaggactaacgttgctgtgaacattacaagatttctcttttttttttttttttttttttttttgaggcaagagtcttgtcctgtcacccaggctggagtgcagtggcgccacctcagctcactacagcctccgcctcctgggttcaagtgattctcgtgtctcagcctcctgagtagctgggattacaggtgcgagccaccatgcccggctcatttttgtatttttagttatttttagttagagatggggtttcaccatgttgcccaggctggtctcaaactcctgacctcaagtgatctgccagcttcagcctcctaaagtgctgggattacaggcatgagccaaccctcccagcccctgtacaagattctgtatgggccaggtgcggtggcttcccctgcactttagggggctggggaggggcgggaggatcactttggtggcacatgcctgtagtcccagctacttgggaggctaggctcaggcagaaggattgcttgagcccgaggctgcagtgggccctgatcatactactgcactccagcctgggtgacagagtgagatcctgtctcaaaaaaaagaattttgtatggacttatgtttttatttctcttgtgtatatctgggagtggaattgctgagtcataatgctgctaacaaaacattttgagaaactgctacaattcttaacctagagaaatagatatgcatggttcccatctgaactggcaaggggtagggctgcttgaggagagattattataaaaagcctccctccttggttaagaactactggtatagtggaaagcatgtgggatttggagccagtgtatttgagttctgttcttcagcgctgagccttaattttctttaaattaggaataatgatacttaatcataaatgattgtccggagggcgaggagttagaattttgttgaaaaatccatttctgatcacaaaagtttattagaaaaatatggactaaatggatactttcttaacatgatagagaaaaatacaattaaaccaagagctgacatttaagaatgaaaccactggaaatagttccattgaattcaaaacaaaacaaaaaaatgctcataagcattattggcattggccttgtccaggtagtatatgattcaagtataggaaattgtaactatgggaaaggacaggtgatatttggaaaccataggttatatttgtagagaataaactggaaaaatactagaattgattgttagtgaaacggggctgatccatacagttgccccttgcacaatgtgtgagttaggggcacaatcaaatcccatgtgtaacctttttgtttgttttttgtttgtgtgtgtatgtgtgtgttttgttttgttttctgagatggagtctcgctgtgtcgcccaggcaggagtgcaatggcatgatcttggctcactgcaatgtccgcctcccaggttcaagcaattctcctgtctcagcctcccgagtagctgggattacaggtgtgtgccaccacacctggctaattttttgtattttagtagagacggggtttcaccgtgttggccagcctggtctcgaactcctgagctcaggcaattcacccgccttggccttccagagtgctgggattacaggtgtgagccgccgcacttggcagaaaatattattaagaaaagcataagagaaactgtatttactcttcattaagtggaagtgggtcattgtaaaagtcttcatccttacggtcttcgtgttgaataggctgagcaggaggataaagaggattgggcttgctgtctcaggagtggcagaggtggaggaaaattcacatttaagtggatttgtgcagttcaaacctgtgttgtccaagggtcaacagtatagaatgtattctgtatgttattactaaccgtataaaggtatcctttgttcttcattgtatctttatcatttttatacattattattactattatttttatatgtattttttgagatgtaatcttgctctgttgcccaggctagagggcagtggtgtgatcttggctcactgcaacctctgcctcccgggttcaagcagttctcctgtctccgcctcccgagtagctgggattacaggtgtgcgtcaccatgcccagctaatttttgtatttttagtagagatggggtttcaccatattggccagtctagtcttgaactcctgacctcaggtgatccgcccaccttggcctcccaaagtgctgggattacaggcgtgagccaccgcgcccagcctattaccattatttttatacaactaagttaaaacacacagaaagcaaagaagtgtggtttgagtttgttgtatacatccataaactgtttatataaaattactggctttgggcttttctgaaaacttggctttcaagattggctttaagcttcaattgtaggtatgaataacagggtaaattgtggagagggtttgttggaataagtactactagtcatcggtacaaaattcaacctaatcaaccttgactgcttcccagccagtctggttttgagacccttctagaaatgtcgtgtgaatgcacaggtgatttttagtgccaactagaattctgtcatatgcacatgaccagtggatacgtgcctgttacccacaccgtcaccttcacaatgaagccttggcattgtgatcagagaacaattcacagaatgaatgaggttgagcatttttcctattgttttccttttctccgttccttttttccatttttctgttactgagattttctgtttctaagattgatcttagaaattctctggaggttttcatgtattagagaaattagctggttctctgtggtgttgcagaagttacatcatcagagactcttagcatagaaaaagagcacaagatttgcagcctgagggctggagttttttctgctctgtggagtgttaatgaggtgactctggggaaaagtcatgttatttctctgagtcacacctgtaaagcgagtgtaatacccaccttgtggagtgggacttggcgctgtcagccaaacccaggccctcacccagctctcctctcatctgtgagaccttggcttggccttgggtagaaatttcacgactctgaggctgttcctcttcctcgaatgaatgtttccctctgcacaatttttagccagggtgatcgctgctggaaaaacccaactaaagttgttagttcctaattaaaattttctccaagtttccatgcagtttgctatgttaagaatacctctgtgactgatactccaatgtgaataagttgtattttctccgtgtagactgagtaccttgagtacatcccactagtgttttgtgtcttcacgttgtgatacaatgtgatgtatatactagatggtccatggatgcttgatgaattaattatttgataagtagtggccattaatcatcttttccctggtcaccggacttataaaacatgtatcaagttttctggaatgaatgtgtgttgagagtccccaagactgcctccaggcttggtgatgtactgggactcagcaaatacttgtactcatggctgcagttttttactgggaagtatgcaaagctcaatcagcaaatggggtcgggcacagtggctcatgccggtaatcccagcactttgggaggctgaggcgggcggatcacttgagctcaggagttcaagaccagcctggccaaacatggtgaaaccccgtctctactaaaaatagaaagtttagctgggtgtggtggtgggcgcctgtagacccagctactcgggaggctgaggcaggagaatcacttgaacctaggaggcagaggccacagtgagccgagatcacaccactgcactccagcctgggtggcagagggagactacatctcaaaaaaaaaaaaaaaaattagcaaagggaagaggcgcaggagatgaaaatcagaggaagccaggcgcaagctttcaagagtcctctcccagggaaatcacacgggatacgcatcattattccaagctgtgacaatatgtgagaaatgctgtctaccaggggtcttgttagagagcagctgggggctggtcacttaagtaccctctgcctgcctagcacatgtccaaatccagattcccagaaggaaaacaggtttaatataaaccagatcgtttgtaccaacagattggcaacagtgagccatctttatcagggaatggtgggaaccctccctaaatccaagttctcagatgccagccagagaccagccttgtaagcaggcctttcgaaagacagcagactgaagcctattatgttaactcttctgcacagaagggagttcatgtttgaggcgtgttatttcagatacataaggttattttcagtgtttagttgattacttagtaaacataggttgtctttcgaacgagttgtgatgaaggagaaccgtgtcccatccgtttgcagtggtttatccactgtctgcatggtgtatccttaacatggacagcagcgcacatcctgcacttggtcatctcattctttctgtttctatttagcactcactgcatttctctttttcatggcccttggccctttcaggtgacaatattctcaaattctaggaggacagaaaatgtaagatggagccaagtctcatacctagcacttgctaggttgaaaaaaaaaaaaaaaaaagaccgggcaccgtggctcacgcctgtaatcccagcactttgggaggccgaggcgggtggatcacctgaggtcaggagttcgagaccagcctggccaacgtggtgaaaccctgtctctactaaaaatacaaaaatttagccaggcgtggtggtgggtgcctgtaatcccagctactttggaggctgaggcacgagaatcacttgaacccggaagtagagggtgcagtgagcctagatcgtgccatcacactccagcctgggtgacagagtgaaactctgtctcagaaaaaaaaaaaaaaaaaaaagccagactttcttagagcagttttggattcacagtaaaatttaatggagttcccatataccccctgccccacacaagcacagccttcttccctcagcagcccccaccagaggggtacacttaaactgcaattaatgaaacattatcacccaaggtccacagtttacagtagagctcactcttggtgatctacattctgtggagttggacaagtttatagaggcatgtagccaccacctgaatatcacacagtgtagtttcattgccctgaaagtcctgtgtgctctgcctgttcatctctcctggcttattttttggatgtaaacttcagttctttgtagagattttcagttttattaaatcaatgtgttgggtgaggtggtgcatgcctgtagttccaggttgaggcaggaggattgattgcttgagccccgaggagttatttaagaagattaaaaatgcaaagttgcattcataacttttttttggggggtgtggtgggggtgcggacagatcgctctgttgcccaggctggagtgcagtggctccatctcgtctcactgtaacctccacctctcaggttcaggtgattcccctgcctcagcctcctgagtagctgggattacaggcatgcacaccacacccagctcatttttgtatttttagtagagacagggtttcgccatgttggccaggctggtctcaaactactgacctcaagtgatccacccaccttggcctcccaaagtgctgggattacagaggtgagcggctgtgtctggtccctaccattacaatgtaaggttcttggtagataaggaaattgtgaatgacctggtactccatggcttaaggtcagaaagtcatctaagtagctttccaagaatttcaagagttgctaatcttaggtagaaaaggtttctctcctcatcaactcttaggggaaaatagttgacactaattaacatctgattccttagcagctgggatttggggagttctactttttaaactgttggtgagaataacatagatttttctaaccattttacctacagctatctttaacatcttttaagtcaccaaaagaaatttgaggccgggcgcggtggctcacgcctgtaatcccagcactttgggaggccgaggcgggcggatcacaaggtcaggagatcaagaccatcctggccaacatgatgaaaccccgtctctattaaaagtacaaaaattagctgggcgtagtggcacacgcctgtaatcccaggtactcgggaggctgaggcaggagaatcgcttgaacccaggaggcagaggttgcagtgagccgggattgtgccactgcactccagcctggtgacagagtgggactccatctcaaaaaaaataaataaaataaaaataagaaatttgaacttgagcttgtagtagtagagaaggcagaaactttgtttttaagcagaacatacaactctggggaataaaaactgaaactttctacattttccaacagccatgacagtaaattttggggaccatgtttacaagtgttgcattcgtagaaacaatttattaaccagggtgtgatgggaggctgaggtgggaggatcacctgagcctgagaagttgaggctgcagtgagctgtgatcacgccatttctctccagcctgggcaacagagtgagaccccatttcttttcttttctttctttctttctttttttttttaaagaagaagaaggttaggcagaatggctcatgtttgtaatcccagaactttaggaggccaaggctggaggatcacttgtgctcaggagttcgaaaccagcctggacaacatagggtgaccctggtccctacaaaaaatacaaaaattagggggcgtggtggtagatgcctgtagtcccagcttctctggaggctgaggcagaggagtttgtggcgtggctgcagtgagctgtgattgcaccactgtactccagccagggcaacagagtgagaccctgtctctgtttaaacaacaacaacaaatttaatgactgttttgaaaaatgttacctcccttcccaaatgatacaagatcccgtatcttcccacattgaatagtcattctgtcattctgtcttgattaaatcattttagacactattagaataacttgttcttttaagaggttatctgttgacctttaaaactaatatggtggggatctcttattttaatttaaaaataacagattcttatgcaagtaattatgatctaaaggataaaggatttttaaaaattttgatttaaggtgttcagaacaacttttctttagactttttagagctgaagggtttcccctctaacttagtttttcactggcagggaacatctgggcgtgttccaaatgtggtcgagctactgtatccaaaggtgatcctggcatttcataatctccttgttccaatgtgtctggggacagctaggcagactttacataagtacagattgcctctctgggcactgctgggagacttcatttgtggcaggaggagtgcccccaggactggtgagataatttgagctttaaatagctcctggcccttgaaataaggacaacatgatttaggggaaaggccagaacttgatctttgtggccttcggcacgctggcctctccttgcactggaggcagtcatgagggctgcaccgcggggcggtttgtcttcagcattcgcacactcagtaaagtatgccagagatgggtggcagcagcgcccaagggctcagctccttccaaagccaagtctgggcagttttttttcaggctgtatggaactagggtttatggaaaggaagcgatgtgaggcagctaaggcagtttccgcttaatatagagaagaggatgaaacggagaagagacactcgatacaggaagatgagctgggagatcgttaggaaatgtagacatcccctgtggtgagaactaaaatgaaggaaaattattcagggtattcttaaaagtagttcctcatgtttctgtagcattttactttttcaagaagactttgctgggcacaatggctgtcacctgtaatcccagcactctgagcggccaaggtgggaggatcacttgaactaagggttcaagaccagcctgggcaacatagtgagaccttgtctctactaaaaatttttaaatggctggatgcagtggctcacacctgtaatcctaacactttgggaggctaaggtgggtggatcacttgaggccaggagttcaaggccagcctgggcaacatggcaagaccttgtctctacagaaaaatacaaaaattagctgggtgtggtggcatgtgccttagtcccagccactcaggaggctaaggtaggattgcttgaagccctgggaggctgaggttgcagtgagccaagatagtgccactgcacttccagcggattgatatagtgagaccccatctctaaataaagaaataaataaatcagccatagactgaggcgggtggatcacttgaggccaggagtttgagaccatcctggccaacatggcaaaacgctgtctctactaaaaatacaaaaactagccaggcatggtggcacacgcctgtaatcccagctactcgggaggctgaggcaggagaatcgcttgaacttggggggaggttgcagtgagccgacatcatgccattgcactccagcctgggcaacagagtgagaccaggtctttttgaaactctgtctccaaaaaaaaaaaaaaaagaaatcagccatgcatggtggtgcacacctgtagtcccaggtactctggagattgaggtgggaggattgcttgagcccagtagtttgaggctgcagtgaggtgtgatcatgcctctgcacttcagcttgggaaacagagtaagaccatgtctcaaaaagaacaaaaaaagactttcttatttgtctgatatacctgtatattaccttatgaaagaagcagaaatccccattttgcagataagaaaaccaaagcccagagaaatgaagcggcttgtccccaagattgcttagcgaatgatggagctgggaaaagcccaatcttccgttatttgtggacacatcagaattcagcatgagtgacagcggtctgctggatgacagatcgtcagtgcagaatgagacacgaggtgcctgtgtttattcatgcaggaggagtgtttgcagaagtgccgggaacaagaggtggtggagcaaagcatctctttcctggtttccttctgctctgaactcaagtagtacccaccccctattcttcccctcttttgagtctgtttcactgagggcacggctggtaggagtaacgttgtccagcattaaaacagagcatcagtaatgtctaggaaaatgttaactttaacaacaccactaatcagtttagagaatatttgagcgtgtagcacttgctgatcattcattcagaaaatgaattgcctgccataaactaataagcatgatttggtttatgttttgatttaattatctctgagtagatgctgcttgaagtaatgactgtaatcacttttgccaagcataccccccgtttataatttaagaaaaaaaatttttttttttttgagatggggccttgttatgttggccaggctggtcttgaactcctggcctcaagcagtcctccccacctggtgtctcaaagcactgggattacaggcatgggccaacatactgaacataatgattcaaacatagaaaaaaaagtctcctggtagttcagttcccccatgccccaggagtttagtacaggggtgtccagtcttttggcttccctgggccacattcccttgggccacacataaaatacactaacactaacaatagttgatgagctaaaaaaaaaaaaaaaatcgcaaaaagaattctcagtgttttaatagagtttacgaatttgtgttgggctgcattcaaagccatcctgggctacatgcagcctgtgggccacaggttggataagcttggtttagtagatctttttggattctaggtccctacctgtcgtctctgtatgtaatataatgttatacagatgctgcagttgatcaacacggaacaatggggactcaagggacagggagtaaccacttttcttctctcctctcctctcctctccccatccccagccagttggcatgtgctggtagtcccagctcctcggtaggcagaggtgggagaatcatctgagcctggggaggttgaggctgcagtgatctgtgatcctgctgctgcactccaggctgggcaatagaatgagaccctgtgtcaaatataataataataataatgtatttcatatggttgtcaagtaatgtaatagtatatgactctgatactatagaaaccaggtaaataaatttagtattattggctgatattaataagcagttatttgtagtcataaaaatatacaacattggtttgagatgccactttagtcttctgaaagtgattagccttgggggtgatgagggcgggagccttgagaaatggccatcttgggagaagcattgattcctgttgcccagctagaggcgctgtgctcgcctcgttcttttgtattgctggttgtaaagttgtattcagtcagacactcccactgccacaaataacatgttccctgggttgctaaagtatcacagcgatcagactcaatcctatgccccttatttggactccctgaggtttagaattcacatggtgttggcatatgagcagaaaggcctccatgtttctcagaagtcagcttgaagttgactcagtattttcttatccagaagagatgggactgaagtttagtagacagggcaggattaggaggaatttgtcagtccgttttcctaaaaaaccactgagttagaccatctgtactcatagtctctcatctaaggcctagacttgacagtgttttgtggaacacacgtgataagcctgtgtccttttctggggaggaagccagggttcagacaccgttgatccattgatccagccgcacttttccctcccttgtgtgtgctccacctccagcccccttcccccagcccacacaaagtaatttccttctgttcatcatgttactcaacagagctctgttctagtgtctcaaagatacagttaacccagtggacaccatctgtaccataacaactctgttctttcctcctggcaggtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggggcagggtaggtggggctttccctaatttatcttcatgtccagtgagcagtgttgcgtttttccttgtag

SEQ ID NO: 16733 - DNA, 12880 bp, Human
tgcagtgagtcgagatagcaccactgcactccagcctgggcgacagaatgagatcctgtctcaaaagaaagaaagagagagagagagagagagaaagaaagaaagaaagaaagaaagaaagaaagaaagaaagaaagaaagaaagaaagaaaagaaattgacaggaggctaaacgagttttcctagacaaagcttcattggagcttatgcccagacataaaggaggcagcatgagagagagagggagagagagggaaagagagagggagagagagggaaagagagagagagagggaaagagagagagagagggaaagatatagagatttttctatctgactctccaaaaagagccaggagggcttttttattaggcaaagcatgggaatttacatcagggatagggcatgccggctgtgctgggcaaagcacgtgaaggtatgcaggttggcattatctggttgccatggttatcttgagttatgggccacctggtagtctggctggtggcaacaaggctgtcaatcagttcagcattccttcctgaggtgggacactccacaaccttggtttgatatttgaatctcctaaggtcagttcctgggattctcttaagtaataggcatgtttccacatgatgatgtcagtgaaatcgtggtatgggtctggtgatcactgggaatgcaggaaagaatgcagtggttgggccaggtgtggtggctcatgtctgtaatcccagcactttgggagactgaggtgggcggatcccttgtggtgaggagctgggcatggtggaacaagcctgtaatcccagttactcgggagagtaaggcagaagaattgcttgaacctgggaggcggaggctgcagtgagctgagattgcaccactacactccagcctgggcaacagagtgagattgtctcaaaaaaaaaaaagaatgccctggtcggggtgagctgaagccaagccccgcttctgctgtgtctcagtatgaactccgggggattcacccaggaatgaagaacgcagggccccttctccacctctcttcacacagctgcctctgcctgaactgacctaccccccggcctcccataaaataaggcagagacccatgaaattcctcctgtctcctaattgataccgcctcctttttctcacacttggaatgagctccttatgtctcagatctaatccccctgactcttcaatcaagggctttctcctgtgtcccccacagacctgggacagctcccttgccgggctgcgagcttcctaagggcagggccagcaggggatcggagggaagctgtgatacattgtggtgcaccaggcaggcagcacactctttgcaaacttttacatgaatacacatggggatttacaagctaaaaactttcaagtgggctggggcgggcgcggtggctcacacctgtcatcccagcactttgggaggctgaggcaggaggatcactggaggtcaggacttcaagaccagcctgcccaacatagtgaaaccctgtctctaccaaaaatacaaaaattagccaggcgcggtggcgcatgccttcctgtaatcccagctatttgggagtctgaggcaggagaatcacttgaacctggctgagaagtggaggatgcagtgaaacgagatcataccactgcactccagcctggacaacagagtgagactctgtctcaaaacaaaacaaaacacaacaaaaacaaacaaaccacaaacacacacacacacagcaaaaaaaaactttaatgtggatacacgtgggggatttccaagctaaaaaccaaattctgctgtggtcatgctggggtgaaggctgagagtttgcagttctaacaagctcccaggtgttactgatgcttctggatggagaccactttatgcaacaagggcccagctggctagggaagggaggcagcggagaagctgagagcccaggtggcagcagccagcatcccacgggtataagatggccagaggcggctgcctgctgctctgcaggtaccatggagctgagctataggctcttcatctgcctcctgctctggggtagtactgagctgtgctacccccaacccctctggctcttgcagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaagagaggctgggggccctggctttggtgggaggatgttcgaggcagccgggtatggggactgtggccaccatcggtgggaggtggggttgggtggatccctctcacttgtaggtggggaggtggcccagttgaggcctgaagctggcactgaggtcaccggacccagggcagctcctgcctctgatgcccgacattgggtcgatggggtggagccagaggtggccgtgcacttcaggctggcccaagccacgccactctctctcaggtgggtttgtgacacacacaggcctgcgtgataggatagccctgtgggtagcctaaggggctgtttctaaggctgggggcattaggaactcatcctgaagagacccaaagtatacattatcttaaaaacaacaagtgggccgggtgcagtggctcatgcctgtagtcccagcactatgggaggccaagactggaggatcacttgaggccaggagtttgaggccagcctgggcaacatagtgagaccccatctcttaagcctttaaaaaaactaactggggcctggtgtggtggctcacgcctgtaattccagcactttgggaggctgaggagtttgagaccagcctggccaacatggtgaaaccccatctctactaataatacaaaaattagccaggcatggtggtgcgtgtctgtaatcccagctactcaggaggctgaggcaggagaatcgcttgaacccaggaggcaaaggttgcagtgagctgagattgtgccactgcactccagcctaggcaacagagcgagactctggctcaaaaaaaaaaaaaaaattccacatagataagtggtatgggggcgggggcatcataaccttggtgttaaagaccttaaaagcatcagtgggtccctgggggcagctccaagggggagaggcttaacctgtggtacatgcaggaaaagaccaagaaatccaggccagacctccctttccctagccagtggggaaagaggctgcaaggagaggccttacggcagggcagggctgggcacacagctccccagctaaaccctgatccctggaccaagttcctgtggtcccatggagggcctgtcctctcccgcctcaggggaacctggctcctcctcacctgggcctagacccagtagcttgcctgggatgggggcaagtccagcccctggagccctccggccagagctctggtcttaactgtggtctcctgggctctctttgaggactcgaggcccttgttttcctggggagggaggccagagagctgcaggagttacttgaggaattattccagtttagaggctcacaaacatgtcttagatttacttggggagccaggtgcctggctccccccccttctgtgaaatgggctttaataggttagaagctgataagtggtatttttttgttgttgtttttgttttttgagacagttttgctcttattgcccaggctggagtgcaatggcgcctataatcccagcactttgggaggctgagatgggaggatcacttgggcccgggagtttaaggccaccctgggcaacataatgagacccccttctctaccaaacaccacacacacacacacacacacacacacacacacaatagggtgtggtggcgcctgcctttagtctcagctacttgggaggctgaagtgggaggattgcttaaacccatgatttggaggctgcagtgagctacgattgtgccactgcattccagcctggaaggcagagcaagaccctcttttattaaccccacctgtggagcttctaaaaatcctgatgtccaggctgctaaaatagaaaggatgtgggaccagctgtgggtaataaggatctcaggtgactccaatgaggagcaaagcctgcaaactccttcctctggtgtggtgtttcccagttttgcccggtgagaatcacctgcggctggccgtgcgcagtggctcacgcctgtaatcccagcactttgggaggccgaggcgggtgaatcacgaggtcaggagttcaagaccagcctggccacgatggtgaaacctcatctctactaaaaatacaaagaagttagccgggtgtggtggcgggcacctgtaatcccagctactcaggagtctgaggcagagaattgcttgaacccgggaggcgtaggttgcagtgagttgagatcgtgccactgcactccagcctgggcaacagagtgagactccgtctcaaaaaaaaaaaaaaaaaaatacagccatggccagtttcccaggtatacaacctgtgcagttctgtggggcccagtgcttaaatggaatgccctcttgccctgaaatggtaataacttttgaataaggggccccacgagctatgctggttctgtctgtgctggggcacttgctaataaggtctaggactattccctgaagatcgagtttggtcagggccaggcagccacctgagctcttgggcaacttcgacctcctaggctcaagccatcctcctgcctcagcctcctgaatagctgggatggactacaggcacatgccaccgtgcccagccaagttatgtttttgtagagatggggtctagctctattgcccaggctggtcgtgacttcctggcctcaagcaatcctcttccctcccaaagtgctgggattacaggcatgagccactgcacccagccctcaagtagtttttaaataagctccctgagatgagaggtggggatagtgagcttagaataggtggttgggggttgagtcatggtggctcacacctgtaatccagcactttgggaggctgaggcaggtggatcacctgaggccaggagttcgagaccagcctggctaacatggcgaaaccctgtctctatttaaaaaaaaaaaaaaaaggcacggtggcacgtgcctgtaattccagctactcagaggctgaagcagagaattgcttgaacctgggaggcggaggttgcagtgagccgagttcgtgccactgcactccagcctgggtgacagagcaagactgcatctcaaaaaaacaaaaggtggttaggaagtgactaaagtaggggtttccagtgctggctctatgctaatcacctggaaaggttgtaaaaatactgattctcaagagaatctcataccttcactctactggggtagggcctagcgtcacatttttctaatattctagcaaaatcttcgaacttaggtgtttgctataaaactctctcccaggcaggccctgccttctgcagccctattggacgatgcaaatttccccagtagtactcacctgtgctcttcctgcctcaggcaacctctgaatcagtctcccccaccttatgtgaaatgggcttgaataggttagaagctgatgtgggttgttgtgttttttgtttgtttttgtttttgagagttttgctcttgttgcccaggctagaatgcaatggcacgatctccgctcactgcaacctctgcctcccgggttcaagcgattcttctgcctcagtctcccgagtagctgggattacaggcacgtgccaccacactcagctaattttttttttttaagtagagatggggtttcaccatgttggtcaggctggtctcaaactcctgacctcagatgatctgccctcctcagcctcccaaagtgctgggattacgggcgtgagccacagcgcccagccagaagctgataagtgttaacagctgggcacttcctgactgcttcctggcggctatcttggccctgggcctctcctgaaagaggaaactgtatgtactggggggcatggagggggagtgtcagaagggatgtgtcatgtgccctgatgcctctattgcttgggtgttacatggtatctgccatgtggttgatccagtctgcctgtggtggtgtcaatatgtggtgtcaggtaaagattccgaggtacaaagacagtacctgtcctgcctctttcctgaccagtggcagagcctgtgttctcttttgtagagatggggtcttgctatgtttcccaggccagtctcaaactcctggcctcaagcaatccttggcctcccaaagtgctggggttacaggcatgagtcactgcacctggccttgaccctgtggtctttctgtccccttgtgggctgccctccctgagcactcatgtatggcttgggagtacccgggcaggtgatggccggcagcattaacttctcacctttcctccaggtaactgacgatgccctggtgtacagcaccttcctgctccatgacccccgccccgtgggaaacctgtccatcgtgaggactaaccgcgcagagattcccatcgagtgccgctaccccaggtcggtgtgggactgactcatggcccctggtgcaaaagccccttgggtgtggctgcaggcaagtgggctggctatgggctacagcttgcagcatggctattagaactacctaccgaagcatttgcagctgtggttactgtactgcgtgggattgtggggcctgctgagtctagttcgagccccagaagagtatcaggagcccaactgcagcttagcggaagcttcagagctgctcagccctggtggtggtactatgccagcctcggcccttagggttcagaaatggccttccaatagtgctaggctggggccaggtgcagtggctcatcctgtaatcctagcactttgggaggctgacaggtggatcgcttgaggtcaaggagttcaagaccagtctggcctacatggtgaaaccccatctctactaaaaacacagaaattagccgggtgtctataatcccagctacttgggaggctgaggcaggagaattgcttgaacccaggaggcagaggctgcagtgagccgagattgcactgctgtactccattctgggcaacaaagcgatactccatcgcaaaaaataataataaaatagtgctaggctgcgttctagaatctgacctgggcggtggtggcctactcttctgtggtcctcaagcccctggcatcaagcacgtgcctgtgaactcaggccctgaagtgggaggagaaactatggctcccaaggacaacactgggtcctgtgctggcctcagcatggggtgcaggggactttgtccctgcccttgaaccagtctgggagtgggtataagatgatgcggccaggtatggtggctcacgcctgtaataccagccctttgggaggccaaggtgggcagctcacgaggtaaggagttcaggaccagcctggccaacatggtgaaacccatctctactaaaaacacaaaaaaattagccgagtgtggtagcgcgtgcctgtaatctcagctactcaggaggctgaggcaggagaatcatttgaacccaggatgcagaggttgcagtgagctgagatggcaccattgcactccagcctgggcaacagagcaagactccatctcaaaaagaaaatgctagtgtgaagtgggtagggagctgataccagtcaggacatcatgagggatgagccatgcccctgggaggggtcatggtaggggttatcctagaacaggatcctggagtgggggaccttgaggctgagatggcctgggcagagccatgtggccacacacccaacgggagggcagtgtgcccttagtaggtgacatgcagcctgggggctggagcccagggactggggtaatgagggagccagacagatgggctcaccagcctcaccacaggtgcccctcctggaatgggtgaggactgaatctccacccagggtcacctggtggctggtgctgaagacaaatgggaactagtgagaaccagctgggaggctggaaaactgggattcaatgaggcctgacccatggttgcagggaccgtagaggctgactcgcaggagctaagagcaattggaggagcttggtgcctatgtgggtaggggagatggaggaggatagaggagtcaagggcaggctgcccagtcggcatgagggactgaagctgtcctgtgaccgtggaagtctgacttcagtctctgggcctgacccctgaggatggtggctcacctggtccattggctgtaggtagtattagagaggctggttgtaggctgggatgctttaacctggctccagatacctgagtctggttatcaatagatgcatccatcacttggagtagcttcttccagcagatcctatggggttagcagggtaggtatctgcagatacccagacctgcttccatggacttcccagtcactggtgtgggtccaggctctcggtagcatctcaagacctaagggcctgtctttgatctctaaaggatggccttggctgggcatggtggctcacgcctataatcccagcactttgggaggccgaggcgggcggatcatgaggtcaggagatggagaccatcctggctaacgtggtgaaaccccgtctctactaaaaatacaaaaaattagccaggcctagtggcgggtgcctgtagtcccagctatttgggaggctgaggcaggagaatggcgtgaacctgggtggtggagcttgcagtgagccgagatcgtgccactgtactccagcctgggagacaaagtgagactccgtctcaaaaaaaaaaaaagatggccttagctgattcccctctcaagcatcctgtggagtactgtgcagggcctgctatcagaccccaaacctgaacctctagggctaaagtatgtgtggtggcttttggttttttgtttaaaaaaaaaaagtcttactctgccgcccaggctggagtgcagtggggtgccatcatagttcactgcagccttgacctcctgggctcaagcaatcctcccatctcagcctcctgagtagctggtatgtactactatgcccagctatcttttcttttcttttctttttttttttgagatggagtcttgctctgttgcccaggctggagtgcagtggtgtgatctcagctcactgcaaactccacctccgaggttcacgccattctcctgcctcagcctcccaagtagctgggactaaaggcgcccgccaccatgcccggataattttatttttagtggagatggggtttcaccatgttagccaggatggtctcgatctcctgacctcatgatccgcccgcctcggcctctcaaactgctgggattataggcttgagccaccgtgcctggcctcttttcttttttatagagatagagtcttgctatgttgtccaggctgctctcaaactcctagcctcaggcaatcctccagtctccacctcccaaagtgctgggattacaggcatgagccaccgcactcaggtccagggctcaagagggagcagatctcagtctagaaaccaaactcctaggttcagctgtatctgtcttcagcggcccagatagcatcatagcatcagttaggatggctaggccactcacaggtgcagaagttcaggagggtgcaggggcagcctcaggctcaaggtgtctgttcagccatctcgcaccagctacctggctgggccatagctgaggaccctgtagtggggtagcagtgagatactccccatcagtgggggcccaggtgggtgtgacctgaggcaggtgtgcacagctgctgttcttctctcaggcagggcaatgtgagcagccaggccatcctgcccacctggttgcccttcaggaccacggtgttctcagaggagaagctgactttctctctgcgtctgatggagggtaagagaagaaggctgggtgggacatctgtggaaagacctgggccatctcagacccctgcccttggctgtgtcttttttttgtttgtttggttttggttttggttttggttggttttggttggttttggttggttttggttggtttttgagacagtcttgatctgacctccaggctggagtgcagtggcacgatctcagctcactgcagtctccacctcctggggttcaaacgattctcctgcctcagcctcccgagtaactgggactacaggcttctgacaccacacccagctaacttttctatttttagtagagatggggttttgccacgttggctaggctggtctcgaactcctgacctcaggtgatccacctgcctcagcctcccaaggtgctgggattacaggcatgagccaccatgcccagctgactgtgtctttcagagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatgggtgagcactgggctccctgcctagagaaccttcctagcaaaatgaccctaaagccacctgtttggctttttgagacagtgtcactctgtaacccaggctggaatacagaggcttgatctctgccctctgcaacctctgcctcccaggtttaagtgattctcctgcctcagccccccaagtagctgagattacaggtgcccatcaccatgcctggctaatttttgtatttttagtagagacaaggtttcaccatgtttgccaggctagtctcgaactcctgacctcaagtgatccacccaccttggcctcccaaagtgctgggattatgggcgtgagccacggtgcccggcccacctgtctggctttaataccgttctgttttcttccaagctgtcttgtcgacggtctcactgatgcctcttctgcattcaaagttcctcgacccgggccagatacactccagttcacagtggatgtcttccactttgctaatgactccagaaacatggtaagagctttaacagcctgaaagaaggctgaacttgcaaccttcatatcctactgaatggggtcactcactagctccacccctaagcaaatgacttagagctgtgtcccagtaactcaaacttacaagtaaagccatgagctttagcgaggccttcaagcagaaggatgaacaatatgaagccttaagaggtagaggccgggcacggtggctcatgcttgtaatcccaatactttgggaggccgaggggggtggatcacttgaggtcaggagttcaagaccagcctggccaacatagtaaaaccccgactctactaaatatacaaaaaaaattagctgagtgtggtggttgggtacctgtaatcccagctacctgggaggctgaagcaggagaatagcttgaacctgggaggcagaggttgcagtgagcagagattgtgccactgcacctccagcctgagtgacagtgagactccatctccaaaaaaaaaaaaaaggcaggtgttagccttcctggaggctttctgcaggggcaaagaaaaccagtgtgaacttcgtagccagggtggcttcttgaacttggtcataggttaggctagtgattctgaaggcatcatcctcagctggagggcttgttgaaattgatgactgggccccaacccagggtttgattcaggtggtctagtgaagcctagaatctgcattcttaagtgttggttctgccagtctgggtcctccccttgagaacctaaactagaaaactcaaattgacactaagagggaaggagaaggaaggaatgaagatgggaactgcctaatggctgaggtgggggagggatgcagtaggaagtgcaggtgcaaggaccaacatctagccgggaagtactggtaagtggttagaagtaaattgcctggtgcggtggctcgtgcccataatcccagcactttgggaggctgaggcgggcagatcacgaggtcaggagattgagaccatcctggttaacacggtgaaaccccctctactaaaaatacaaaaaattagctgggcatgatggtgggcacctgtagtcccagccactccaggttcccaggtgcaagtgattctcctgcctcagtctcccaagtagctgggagtacaggtacccgccaccatgcctggctaatttttttgtatttctagtagagacaaggttttaccatgttgtccaggctggtcccaaactcctgacctcaggtgatccgcctgcctcggtctcccaaagtgctggaattacaggcgtgagccaccatgcccagcctcaagtagcttttaaacaagctcactgagatgagaggtgaggcggtgagcttagaataggtggttaggaagtgattaaagtaggggtttccagtgctggctctatactaatcatctggagaggttgtaaaaatactgattgtagagagtctcataccttcactctattggggtagggcctggtgtcacattttgtaacattaactaaatcttcataggtgtttgctgtaaaactccatgaacttcagtgtgcacaccatctaggttctaccaccagcatttttttttttttttttgagacagtctcactctgtcacccaagctggaatgcaatggtgcggtcttggctcactgcaac

SEQ ID NO: 16734 - DNA, 5688 bp, Human
attagtgtttctaaagatagaagatggccaggcgcggtggctcacgcctgtaatcctagcactttgggaggcccaggcgggtggattacttgaggtcaggagttcaagaccagcctggcgaacatggtgaaaccccatctgtactaaaaatacaaaaattagccagtgtcgcggcacttgcctgtagtcccagctactcaggaggctgaggcagaagaatcacttgaacctgggaggtagaggttggagtgagcctagatcaggccactgcactccagcctgggcgacagagggagactccatctcaaaataaataaataaataaataaataaaacatagaagatgtacagtaaaaacacggtaattgtttttgtttgtttgttttgagacagggtcttgttctgtcatgcggactggagtgcagtggcaccatcaggctcactgcagcctcgacctccttggctcaagtgctcctcccacctcagcctcctgagtatctgggactacaggtccacgccaccatgcctggctaatttgttctgaattttagtagagatggggtctcactgtgttgcccaggcttgttccagccttctggcttcaagtaatcctcccacatcagcctcccaaagtgctaagattacagatgtcagccactgcacccagccagtaatataattttatgggaccaccttcatatttgctgtcccttgctgacttacacatctttatgcaatgcatgactgttaccatcattatcatctctattttccagatggggaaactgaggcacaaagaatctaacttgcacaagttcatctgcttagtgatggaacaaagatgtgaattcaggcagtctggcttcaaagtccacacgcctaacaaccacaccagattactagattgcttttttcttttttctttttttttttttgagatggagtctcactctgtcacccaggctggagtacagtggtgagatctcggctcactgcaacctctgccttctgggttcaagcaattctcctgcctcagcctccccagcagctgcgattacaggcgcccgccaccacacccagctaatttttgtatttttagtagagatggggtttcaccatgttggccaggctggtctcaaactcctgacctctggtgatcctcccacctcggtctcccaaagtgctgggattacaggcgtgagccaccacgcccagcccagactgctttatttttgtatttgtatttattcatttacttattttgagacagggttttgctctgtagcccaggctgaagtgcagtggtgcaatccagctcaccacagcctctactcaccggggttcaaaggatcctcctgcttcagcctctggagtagctggggccacaggcatgcaccaccatgcccagctaatttttaaatattttttggtagaagtagggtctcactatgttgcccagactggtctcaaactcctagcctcaagggacccttctgccttggcctcccaaagtgctgagattacaggcatgagccatgcacccagcccctttttaaaatttttttgagagacaagactttgatctgttgcctaggctggagtgcagtggtgagatcatagctcactgcagcctcaactcctgggctcaagcaccagactccttttatcacattctatctcacacgcgtgtggttccaatcctgcctctgccacttctcagttgtatgccccaacccaacctgtctggctctgtcctccttaacagaaggacggccctggccacgggccacagccagcaacgcttaagcaccagggccggcgagtgccctgccgtggcacggctccagcgtcgcgctctcgaattcatttgctttccttaacgagagaaggttccagatgagggctgaaccctcttcgccccgcccacggcccctgaacgctgggggaggagtgcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacacgtgagtcctggcgccaggtcggggtgggtgggtggcgtgggggtggggtcagggaagagggcacagggacccacccggtgtgtaatgtaacgcttgcctttcctctctgcacgtccaggctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgtcactggcccaggccctggtgtttgtggaaggaagcctcaggcacctgccatttgctggctttcaggagtcatctttgctcaggcccgtgctgggccatgtgggtacactggtgtaggttgctggacacaggctgactcacatccataaagacagaggtcttagggccgggcgcagtggctcatacctacaatcccagcactttggggggttgaagcaggaggagtgcttgaagccaagagttctagaccagcctggacaacatagtaagactgtctctaaaaaataaaaattaggcagggtggtactgcacgcctgtagtcccagctactcaggaggctgaggcaggaggatcgcttgagcccaggagttgtgaagggtacagtgagctaacatcgtgccattgcactccagcctgggcaacagaacaagatcctgtctcaaaacaaccaaaagcccagagagaaagagtgagaccccatctttaaaagaaaaaaaaaaaaggtcatgattgcaaggtcacgattgcaattaaaactgtaaggtggggaaggaggaggaaataagagaagcacctgaggcttgagttctcaggagcacctaggttgggtcccaggtgaaggggcacagaggtaattgcacctcagagctgatgggaggattactatgtcaaaagcttggcatcggcttcagcacaccccaaggacaccacagtggacctggcaagctttgagatctctgtcaccgccacactccctgaggccagggcatccctgttggcagtcacaagggaactggcaagccgaaatggggtgagaacggagcccgcagagtctcggggtggggagattgggcagagccctggccaaccgacgggctcagacctgtgctgctggctgggccagcagctcttgttgcctgtgtttatttccagctggcctccctccaggtgtagacaggcttccaagggcccagttcccctctctcttgtctgcccttgccctagctgccaccctctcaccaggcccagggaaagttgaggtagaaagcagatgggggaccaggcgcggtggctcacacctataatcccagcactttgggaggccgaggcgggtggattacctgaggacaggagttcgagacagcctggccaacagtgaaactccgtctctactaaaagtacaaaaattagccgggcatggtgttgcatgcctgtaattccagctactcaggaggctgaggcaggggaatcgcttgaacccaggaggcagaagttgcagtgagccaagatccatgccactgccctccagcttgggggacaagagcaaaactccatctaaaaaaaaaaaacaaaaaacagatgggagctttggagctcagtcccaaggtcctcaaatatttgagggacccagagtctgaggctgtagcaagatactcccatgttcaaggcggagcatgcagtgagccgagatcgtgccactgcactccagcctgggcgacagaggaagactccgtctcagaagaaaaaaaaaaaaaaaaaaaaaaaaaaaaaaatactcccatgttcttttctcagcccacagtctgactttcccaggttccctaagaagggtggcaccctgcaggcgagggcctggagcatgtccacaccacccccaatatcaccccccaccaccttgctgcttttttgagaccaagttttgctcttgttgcccaggctggagtgcaatggcgtgatctcggctcactgcaacctccgcctcccaggttcaagcgattctcctgcctcagcctccagagtagctgggattataggcgtgcgccaccctacccggctaatttttgtatttttagtagagacagggtttttctatgttggtcaggtgggtctcgaactcccaacctcaggtgatctgcccgcctcagcctcccaaagtgctgggattacaggcgtgagccaccacgcccggccccagcttcttttttagggacagtctcct

SEQ ID NO: 16735 - DNA, 38808 bp, Human; identical to SEQ ID NO: 11802

SEQ ID NO: 16736 - DNA, 27783 bp, Human
  misc_feature (1)...(27783): n = A,T,C or G
attgtattctagtgttcatgaatcagtcagccaggcctgtctcttatctagcctaggaaatgctgtgttcatgtctgcctatatatatatttttttgtttgtgtccctttgcctttgacatttcccatctcatctcagacaaccaaaccatggttttacttcctgacccacatggattttatcatacatccttgatgtagatgcaactgaggtcagcccttcttacagttcatttagtacataacactttatactctgtgacctgttagtgacaattatgctttcattctctttgttatatctctctattttaatgtggccagttttgtttgcctaggaaaaatcatcctacatagggctgggcaagacaaggcacaaggcatatccatacataaggaggatatctttacttccctgtacccttccccaccatggttccagcatagaaggctggatagctgccagtagttgatcggcatccagaactgtatctggtactttagtaggctctcagtaagtgtattttgaatgaatcagtttattgactgttgagattaaaccctacttggcataactttttttaaaaagccccatcatggctattcacaatacatgggatgtaacaaagaatcaataattatttgttgagtgtatgtcagttttactttactctgtgtttacattatctttatttactttatgttattgtctgggctttagctgagcacatacattcttttctggaaaggtgcaccccagtccagaataatattgatgctagaatttttcaaagacaaagctatagcttttggcaattgtaggcacaagaaaggaagcatcttttgttacaccatttttccaaacgttattcttgttactttagtaggtatttatcgtctgtggttggctgtgcagcgatctgcaggagatcttacacattctttttattctttatttagaaatgggatctcactatgttgctcagactggacgtgattgaactcctgggctcaagtgagtctcccgaataactgggattacaggtgtgtgccactgagcctggtttttaccagcttctatcggtggagtgcctgtcacttccacctgtcatcatcaggagcttcttaatggtgcagaacagtggtttacctggagcaagctcattaaccaatataaaatatcacttaaaataagccgataggaattataaaattagaaactgacccttttaaaatgaatttattctctttaaatttattcaacatacttagttttacaaatagatacttgccattttactggcagttataatgatttatttgagggtttggtacatcttatacaaccgtgaatacaatttgcatctaataatgtgacttcagtagtatcatgatttttgtccaaaccttctcagtctgggaaacatttaaagagaataatgaccttagagaagagctggatttcttttaagacttctattcagatcaggacacaatcacgttcaaaattgacatagcatgtaacatggatttcagtgaagaaaagtacttcagaatcaaattttagaagagtgttttagggtttagtggcctaatcaaagggagtccagaagctatttttggataatacataggaggtagagcaacctggttttgcctctggttatcatttgacattgccagtgtcttacttgttcatattatggggaaggaatcgagtggtcacagaacttttggagaaaatttatcaattttttgtttactttgtaatgcttttctgttcttatttaataaaatatgcctttcgattatattaatttaaatttgtatatattgaattgatttaaactaggatcctttccccctttctctttcaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccaggtaggtcttattcctgagaagaatttggaaaaacaaaagcaaaaaacctctcttcctgatatgcatgtaactagatttagtaatgaaaaggttgtattagctttgtgtttccatcttaaatattctaatcttggaagggctattggattttgagtttagctttttatatgtaggtgatacaattctcaggtggcttactctaattcattattcactgtaagcacccatatatctactctgccttttcctgtggatgacctgtctctgttttatttaaagcctaagctccaagtgtgtactatatcccattcctttttgtcaaatgaagaactttgttcctacagttatcatccttctctccagcattatattttccctttctaccagagtatttctgatagcatacaagcatgccatgatactacccatcctaaaataaaacttaaaaaaaaattctgcttttcacttcattcacataacccaaccccaatcactgcactgtttccactggtccttttagaggattctccatttttattatctttatgtttcatttttttcttgtgacttctctagttagtctttctttcctaccatttaacttgtcgagatcactagtgactgcctttttataggtcaaggggtcatttttgagtcttatcttactgtccgctcaactgcatttgatacagttgatctccttccatcctactcaaaactttttctgtgtttggcccctaagacagtatgctatcctggttctcctacctcactgactgttcttgcccctctttgctggcgtattctcctgttttcacaggagtcagtccatggaccttttctccatttatattatttctttatgtgctttcatgctgtcacatgtcttaagattgtctataagctgatgctcacattttgaactcaagtcaacttctcccttgagttttagatttgtgtatccagttgcctacttgacatttccacttgaatatttatttattaaacataccaaatgtaatatgtctaagcgcagttttttttctctggtttcccctattgaagtgaatggcaacagcattcatgtaattgctaatgccctaaactgcaaggtcatcttttattcttcttacttaaatcctatatttaaaatatgagcaaatgctgtttgctgcaccttcaaaatatgtcttaataaatatgtcacctctcatcatttgtgacatcactactttagtacagtacatcatcatcatcactcaccttaagtagtgtcctaattggtctttctgcgtctcttcttccccttaacccattgtgttttccacacaacagccagaatgattttttaaaaacatactaaatcatgtcagttcctactgaaaacactttcaaggctgtcacacttaaagagatttctgtaagactctgtatgacctatcctcagagttctctgttccttggacttgccatactcctgtttccaggctttaactcttgctgtctacttattctcccccaggatctttccatggcacattttgtcattccattcagtccttgctcaaatatccgcatcactaattgactctatattagatatttattttgtttattgactgacatgagcagagtcttcctctatttcattcattactctatccttagtgcttagaatagtatattgttgtctggcacttggtaggtgatgctcagtaaattttttttataatgaatggtataagctgagctgctagctgagtgcattagtcatctattgctgcatgacagattgccacaaacttagtggcttagcacaatgcatgtttattacctcacagtttctttgggtgaggagtccagtcacatttagctgggtcctttgcaaggcgctgtaatcaaggtgttggttagggccaaggtcttatcagaagctcaattagggaaggatctgcttccaagcccatgtgattgttgacagatttagttgctttcacatagccttctttataggtagttcacattcatgacagcttcttcaaagccagtaaggaagagagggtcttctggtaagaaggacattatattcttgtggaatgtaatcatacataccctgtcacctttgccatattctgttggttagaaggaagtgataggtcatactcatactcaagcagggagaattacccaatggtttgaatacctggaggtgggaatcacagtggttaccttagagtctatctgggtttcacgtggagatgtgtggtaaaaagactgaaaataacattggatgtggagactagtagaaaggatagcagatagcagtgattatgctgtctgtgaaagttcaacttaagagctttagagtgtctttagacagttggtatgatatgattctcagtttcttactgagtccaaggaaagctgatagctgaaggaactgatgaagaaaggaagataaaaggatttaatagagaagtataggctgaaaaactcccaagcttgctatttgctaggagggagtctaggaattttatgtattcccctatagccaaagtgtgactagtagtcagccagccaatagaaatgtcttattttttgtatacatttttctcagctatgattcattctatagaaaagactggggcatagctctgatacttttaaataacggaaaatttcatgtcttactagttcaactattggaaagagactatagagacctcatgtttcgccctgagcccaaactcttgggggaaggggcagattacccagctagattagcttgctgaccccccatgattaagcagctatgacgcagaatggatcacttcatattaccagtattaataaagtagtagaaggtggtggtagtgatagtagtaacagtgatagcaattaatatttattgagcactgatggaatagtgattccttcatggggttagaaaagggtactgacattttacaaccctttcagtttacttatgggtttatagataaggaaacaaagacttaaaagggaagtaacttaggcacgctcacacagttagaatatagtggagtaagttttgcaaaaagataaaaagatggaggatagttagaaagagataatgaacataagaaaaatagagggccaacctaggtggtcctaggtgtttagttgaatacagtgcaccctaagctttttggcaccagggtctagtttcatggaagacagtctttccatagaattggttgggggatggttttgggattattcaagcacattatatttattgtgcactttatttctattattacattgtaatatgtaatgaaataattatacatttcaccataatgtcaaattagtgggagccctgagcttgtttacctgcagctaggttgtctcatccaggcatgatgggagacagtgacagatcatcaggcattagattctcataaggagcgcacaacctagatccctcatatgtgcagttggcgataggatttgctttcctatgagaatctcatgctgctactgatctgacaggaggcggagttcaggcggtagtgagagcaatggggagtggctggaaatacagatgaagcttcgctcactctctctcaccatcacctcctgctgtatggcctggttcataagagagcatgaactgggggggttagggacccctgatctaatagacagtattgtctattgattaagactgtgggttctggagccaggctttctggatttgaatcctggttttaccaaatactacctcaagccttaacctttctgagatttagtttcctcattgtaaaatggtaataatactacctacctaataggttgttatgagcattagatgagttggtgccttaaaaagtacttgttaaaacattaagtggcctggaatcagtttcaaattaaatatcaattctaatagaataatatattctggaaatagagcattgaggaagatggcagagagaaaattttccaagaaataatatcaaacacttccccaaactgaaaattgaaagggctcagtgaccaagtaatcagaacaaaggataaaaaaagccccacatgaaatttttgtatatcatagattaaaaaaaagattctgaaaactttccagaaaagaaagacaggaaacatataaaggactagaaatcagaatactggatttctcaatgcagttctggattctagaagaaagtaaagtagtgctgtcaaaattcagaaggaaatgttatctgcctgccgacaagcaaaaaaaataaatttttatacatgcaggaagtcaagaaaattcaactttttactttctcttaggacactaatagaggatgaggtccaggaaatgtgatccagcagtagagaagggaagtccaaggacttcagacttgtaggagacttgagcagtaaccaatataggttggaaccaaaagttggaagatctgggcctggcacggtggctcacgcctgtaatcccagcactttgggaggccgaggtgggcagatcacgaggtcaggagatcgagacaatcctggctaatacggtgaaaccccgtctctactaaaaatacaaaaaattagccaggcgtggtggtcagcgcctgtagtctcagctactcgggaggctgaggcaggagaatggcgtgaacccgggaggtggagcttgcagtgagccgagatggcgccagtgcactccagcctgggcgacagagcgagactccatctcaaaaaaaaaaaagatggaagatccaagggaaaacgtagagtgaataaattatttgattatttgttgtatccaagaaatagtaatgataggcgtttaacagatctgttggaattctggaaatattagtggaatgtacttaaaattaaacaaatgaagaaacaaggcaatggttaactttagtaaaaacattgttcaagaaaaagtagactcatagtacacttgattcagcaatgaattacatgtatgtatatatgaatactggatattgatttaagcaaaatgttatatttaactctattttggggatgggagtgggatagaataataaaagaatgctgcctcatttgccctaagagcaagtctacaaataatatcttgactaataatagcaatataagcatattatttagcagtacacaaagtaaatgttataagagatggctaagagtttaaatttgttttctatagaaacagtatatgggagggggctaggaattgcagtttttgttataatctctaatagcatgtctttttttaaactgtccacatattaacattattttggatgatataaaataattttttaaaaatcgtgcatagataatgtacaagtgaaagagaagccagtgattttagcatacctctaaagaaaaaaaaaagcaaattcttactgaactgaattcctgagtagttatttcactaagtctctcagattgctagcctgctaaatgtagaagttcttgctgccttaatgcccttctctccaatggcagctgcctcttgttctgcgaggggaatagcagttgttaacacacagtagaacaaaacgattgtagtcagatgttaaccacatatttagtatactaatgcagtagaatgaaatgaaacaatagacaaaaatagcacaaatactgacttaacagaaacactggattgttgtgtacatccctacttcagggaggtgaagtgtgacttaggtagcttaaaaacaaactcattttgttgatgctgaatgatatcagaattaagttgagatttttctaagtgaaactacattgacagatacaggacaattgttaatgagatgagttgtaaatgtttgaagaatcaggtttgtttcagtttcctgcatggaaaggtaatcagatatttgaatgtgattggtcacttgggtctttagagaaagcgaatatttgaataaagtttatctcttaaaaatgtatctgttaaaaatgtttagactttgttgtgtatattttcattatggtcatatttagaagactgattttgattggaaggcttttacctagagaatattaccatattcaatatggaaaaccgtactgaacaacgtaaaacatgagatctttcaaactaagaaagatcaaagtgttcataattggaaatgtggaagtttttagggcattcacataacagattccaacttcactctgtagtcttaactccttgttcagtgcgtaggccaactgattttctcatctcctctgccaccctccccttctacctcttcccagccctagtactcccatgtgaaatcctcctgtatctttaaggttcagtcaggtatgtttttttcttacagtattttgtttgattctctgctagctgggagcgctcacctctgtttaactcctattgtgttaaattctctgttttatggttgttttttaatatcctttatctcatagaacaggagtggtatctttctctggattttctgtcttccagggtaccttatgcaggctaaatgcttacagagttttggattcagtttttatgtaaatagagattcagggctctataaaacagccctttctaaaagtaaattgttttaataggtttacagtcttacatgaatcctttctaccaaccccttagtgtggatggggcatttgtttagtcattcctgacaaatgacttttgatttttgtttttcagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccaggtaagactttattttattgataccaaaaaaaaaaaaaattcctaagaatcacagttgttcttactgtgggccctctgggtgaactgttacatgccaaggtatagctgtttctgactctttattctttaggtaattgtttgatttccagaagagtttagattttattttgccaattaccgtatgtttaaaaaatggaagtagccctatttgacttaaatattttcttctattttatgacactcagtaccatttattgtcttttatataactgatactgtgatgaaagctatggcattcaatttaatcttcagaatgactatgtgagatagatattcctgttttacagatggaaaaagaaattctaaagtaaattttaaacttttaagtaccttacctagggtagggctaagaactagaggttcagacccaggtttgtctaactctaaagtctgtgatctttcacctttactgtgtggcttttcaaattatttaagactttagaagttaaaatgaatcctggttatctttagttagataactgatgaactgatttcactggagaaagataagtagattttgtaaagttctaaattttgttaatggcatgtcatatatggacatgtcagtatgtcactgtcaagaaatatttgaacacctgctgttgtcaggcagagtcatatataagtacagtaagtcctcacttgatgtcattgataacgtcttggaaactgactttaactgaaacagcatattacaaagccagttttatcataggctagttgatataaacaagagttaagttcttgtggtatatttctggtcacaaaaatatcactaaatttataaataaagacccaagactcttctaatattaaacattgaaataaatgtgagctgtgcatatctttaagaaagatcaataaaaacaagactgttatttacttaattattctaattcatggtcatgggtagccagagcacattccagcaactcagggcacaaggtggaaaccaatcctgaatgggacgtgattaaatcacagagtgcactcacacacaccccggcactcacactgggactgtttagacatgcatgccagttcatctgatgtgcacatctttgggatgtgagaggaaactcgggtaaccagagaaaactcaaacaaacatggggagaatgttcagactcacacagacgtggccctggctgggaatggattttttttctcatcagcatcataacaaaatgatgctgaacaaaacaccattgaacaaaacattattcaaggacctacagtatattctttgtgatttctctactgcagcaaaatatcaattggtatagttttttcttttgaagagaaattaagtgccagctgtttaacttgctattaggaatttgctcaaaaacaaattttcatagtttgtcttagattcagtgctgattgtagttctgtctcaaaatacatcctgtacaaaacattgggatgaaagacaaattcggttcttatttataattactgagacaaaaaagtatagctgtagcttttgcaaaattttcaactatgagtgttgaaactcaaagattttctagttaacatttagtttcctaagtgaattacctaaccatttaataggacacaacagccatatttggatgttgcacaagcgttagacaattgctgttagtgttgatggcaaattttgaagggacatagttttactttccagttttaaatgacagtatacagtatgtgctgatcttaataatttaaaagtgtctctgtagtagatatatacccaaatgaggaaaatctgtacttcagattgatatgtaatagctgtagtttctctgaacacataaaaataaaggcaaaattcttgaccttgaattctgtttcagtgaattttaggactgatccttgtatcctggattaccagggatctgggctaaataaatgtggatttgtagtaggttttcaattgccattaggtgtgctgtctgttctccttttcccttgccctaggatagtatcctacatttttttgtgtgtgatgttcagtaatgaagcttgctggtaatcttaagaattttctaaagcttttagagtaataattttgagcagaatgaagattttaattattatttttttcctcttagctgatacgcctcctcctgcctatatgccacctgatgatcagatgggtcaagataattcccagcctatggatacaagcaataatatgattcctcagattatgcccagtatatccagcaggggtaagagaagtactcacttcatttattttatagtagtagttgtttttaacttattggctacttttttaaaaacagctttattgaggtataatttatatgctataaaatttttttgttttaagtgtatgatacaaagattttggtaaatacaccaagttttgcaccacagtctaggtttagaatatttccctaactctttaaaaaggtttctctgcgtatttgcagtctatcctcactcctatcctcagctccacataccctctaatctgttttctgtacctgtagattttatcttttctgaacattttatataattggaatcatgtaataatgtagtcttctttcacttagcatgttttttcaaggttcatccgtgttgtagcatgtatcaatagtttgttcctttttattgcttaacagtactcctttatataaatatatcacatttattcaccagtcagtgggcatttgaattgtttccgtattttgattattataaacatttgcagctgggctcagtggctcacgcctgtaatcgtagcactttgggaggccaaggcgggtggatcccttgagatctggagttcaaaaccccagcctggccaatatggtgaaaccccgtctctactaaaaatacaataaaaataaaaaattacctgggtgtggtggcagatgcctgtaatcccagctactctggaggctgagacaggagaatcacttgaacccaggaggctgaggtttcagtgagctgagagtggagtgccactgcactccagtctgagcaacagagcgaggctccatctcaaaaaaacaaacaaaaatcgcatgtaagtctttttgtggatattgttttatttctcttggatagatatctaggagtgcaattgctgaataacatggtaagtttaactacttaagaaaactataaaacttctctgaagcggcagtaccattttacattctcaccagcaaagtatgagggttctattttctctgcatcctcctaacacctgttattgtctggctttttaattatagccattctagtgggtgtaaagtgcttattgtggttttaatttgcatttctctaatgagcaatgatgagcattttttaaatgtacttgttggccatttatatatcttctttgatgtgtttattttaaatcttttgcccattgggttgtcttactgagttgtaagaattttttgtatattctggatatgaatcctttatcagatatatgatttgcaaatattttctctcagtctgtggatttcttttcattttcttaatgacgtctttttgagggtaatagctttaaattttgatgaaatccattttgtcagttttttcatttctagattatgcttttggtgttgaattcaagaaatttttgtctatcccaaggtcatgaaaatattattttatgttttattttagaagttctatagttttagctcttatattaggtcagtggttccttttgagttaagtttgtatgtggtatatggtaaatgtctacattaagttttttgcatatagaaatccagttggctttgccatttgttgaaaagagtatcatttctttgttgaattaacatctttgtcagaaatcaattgactgtaaatgccagggtttatttcaggactctgttggcttacatatctatacctcatagtcttgattgctaaagctttcctataaaggtttttccccctatttttttgttgttttgttttatttttaatttttaaattatttatttattttagagacagagtcttgctctgtcatgtccagactggagtgcagtggcgtgatcatagctcactggagcctcagactcctgggctgaagtgctcctccaccttagcatcctgagtagctgggactacaggcatgcatcaccatgcttggccaatttttttgttgttgttgagatggagtcttacagtgttgcccaggctggccctgttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcttgctggtgggtgcttgtaatcccacctgctcgggaggctgaggctggagaatcacttgaacctgggaggtggaggttgcagtgagccgagatcatgctactgtgctcaatcatggatgacagagcgagattccatctcaaaaaaaaaaaaaaaaaagttaaccaattattttaaattgcctacatagaccatgtgattactcttacattttccttggtgttattttattcctgcccctttttttttgagacggaatctcgctctgccacccgggattgaatacagcggcacaattcgctcacagttctcctgcctcagcctccgactagctgggattatcatacgcatgtgccaccacacccggctaatttttgtatttttaatagagacggagtttcaccatgttggccaggttggtcttgaactcctgacctcacatgatctgcccaccttggcctcccaaagtgctgggattaccggtgtgagccaccgcacccagccatattcctgccttttttgaaagagaattgagggtctgtgatttctttgcttgatttcagctccaggaagggtgctgggatgtagagcttccatgtatctcttctaccctttgtgtctattatgagttactgacttttatattaatgagtttggccagtattttatattgtgtataaacctttttctgtaggcagttctggcatgtaaaatttaaacatatacctctatttacccaaagataatgttcatttagttgtttttttgtttttctttataaatagactgcattttttagttcagtttttggttcacagcaaaattaagtggaaggtacagaaagttctcacatactctcttctcccacacaggcacagcctcctccattatcagcatctctcaccagagtgggacatttgttatagtcagtgagcttccattgacacatgattattatccagtggggttcattcttggttttgtacattctgtgggtttttaacacatgtatccacccttatgatatgatacagaatcattttttacctcttaaaaattctctgtgctctgcctgttcacctcttcttccccacaaccccttgcaaccactgatctttttactgtctctatagttttgccttttgcaaaatgtcatagttagaatcatacagtatgtagctttttcagactggcttctttcacttagtaatatgcatttaagtttctccatgtctttttatggcttgatagctcatttctttttagcatctctattagggttctctagagggacagaactaataggatatatgtaatatatatgaaagggagtttattaaggagaattgactcatgtgatcacaaggtaaagtcccacgataggccatctgcaagttgaggaacaaggaagccaggggtggatcagtccaagcccaaaacctcaaaagtagggaacctgacagtgcagccttcagtctgtggccaaaggctcaagagcccctggcaaaccactagtctaagtccaagagtccagaagctgaagaatttgagtctgatgtttgaggacaggaagcatccagcacaggagaaagatgaaggccggaagactcagcaagtctgctcttccatcttctgcctgcctgctttattctagccacgctggcagctgattagatggtgcctacccagattgagggtgggcctgcctctcccagtccactgactcaaatgttaatctcctttggcgacacacccacagacacacccaagaaacaatactttgcatccttcaatccaattagtttgacactcaatactaaccatcacagcaccaaatactatttcattgtcttggttgtaccacagtttgtttatctgttcacctgctgaagaaccttttggttgcttctaagtttgagcaattatgagtaaagctggtataaacattcatgtgcagattttttatgtggatatagttttcatctcatttgaataagaagcatgattgccaaattttatggtaggagtatgtttaggtttgtaagaaacggccaaagtgccttctaaaatggctgtatcattttgcattcccaactatgaatgagaattcctgatgctcctcatccttaccaacatttgatgttgtcattgttttggattttggccattctaataggtgtgtagtagtatctcatagttgttttaatttgcaattccttaatgacataacatgttgaacatcttttcacatgcttacttgaccaatctgtgagtctgtggtgggctccctactcatatcttttgccatactttaatcagattgtttttgagttctttgtatattttgaattatagtcttttatcagatagaactttttcagattttttttttcctaatctgtggcttgtctcctcattctctagacaatgtctttctcagagcaaaagttttaaattttaatgaaggccagcttatcaattatttcttccatgaattgtacctaaaaaaaagcatcatcataccagaagtcatctagattttctcctgtattattttctaggagttttatagttttgcattttacatttaggtctgtaatccatcttgggtcaattttgtgaggagtgtaaggtctagtctagatttacttttttgatgtagctgtccagttgtttcctgtatcattttttgaaaagatttttttttcttccattgtattgtctttgctcctttgtcaaataccagttgactgtatttacttgggtctatttctaaactctattctactcctttgatctgtttgtctgttcttttattttatcatgatcttgattactgtatctttatagtaagtcttaaagtgaagtagtgtcagtcctccgacttcattcttctcctttgatattgtgttggctattttgaggcttttacctccccatataaagtacagaatcattttgtctatatccaaaaaatagcttgcagggattttgattggcattattactctatagattaagctgggaaacactgctatcttgacgatattgagtcttattcttgaatgtgcagtatttctccatttatttagttctttgatttctttcatcagagttttgtagtcttcctcatagagcatgttcctatttttttatatttgtgcctaagtatttaattttggggatactaatgtaaattataatttttttattttaaatttcatttgtttattgttgctgtataggagagcaatcaacttttgcttattaaccttgtatcctgcaaccttgctataatgcttactagttacaggaattttttggtcagttctttcttatttttacatagacaatcatgtaatttgcaaacaaagataatttcctcctttcctatctgtgtaccttttatttatttatggcattagcaaggacttccagtatgatgttgaaaagtgggagaggaggcatctttgctttgtttttgatcttagcagaaaaccttctagtttcctaccattaagtatgatgttagctgtagatgttccgtatcaagctgaggaagttcccctctattcctaatttgctgagtctcacttagttttttagtttaacttttttgtttaaaataattttacagatactgattatagttaaatccttcaggtctctgaaaaagaattttttgtctcaaatttaaacctgaattagtttatgttagaaaaacaattaaaaatgtgttgttgctgctatgttctgaattgtgtcgtcccaaaattcatgttttgaaccaaggcctgggcacctcctcactccacccagagggttgggagggtagaacatcaaaccaaagaggtttattctccagccttaaggcctaatgcaatttgctttgctaggttttcagcttccttgacccatcatcactcccttattttttgtttttccattttggaatgggaacgtctatcctgtgtctgtcccaccataagcacgtaacttacctggtttcataggtttacagctggaaaggaattttgcctcaagtctcgtatgtcatatgtagatgatatttggatgatactgggtttacaacattagagttgatgtggaaatgagttaagacttcaggggctgttgggatagaatatatgtgtgtattttacatgtaagaatgatgtgaattttgggttgctggggtggaatgctaatggaccatattgaatctccctaaaattcatatgttgaagtcctaactaccagtgtgatggtatttgaagatggaaataattaggcttgagagtgggattgtcataatgagattagttcccttataagaagaggaaaagaaacagatctttctctaagagcatgcactgaggaggggccatatgagcacacagtgagaaagcagctgtctgcaagccaggaagcaggtcctcactagttaccaaatcttctggcaccttgatcttggacttcccagcccccagacctgtgagaaataaatttctgttgtttaagccactcagccttacggtattttatagcgtgagcaagctacgactattgccgatcctggtatttctataactttttaaattgtcatattcaagctgatttctagtgcttgttttcggatatagattcacagctaggaaggacagtgagacttgtgaaatatctgaaaattttctttttcatgtaatacttgggttgggttaaaagataaacacatggacaatctgagtttctgatatgtattaaactctttctgtgtctggtttgttcacagatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtaatcttgtcattttcctacatttaatcgaattcagtcatttgttgtacttgccatgaaccatgcattgtgaaaggtgctagaaacatacaaagaagtttgacacgtggcctctgccttaagttgccgatattgaagaatgtattaatcaaataaagacatgatgttccctcatttttttgtcctgcttagtgtttcttcccagtgctaaggatctgaaatcatactaccactttgttttttgagtgttaccctgactggaacataagctgtacaggaacttgctttgttcacagcagtatccccagtagctagaagagtgcctcattgtaaatacacaacacatatttatggaatattgtgtatgaatgctggtgaaggattagaattttataattaaggtatttgtggagtattttgggttgagatgacttgtaagtgttaccatgatgtgagaggagcggaattagaaatgggaaatctagtgtgaatgatactccagtggcttcaccaccactgctcccatcttttaaatttaggcaataaggttttattaataattcatcctgcaagatagttgccataacaaaccgggcccttttcatactgcaataaaatgtcaaagtctcatgcatcaagtgatcaggaaggaaacccatcccaggtaaagtgtattgcctgtttcttgagaagttttgtttttaccccttgctgcattttgcttctttaacttgagggcatcttggtccaaaataggaataaaaggtaaataaatataattgtgataggatttcttatagaagtgattcaaaaaaatcctgcggccaaaaataagttacgaaacaaagttttcattgtcttgagtttactgccaacttgccttagttttttcagtgaagtgcctcacttctaggcattgattttttttttcttccatcacagtagaagtaatttaagggaaatctattttgtgaattttgaaattctagaatcagttttttctttttccccagcatatagttctaggaccttttctttcatgggttagttttggggtggtggagggatatgttgggaaaatactaggtgactagctttagttatataatttgaatatttaatgttaaaactatttccacatatttatatatttttaaaatttttattttttttgccctcacatcttgcaaaggaacatatatatttttaaatataaaaaaattttaagtaagataaatctgccatttcaaagctcttcttatgacctgaaattatatatgtaactttggtttttttttagtgttgctgtcctctttgttagcacaaagagtgcaaaagtctgtcaaatgactgtttatgatagttgatagcactgagcatttatttgaaaggactcatcaaaagatgatttggggttttttttttttagccctctctttctctcatagagatgataaatgattgttgggaaaggaaaaagagaacaacctaaaaatggataacttaatatgctgcctatttgaggcttatcttgtagatgcaggcagacattaacctcttgattatctttggcagcagaaggccatctagtggtaacttctgtctaaagactgctggaagtttgctgtggattaatgggtacttttgttgcaccatacagtctatttggtttcattgtaatgattctttaagctgactcttgtgatgtttgtctttttaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaaggtgagttgtgacctctaacataatttgagtcactataaatgtgtatattatgactttaggttataatttttaaaaattgttaaatgaaagttgataattgcttttggcgtgatttaacaggtttttaaataaaattattgaatttgtaattttaactacataatagatctaagatttcattttgtaatctagacattataaaatgcatgattgatattgattttgatattgaataggggctgagattataaggaattttagttaaaagactaaatttctagaaagcatttgtattagtccattttcatgctgctaatagacatactcaagactgggtaatttatgaagaaaaagaggtttaatgaactcacagttccacgtggctggggaagcctcacaatcatggcggaaggtgaaggaggagcaaagtcatatcttacatggcggcaggcaagagagaatgagagccaaatgaaaggggaaaccccttataaaactatcggatcttatgagactttattcactactgtgagaacagtatgggggaaactgcccccatgattcagttatctcccactgggtcctttccacaacatgtgggaattatgggagctacaatttaagatgagatttgggtgaggacacagccaaatcatatcagcatttaatattaaaattgctatttgagtctcttaacttcaacagttttgattattattactagatttcattagggtgacttggcagaattctttagaatactaaaattatttcattcctagctaagtactgttattaaaagtaatggcagaagccacaattacttttccaccaaccttaatattaaggatttgcaaagttcaaaggaacttttcaagtttttcatctactctcttcacctgactgtattgacattccaaagatttgtgcttaaaatctgaaaagaattttagtcatgtatttaagcaatctgtactgtatctacatatttaagcaatctgtactgtatctacatggttcttaagaatttagcacaagaagagcacctgtcacacgctgtgcatgggtttttttctttttggtattcagccccagtccagtgttttcatgatactttgctgtagatctattgtatacatcagtttactggttaccctgaaggtatttctgccttcttgtacagtaatgtgacttttgcatatttattttaatctccactccccaatgttcttcactcccctgaccgccctccctccccaacccagttttcctgggccaagactaccataagcagtaaaccagagaacctgataaatccaggaaaataaaagtgaaaaatttctatttcaatttttatctgcagttttaggctaaagatttcagctcagttcatcccagtaatttccaaccttaaaggataatcactatgtgactgccacattaaattatacatgcatgtattgatcaatatctacaatgccttatctgatattcaaacaacttgaaaataaaaaatttttcgttaaaaaaaaaaacctgggccgggtgaggtggctcacacctgtaatcccagcactttgggaggccaaggcaggtggatcacctgagatcaggagttcgagaccagcctagccaacatggtgaaaccctgtctctactaaaaaatacaaaaattagccgggcatggtggtgggtgcctgtaatcccagctactagggaggctgagacaggagaattgtttgaacctgggaggcggaggttgcagttagccaagattgcgccattgcattccagcctgggcaacaagagagaaactctgtctcacaaaaaaaaaaaaaaaaaaaaaagaaactctgacatgtgacatgatcttacatgaggctatttatgattttgattttgattttttatatatgattcctttattagtatttaagtgacatctctttacattttttagtggtttctccaggaattaccacgttatctttaacataccccaatctacctagagttaatattgtactatttttagaatgtaaaatatgaaaaccttgctgttgaagagttttaattaccttcttttattctttgtgctattcataaattttacatctgcacattatatcttataatacagttaaaatttttcctttaaatagtcattaagtcttacaaagaaattaagagaaaatggtatttataaatatttgcaggcagattctttggggctatgtaaatacactgtttctcctttatattttacccacaatttttgcattcttcaatatatcttgtctacagtaattattactgtggtgttctagtggtgattttctattttgcatttatcccattaagggagaatgtatctcagatcagaaatatttgttttaattatgagatactgtactgtgttacctttctaagattaaaaaaaattatgaactataactggctctaagggtttcttttaagggaattatatattattttagaattcatgaatctttaaataatgtagctgttgtcttttaatttcatggtgaatactaagactggttttgtgatagttattctctttatgtaaattctacatatctctactgttaaaagctatctttttcttatggtaaaattggtttagagtggttgacagtttaaagagggatttgtgatgatatctgttcattttcatagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgatgaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaaacccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttc

SEQ ID NO: 16737 - DNA, 7585 bp, Human
ctgcaaagagcagggatggaagtcagagatgtgggatggcttaagggaatttagcaaaacacctgtttctctttaccttgtttaccaccaagacactcccttccccatagtgcagtggaacactgacgagccatcatcactcctaagaaacaatacaaaatgaaaaaaaacagtattgccatactcttacagtggaggcgaggaaatcttatgagtttgtccccactggctattatagttcagagtgctaagctaaagaacccctcaccttttcaatctactgtgtagaagctatatttacttacctgcacatacctccaaatatgtatcctagaaatcagatttgaaatcttataaatcccagaagtaggaagttcgtatttcaagaactacttttcaaattagtgttttaattcaacaagcatttagtgagtgcccacagttccccaggcacctccttaagtgctgagaatataggggtgaactggacccataaagccctggagtatatatcctggtgggagaggcagataaaagatctgcagaaaaacaggagttcaggaggattaagagctgaaatcaggaggcagacttctgggcttgaatacaaattctgcggcttcctggctttgtggttttgggcaaattacctgcctctctatgcctcagtttctccatctgtaagataataagaataattatagtacttcatagagttacactgagattgcttttttgactcatagtgattaaacacagccatactgaagggccaggaagctaagatgtagacagtgttttaaagggtaaaaaatggtgatgacaaattactccccacctcatttggcagccgagtgtattacatggcttaatgcatgtaaagtacttagaaatgttgctagtatggtcaggcccagtggctcatgcctgtaatcccagaactttgggaggccaaggcgggcggatcacgaggtcaggagttcaagaccagcctggccaacatagtgaaacctcgtctctactaaaaatacaaaaaattagccgggcgtggtggagggtgcctgtaattctagctactcgggaggctgaggcaggagaatcgcttgaacccgggaggcagaggttgcagcgaacctggattgtgccaccgcactccagcctggtgacagagggagactctgtctcaaaaaaaaaaaaaaaaaaaaaagaaatgttactagtatgtagtaagttctcagtaaatgttagctactatactctttcaagtgctgggtttttacttgatgtcatacagtgttatataagatctccaaagatactgaggagtcctcaaggccaattttaacaagcatggttgccgcattcttgtgcttatagttgaacatttcttctttcagacacttgcacaaagggatacttctaagatgcatttgcattaggtggcaaacttcatcctgggtatgaaaaacattgagatttgggaataaagcatagtaagactgaggttgcaattactaaaggaaaaccccaacagagataagtgaagttctgcaatatcatgcaccctcccccaacccgctctgtctccccaggccccccttcgttagaacacccatgactggctatattatatcagcatttcccataatgtaaaaagggaaaatacagacctgggcgttcatggaaagtattctaactctcacaaccagaatccctgtctttgaattttttttcttggtttttagatctttaacttttccttcagcatttcagtactcaactttttgaaaatcatcttttctgaggaatgatatttcctggcacagcatcatctctgtcaagtgactcagtttgatttttttgtttgttagtataaagtggccccaacttacagagaaaaagtgggctcttggtatcagtttgatgtcagggtttttccgtgtttgagagggagctttaaataccactcgatttgaaggtgtctgcaagcgagctccagtccgctgtcaagatgcttctggccatggtccttacctctgccctgctcctgtgctccgtggcaggccaggggtgtccaaccttggcggggatcctggacatcaacttcctcatcaacaagatgcaggtaggctgcagggggagcccatgggaaagacagctactgacaaagtgaaatatgtatgaggatgaaaaaactcggggctgactaaaggttcttatctctctatctactttaggaagatccagcttccaagtgccactgcagtgctaatgtgagtgaatgctctttaagaactttccaaattaattttaattttcacatctggaatcttcactctgaaatttcccttgcaggtgaccagttgtctctgtttgggcattccctctgtaagtatagtgaaataacataatgttgaccttggatttttttggtttgtttttaagtaaaaataagttgctttatttaatatttaatgttatacattgttgcttaatttaattgttacagattagtattccctgttaaaaccacattgttacaaattattcccttttaaaactacgatcttgaaatcctatattatgaacatttctttgtatttaattaactttatgcctcttgagaagtttgaacacttttcaacattaaaaaaagaatcctgaatatctttttagataggtggccatgtgcacaattaaataaaactggaactaaggatataataattgctgtagctcatatcatattgctttctaactcatttactgataactctagagttgtgaaacaatgtaaataaaatgacaactccttatctttcatctgtcatgaatgatctatgcgctatacctccccctccctgcctcctcccttcctccccaccaccctgttgtctgtctagctgattagagtgactgttggtttgaatgctgccctctgggcaggtagaggatctgaggttgtgagtggaaggagggcttccagagggccactgcccactacggcaggaaggatgggtggcaggaaagttctgattcctaattcaaactcctggttagggtgaggaggaggcacttctccaaggtgcagtgctttattctttctcatgcaaggcctgggagaatctgaagaatctgagcttcttgccctggctagggtaagacatcgcacccatcgcggtccatccattagatgagaagaggatagagtgccttctgggcaggaaccaggcagacagcacagcccctgtcccttggagtaccgtccatgtttttagctgctgctgaaataccagctgcattcaattgtcacatcccattagctggtgtgaaaaggcttttcctcactctgcactttcagacttacaagccttgaagccgggaagcacccgttgaaaagaacattcagagccgactatttcagggcccagagccctcatgtttcctggatgtaacatacaggaagtctcctccaggggatgtcactgtggaaaaatggcatcccctttaaatacgggagatcacttcctacattggcaagggacctgtctaaaaataatgcaagtttgagtaatggtgattaaataaaaatcatctctattatattgctctttgtgatatatttccaaagctgtcctcagaatatttctttgaataaatccttactatttaccaggacaactgcaccagaccatgcttcagtgagagactgtctcagatgaccaataccaccatgcaaacaagatacccactgattttcagtcgggtgaaaaaatcagttgaagtactaaagaacaacaagtgtccagtaagtttgttttcatatgtgatatgttcctgttggtgatttctatgtgaatggtgatgccaaccctgtttgaacacaaaaggatgataaagttggaattggtagttcaaggttgataaaagacatctaagaattttaatcagaagtaatataattaaagtgagatccactgaaacaatagaattaaagtgagatagatcattgttcctgacgaggccatttacttctctctactatggaataatgaaagaatcctttctgagtgtaattagaagctacaatctagagaatcagggatgtagctcacataatactaaattatcctagagattcaatgtactaactgaatggatgttgttaacagggatttttttttcctgttggttaaggaggttttgttttgttttggagacagagtcttgctctgttgcccaggctggagtgcagtggtgccatctgagctcactgcagcctctgcctcccgggttcaagtgattatcctgcctcagcctcccgagtagctggcattacaggtgcgtgccaccatgcctggctaatttttgtatttttaatagagatggggtttcaccatgttggccaggttgctctccaactcctgaactcaagtgatttgcccgccttgacctcccaaagtgctgggatgacaggtgtgagccaccatgcctggcctgcattaaggaggtatttaaagggcaatgcacccaggtcaaggtggaagcttgctactcatcctgaatgcccatccacacattcttttcttcagcatataccctagtccctgacagcagactgggatggcaagttgggtagaggtgacctccctctgttttttgggtattagcatctccacacaagatcctagaaggctgaaagccctgagctcagctgtttagctgcatgcgtttctaccatcaatggcatctagttctaagtgcttaatatatgctgtctcactgaataaatacataccttagggacaattattcaatttattactctcagtgaggttaactaatttgcctaaggctgcatatttgataagtggcagagctgagatttgaactcaggcctatatgacctcagagccccactcttagccattgtactgtcaaatgaccttggaaagacaacctaaaaggataatgatacaattttaggcctcaaagagtccccagaaaaggctttctctaatgcagagatttagggccacttaataggggtgtgtgtgtgtgtgtgtgtgtgtgtgtgtgtgtgtgtgtgtgtgtgtaaagacccctgaaatccaatttgaggtcaaccacctatgctgtctttacaccacatgagctagcctggacctgcccacctatttgctctgtgtctcaagccacttcccttcccatccccacaatcctcaccaccgactctggctcttggcaggtaggcttctggggctgcttggctctacatcatttgagtcactctgtccttatcaactttcatccccacagtatttttcctgtgaacagccatgcaaccaaaccacggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaatacatatgtggaaaaaacaacatgagctggtctcttggcaattattcatttcttgctgctcagaacaaagaaagctacaagtgttgttaaggggaagaatagatcagagactcctgtaggagtctctgtgataagactcctgatgctgaatacagaccctcaggctcataggctgtggctggagctgcaggagggctgcagggagcagttacaaagaatgtctatgaggaccatctgagggttgccactaggggaggctgaaggcatgtctgacactgctaagagggctagggtcctgagaaactggccttgtgcctgaaagaggagaaggcagcagcttggaagtgggagactgctcaagaatgtgggcatgcagaataaatgcttaataattaagtgcttaacccactagttatggtaggaagtagatattattattatgcatttctgttttatatatactgaaaccaaagcttagaaagtctgcatggcattcccaagatcccacaggtggtgagatttagaagaaggattcacccctcgtgctctctgcttccaaaccctttgctgtttgcattctgcccctttcttattctctttataccaagggtgtgcattgtgcttcttccaaccacagcctgagggtaaaatagacccatcataattccagtccacactctcatatccagaaacctagggagtcaggtttcagaattcaagctttttagccttttagaaagttaaaacaatccacgtgccatatattacataacacccacagcagggcctggggcaagtttccataattaaacatatcaattctgcaacagtcactgaaatggtcaggttttgcagccaaatgagtcctaacaaatcttgagttttcgcagctgtttggatttcagaataatgataagaaattagtaagctgcattaacaaaacagcctttctctagctcatgccctatttaacaagggaggtgggggtggggggcactcttacgaagacattttatgtggggctgggctgggtgtctccaggagggataaaggtttctgtagcttcctggacagccagccacatggagttccagatcacagctgaagggccttctcttctcctctcctccatgtgggttttctgaatgactggcgccagacatagttgaatcatgtgacactatgtggtttaccacctgtggcatggggagacaccagcccaagcaggatcccagcagggacagatactgatggttggtgatggtttcagaatataactcggaaatgcaatgtcttgccagaggagacgggcagagacgagcttccactcactgatgcagattaatcaccagcatagcttggtgctttccctaggcttttctgcaaaagtcacataacctgcagtgttcattcctgcaggcaagctccaaggagggttcacttacagtaaagtgtgctataattaccatcttctctgtgccaggagagttgagattcatcaagaagccaccctggagaaaggagaactaatatttattgtttactctgtaccaggcagtcctctaagcctattttgtagaatatctggttggatcctcacaacaaccccatgagatatttatataattgttgtatgtaatttttcccactgcacaaatgagataagtaggcccaacgaggttgcataacttggccagaagcacgttgctcacaagcagtgaagttgctaccctctccaggttgccaggccccaggcagagttgtttccagcagattccagatcaaagcacacactgcaggccaagatgtggccagccataaagctagcttgcccatctatccatccatccctccctctttacatccacccagtttgaagcaggaagatgctgtgatgttcaaacctcacaattcctctcctcccattgtcacattgtcactctgcttcattgaccccagaccaagacctccctttctctgcaaaggaaggcctcagcagaaa

SEQ ID NO: 16738 - DNA, 28035 bp, Human
atcaggtcaggagatcgagaccatcctggctaacacggtgaaaccccatctccactaaaataataataaaataataataataataataataataataataataataataataatacaaaaattagccaggtgtggtggcgggtgcctgtagtcccagctactcgggaggctgaggcaggagaatggcgtgaacccaggaggcggagcttgcagtgagccgagatcacgccactgcactccagcctgggcgacagagcgcgactccatctcaaacaacaacaacaacaaaaaaaaacaaaaacaaacaaaaaaccagacacagcagtaaagtggacacatcaggttatatatgaccctgtctcctttgttcggtgtactctcgtgacaaaactgctggcgagtataccctttctacaaaaaataaaaatggccttgctaaaaaaattaaatttatattcaagtgctatttctttacaacatcaaaaaacaaacatttctaacaatcccattcctcaggtctgtatttatgtctatcataaagcagagactttttacactctactgaaagagctgattcactcaactgtaaactttgcatgggcagaaacatgtctttttggtctcttgagtctccagcatgtggggtatctgtcacaaagtaggcaatcaatacatatttatttgcagaatcaagggcaggatgtggacaagtgctgccacctattgggagaaactttatttgactctaaggatttggactatggttatcacacaaggacgaaacttgatactctctctcatctaagttatcattagttagaccctctatggtagccagcctccaggatggcccgcagcgatccctgtctgttggcattcatacctttggctggatcctctcacacatagggttggtttgtaaatatgacaaaagccgtatgtgacctctggagctaggtcataaaagacattgtggcttataccttggtctctctgggatcacctgctctgaaggaagccagctgccatgtcatggggacactcaaacagccctatggggaggttcacgtggtgaaaacaggtctctggccaacagtcatgactgtgccatcctggaggccgatcctccagccctagtcaataactgctgccctggcctacagtttgtaatctcatgggagacctggagacagaaccacccagccacgcatccccaaatccctttacctctaaaacctgtgggacaacaaatgtttattgcgttaaactttggggtgattgttatgcagccacagagttctaataaactgtcggacatagattactggctacaaatagttctactttttttttgagacagggtctcgttctgtggaaccaggctgaggtgcagtggtgcgatcacagctcattgaggcctcgacctccgggctcaatcgaccctcccgcctcagccacccaactagctgggactacaggcaggcgccaccacacctaattttttgtattttttgtagagatgggggggggggtttcaccatgttgcccaggctggtctcgaactcctgggctcaaacgatccacccgcctcggcctcccaaagtgctgggattacaggcgtgagccaccgcgcccggccaacctaaggattaacctaaggcttctcagagcagatgccgctggaactgagggccacggaagaaagggggtgacacttggtcctggggagtggcgactgtattgtctgtctgcagcatccctatcagcgctaccgttgttccacgcacacagggagtaagtactgggagtcccagccaccgccgcggaaaatctgggatgccagcgagcggccgcatctcggcgcctgcgcactgtgcccgcgctctcaggcagcgccgttgcgcgcggagtcatcgatcggccgaccccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacaggtacgctggggccggggctgggcggcccgcggggagtggggagtgcttggggtgggtgcagggcgggttggcgtcatctgtgggctgcaggcgcgggcgtggccgggcgataggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcggtgagtcatggcttctggttttgcagtaaacggaaccagggagaggagggaacgcacaatttccacaactggttagatttcaagttggaaatgatgagcttggcttgggttaaacctttctggactgtgaggggtccgagttaatttcttcagctgttggagtatttcaatgaaaaagtttggaaattgctagaagttaaaaatctgccctcaatccgaggccaccggtagcttgtatcgctgctgtgaagcggcaacaattttagattctgttgtgttcatgcgccgagcaccgcggtgagcgcttggacttcgccgccgaaaagttttagaaaggacagcgtgtaggcgtgtttcagaccatttcattttcttgggtgaaatgttgcttttttgctaaaactgaggcaaacgttgatcttgagagcttgcagtttgggggcagtaaagttgagaaaggatcatattctgttattggtttgtgggactgcaggtgaagctgctttgtttccctaaaagatactttttggggacaataatttgggagtaaagcggcaaggtaagagtggtcctcttcaaatactgagctagtgaatttgaaacttgagtgtgctaaggaaaaatgaaaaagatgttccctggggatttttaggtgaattcttcaaaacaaaagcaaaccttcctacgttttcaccttatttttagggaattgggtaaaatgaggccgttattctgaacttctcgccctttcattttcctggttaagacattattagattgaaagtaagcctgttttcttcctgattaaaaaaaaaaccctaaataagatactgacataactccttttaaacattatagtaagtgacatgcctactgttatttcttgttgttaaacctgtgtgttttacatactggcatcgttaccagtaggttacgagtagaagattgaataaatcttcaaacttattttttaaaggtattaccaagtatatatatattttattatttttaaattaggcagtcttgaaaggacgtgaaactcaatatgactgcccaaaagggcacgttggtttctctttcagatttctttttacagttgaggctggttacctggacagaatttaagcttcagcttgtgaaagtaaactcattttttctgaaagtatactcattttctaataaaggtgcagttttaaaatatgtccatgtgatattattttaaaaatatctttactgagcaagtggagctaggattgtcatgaaatgcttttatttgttttgtttttgttttttaagagaaaagtgaaagcaagtttattaagaaagtaaaggaataaaagaatggctactccataggcagagctgccatgaaatacttctaagaaggctggagtttctagaatttcatttcctggaattaaatactcctcttaacgccccaatttcagaggtagaatcctggaaaactatatattactttagaaatagcttttccctttttctaaagtgggaggaagagctggtatatttattaagcggaccatgaccttttctgcaaacagatacttgaacgtaccttgtactagatactgttttaaaaagcaaccttttgctgtgacaaatgacccataaacacatagttcatttgaggtgtttttgctttttctgccaaagttggggtggtgtttttgtgggcaaatggcagattttcaacgttttgtttatcaaagcattttgaaaagagaagcagggccacttgttttctagcaaacaggaatagcttctatttcagtaattttaatttctctaccaaggacacttcaatcagtaagaaaaaatatatttacgagtgaaataaaaacaagaattatttggagcacttttcaaaatgcagcattgtaagaataagtaaacaatataatttttaaaggacttcatcttttgttaacctctcaaaaaagtaatgaaattagcattgctgagtgtaaatgtttttaaaaatgttttataatgttttgttattgttcctcaccactgtgtgatgaaaaacattttattcttctaatgtcaaataatctgtgatgcagaaagaatgggagtttgttgcttccgggcttatttgaattctgagcttgtttaacgtgggcttttgggtttgcgctatgttccactaaaaggcatcataactgatgatcagtagaagggtgaatttagcttgtcatcatcagtaagagagatgaatttatactcagtcatatacataatactcctctaactttttgtgattatgaatatatggatctggtttttcggaaccattataagtaaactgtcctgtaaggatattgaatagacatccttgatttcacgctcatctcttgatcttcccaactagtgtttggtggttgcatttatttcacaagtactttatttgccagtgttgaagatatggtttgaactgttcagacaagatcgctgatcttatgaaacttaagttgtagtggcagaggtagggtagacagatcatagacaagtaaatacgatgttttcaagtagaacataacagaatagagagcgctggagtctgaatgaaaggcatctctgaagaggtgacatttgggctgagactggaatgatgaagaggagtcagtcatttgaagatctggaagaacaaacggagaggcccgaaggctgcaatgaagttgatctgctttttggaacggatggaaagctcatgtgaatagagaacagtgagagaggatggatggcacaggatgcagtaggagaaatgggaagaggtcagacgttgagctttggaagttaggttaaggattccaaatagaagctattggaagattttaagtgaaggaatgatgtgatctaatttgtattttaaaggtatttcactgaatcttagttgctgtcacttgtaagacatattgttttatgtaacagcaggggaaaatgctgtcaattgatatgtcattgattttaggaagtatcttaatttcaaagatgtcaaaaaaaatttgtgcatcttagaattgaggaaagcatggattagtgatagaggattactgtatcccgtcccccaggtggagagttttagccattagaaatctatagattaggcattcattgataaatacttttgataattttctcaaaactataagcttgatagggtaatgcgtgcctatagtcctagctcctctggaggctgaggtgagaggattgcttgagcccaggaatttgaggctgccatgagctgtgattgtgccacttcactccagcctgggcaacagagtgagactctgtctctaaaaacaaacgaaaacaaaaacaaaaatgtagctggacatggtggcttatacctgtaatcccagcaacccaggaggctgaggcaggaggattgcttgaggccaggagcttgagaccagcctggacaacatagtgagaccttgtctcttcatcacttagttcttctagggtcatactgtgtacttatgtatgcttcagatgtgctattgaaggtattagaagtaggtagttcttactatgcttatctgtctttcttggcagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatggtgggtattaaacaccaatatatcaaatagagtaggtgataagtcatattgaacacctcagttgaattctgttccagtcaggataattatcatcgatagattgcacattttatatatatttttttctttttttttttttttgagacagagtctcactctgtcaccaggctggagtgcagtggcgcaatctctgctcactgcaacctctgcctcccagttcaagcgattctcctgcctcagcctcccgagtagctgggactagaggtgcacaccaccacgcccagctaatttttgtatttttagtagagacggggtttcagcatgttggtcaggatggtctcgatctcttgacctcgtgatctgccctcctcggcctcccaaagtgctgggattacaggcatgagccactgcgcctggctgcagattatatttttatagaatatattttttttaactgccaaatgcctgtaccaatatggggctggcatcccaaagtacctagtgtctgtctgttttgttcacatactctccttcagatcagttattccttgacttctattattgttcctaagctcatgattcctagccttgcttctctgatctggtccgctcattaaggctatagatgtggtctaattatttccagatgacttgcaggatatttatacctggattttaaattgtcattgcagactttagatgttgaacataaatttggaaatatgtgtgctcagttcccttctttgtcagtggcactgctggttttctgtgatttttgactccttaaatctagcccattaataagctttgtcagttcttcttttccatttcgggttccatggctttattcctcagtctgttttctggatttgccttcttcctacatggttctgatgctattgttcccttgctgtctttcataactctatctcataaacttgtgctcataatttttgagctgaaaaagacaatatatctctagttcaaccctgtcattttacagaagaggaaaatggtgtctgtcctcctgtacctagtgctcaaggctttctgaaaagttactccactcaacttttttagggctagtttctgttcttccttcctttaaactgtcatctccaatcagaacagacccatcattttcccccgcccccaccaaccagcacattcacctgcttgcatgcatgtgcacacacacaacctggtgactacttttgtgactttgctcttgctgttcacccagactggaacctgttacctttcctccctctctagtctatatttctacccatcttcctaagcccttgccaaccatagcccaatagttttctttaatttctttgtattgattatctgattatctttattgccttgtacatgcctcctcatttttcccaccttttttttttttggtgacaggatcccactccctcacccaggctggagtgcagtggcacaatctcagctcactgcaaccctacccttccggggtcaagcgattctcccacctcagcctcccgagtagttgggaccacagacaccaccacgcctggctaatttttgtatttttggtagagatggggtttcaccatgttgctcaggctggtcttgaactcctgacctcaagtgacctgcccaccttggccacccaaagtaatgggattacagatgtgagccaccgtgcctggcctttatccgcccttttaattttttgaatggtgcaaatgatcacctttatttttttaataccaatacacatgccttcttgttaattggtttttgtatgtatgcttatcacctcaatttaattgctggccttaaacatttttgagtataagtattcatggtaacttgtcatggcattaagtatagacatattaaaaaatactttttaatagattggtaaattgtgaaaattatgtccagatatgtggattttaatttatttttaaagttattgttttatctgtgtgtttctgcctcatagaggtaaactggggaatgagtaagaatatttcgctgtatatttaaattatatttctgagtcttttttgctgatagacttgttctgggatgacttagtaggggccattacttttacttctgtgtacttttaaagttgtctagtaagatgaagcttttcacagtatttgtgatagtttgctagtttccttttggaaaattttgagaaattaatgttgcctgaagttactaatttcagttctaagattttgcatattgttttgtattccaagacttgtaaagggtgacaggaaaatctttagagtatggaaactgagctcaagatctcataaataatgctttcaagtacatcacactctgtaatgtagaatggagcattagaaaaggaaaatagatgcgtaaaacttgaaaccataggaggtaaatttactcttgtaattaaatatcagttttcttatttcatcatatttgggaattcatcgagtgcctcttgagtctttaatgagaaacgggtagcaggtatcagaacctaatattagctctcatgcatcttagtcacttgttttagtcttttgtaaatgacatatggcaaaatgatctgtttagagaggtgtggtgctcacctttttttttttcatttttacacatgtgaagaatttgataaatattcatatcagaatagctcagagaatgtcagtggttcttatggagtagtagtaaggcttgacaagcccagcaggggattttgatatctccctctcatgtactcagcctagggtaccctttttcatttttcctcatatattctgtcccacacaactgccaataagtagtaaatggccaaaagttagacatagtggtaaagaagcaaaacctatgtttcatagtttagcttgatgttaagtggtttttaatgtagttgtttctgttttcttaggaaatatggaaatatttttgtgccatacctcctttttgggtaatgtgacttgtcattggcctttaggttttaacaggtgactttggatcttttccataagccctagggcttaggtcctcagagattttggaagaacagctgtcacctccggctcccctccatttctccaaccttttacatatactgtgtaattttaatttcctttgccccttctttaaacaaaccctaaaaagacgaaacgtatgctttgcattaagagttgggcatatgcctaggaaacaagctttctgagcaaacttaatataggtaacttagttttttttgaagccatgtattacatctcaaagccctgaactgcaagtttagagatctgggttcgtttcaaatttttattagctggtaaccttgattatgttatttaatctttctgatttataattataggatctataaaaaggcgatacctgccatgcctattttataggattgttataaagtgcaaataagaaaacattttgaaaataaagacattatgaagttgtaaggtattatccttcagcatttgttcagcaaacattgaatacctgctatgtgctaggtactttactggggttacaaaaatgggtgacatgtagtctggttttttataaacttgcagtcatggaaggatgcagatatgtaatcagaaaattgcaatacagtgcagtgtgataaggtgcagtaatcaagcccgttgcaaggcagagttgtggtctgtgttacctcttttgaagaagtggaaaatactgggatgagtaagaaggcactggcagaaagtgaacttgataatgagtcagagatcaggtaatgaaggactttgtatgctaagggatttagaagtttggtcttcatttgtagacctgcatttctcagtgtcctctgaaaatctagtttcatgagatggtgtcacagggatgttgactgctgaggacggaggatagtgttttttggtaaagtgttaggcacacactattattgttattagactcctcagtgcttatataatgcgaatagtgtattttgtgaatatggagggtgaagttaggtggctgcagcatgcagtattttccacacttattccgtgtgcaccaccttttttcctaagaacatctaaggcacaattgagggaaatgctgtttatgttggggaggtactggtgaattttaagctgcgacatagtacatgatcagatttttaattgtcaagaaaattctggcagcagggactggggtgtattggaagacaagaaagttgaagaagggatacttgcaacggaagctcttgctggatgtcgggaaataaatgatgagagtttgaagtgccaatagagcaggaaggggcaaattttagacatatttaggagttagtttcagggaactttgaagactgatcagatgtggaacaaggtttagttagggagggaggagtctaggatgatttccaggttcttgacataccagctagaattaacagaggtaaggaattcaggatggaagagtaggtcgcaggcttatttatttgtaaggactcacttaaaatgtctcccatttctgaacccaatgatgtactttgactttcagcacttagttcactttaggatacaaaaatgtatagtgtaaaaataagtctttaattaattcattgttttgttttcctttttcagttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcaggtaagtactgcaagcaaaacacagacatcttatgattgctcatacatgtggatggttcctgctctcaagttgcccgtagtctgagagtggcagagagagacaaaaatataaagcactgtgctatattggtgaagttctgggagaaacatactcatatataggatgccaggaattcatggaggagaacatttagaatattgcttctcaaactttaatgcgctttggaatacctggggaccttattaaaatgcagattctgatttagtaactgtagaatggaccgtgaacttcttcatactcctgcataataccaatgttgctggtctgtgagccatgttataagttacaaagatacagagtagttcggtgatcagtgcacacctgcagcatgccatgcactgacctagaaattaggatataaaaatattgggatatttcttgtcttcaaggagtccatacatagaggagagagatgaataaaaagatactcagaaataacacaggtaaacatagataataatacaattgaagtgtaatggaaatatgaatagaatgctaggggatgaaaggaaatggcaaacaatttttctttgaaaaaggctttacggaggaagtgatatttgagccggagttttaaataatcatatggctttgctaggagagaagtgagtctttgaagagagagatcaatccctgtttccatgatgcagttttacctatttgaacaaaaattttgattaaaagtgttctaatatattatcttatacaatatggttatcctacaatataaaatatattggcaatgttaatgatttgatgcattttattaagaggactgtgtggagtgattatttcaaacaagttaggagtcttttggatttttaatctttttgagagtaacacctttcttcattatttgtttccctttcatttcgttccccagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatggtaattggatagcatagtcatggttgctggtttatggattcttagacgtttctttccaaatgttttatagccacttcagtgattggctatcatgatacagttgtgagtccttctcaactgtatttaattcctaggccactgataacatgtgtctggaagatcatggaatatgaggttgttgagttgtttaggccagcacccttcattcttagggcatccatttttttgatgtcttaatctttgtaatattttgctctgggggataatatttaatattatccaatattatcagtatttgataataggagtgaaatgagcctattacacatgaactccttggagaatactttttctttatgcctgtggatggctttatttttttaacgaaggtcttgaactgagacatggggagctagacctggggtcaccatttatccaagttggcatccctgtgaccagcaatgcacaacaacaatgctaagtttactggggccttagtaagtatgtgttttatttgctgggcctcccccaacaaatgtcactctgtatgaataacttttcctgtttatttttcatattaagaaatttcactggaatagcaatgcattccatctctgtgttttagttcaggtaccactttgtttcatatcaactcctagtgttctgtcataatcacacatactggagatccatttgaatgactaggagctttcatttttgttctgttttgttttttgagatttatccttttagttagaaagatagcgtggtaagattgggagggctgcgtttgttgtttttttattcagtatagctcatctttttcgtttagcaaaggcagttgctttggtaagccttaggtcaaaggtttaggtcagaggttttcagtatgttctgtagctactcctttctgctgagatgaaagttaggtagaagccctatcaccacttaaaccttgagcagcaaaatgtttatctgtttcatttattgaagttctgtgtaagattctgtttgaaaaaatgttggtttttttttttcctgctaaaatctattttgaaagctactgactcatgccatcttgatctttgacatgttggatagttctcattcccctcttacaaagtttcttttttcttttttttgagacagggtcttgctctgtcgcccaggctggagtgcagtaggcagagcatggatcattgcatccttgacctcctaggctcaagcagtcttcctccttggcctcctgagtagctaggaccacaggcgtgtaccaccacacctggctattttttattttattttttgtagagatgaagtgtcactgtgttgcccaggctggtctcaaactcctgggtttgaagcaatattcctgccttgacttcccaaagtgctgggattacaggtgtgaaccatgcctggcctcttacgaaatttctatttctttagtcataagattctttgaaatgttatttaaaagtctcaaaactaggtttaatagctttggtggtacttcacatttgtcaggacatgactgtctgatgacactaggacctagcaatgtctattcagcagttcatcataattagcaaatgtagcttttactttggcattcttgtacacagagtgtcaacagtttctgccttcatctaatcattctgctacatcacatcataacttgcaaggttggagttaccaaatagtaaatgtgtagttgcaaattttgccttgattttttataaaagcacttaatgacgtgtataataacctctattcactagattcaggatacttaatataaaaagaataactgctgaatgtcttgatgatttcctaatttctgatgttttgtttctttactgttcttggcaaatcagctcttggcagacttgcatggcagccagccgttccaggattgattctttgaaaaggagcagtgtgtctttaaatctttccttcacccaaggcatcctgcttggtgcacatgtgcataagcacatcactgggctctttcatggaatgagatgaagtgcgcctttgtatacatgattaaaattgaaccctctggtgatgtcaagtatatttatcctttgggtctggaagagagatgatgctgtgaaaactagcaagattattttaatgaacaaaggaagactcattgccaagggttaaataaaaaataaatggagtttttagtgacttcattagaaataatgattttattgtgtttagttgcctctgattaaccttgttgcatatctttaagttactaataagctgctgcctagtggattttatataaagatgcttactgtagtttttaaaggtggtgttgtagagtgattttacttcatgtgatgccaggtttacacttttgaacttgctatcagagaaagaaataggcgaagaacagtttgttttgtataatgtgtccttagtatattaggagctaggaaatgcaagcccatactaaaaaagaaaggcagttgatgaagtgacagaattctttatcatctttcttttgtttatttacagctacactaaaaatcaacaatgagattagaagtgtgaaaagattgcagctgctaccagaatcttttatttgcaaagagaaactaggtaatacaaacattatttaacttttggggtgaaactctgtgaaattcatataagaaaaaaatctgaaagataatgttcaaaagactgaaaatttctatatgagattaaagcatattgaagacaatgtggtttgtttaagaatgcaaaggtttaaaaaatgtgaaagttttgcttataatttgaggagtttgtttctttcctgtttttcttagggtcatagtgtgctgaattatattgttatgagataacactagtatgtaatttattacactctgatgatagttcatagtttctgtactaatctttggagatctccctattgagatctccatattggtatttaaccaatatggaggggatctgtgtttcatgaaagtaattcaatgtcaagttcattattgaagattattggaggaaaaactacaatcaaaatgtttgtttaaacctatataaatttgatggctattttatacagattgatactttaccaaaggtttgcattctaggtaaggttttgcttaaactctataaaattattaatagatacaaagaagacaggttttcccttttatcatttttcagttaaaccaaactgtgagaggcagttataggtggttggagcagaagagataaggtggagaggggaactgacattttttaagtgcctgtttcattctgtacttgtgcctgtacatatgttattccatttaatcttcttagtaaacttaggagggttttaagagcctagtgggaatgttgtggtacaatgggaagatggcatttatagcagtcctttaggaaaggctggctagattgacattgttgctttgaaggcctaaaggcttattcttgttcattcctaggggagatcagccctgagagattgacttatactaactaaaactgacaggaaaaggagatagcagaatacatatttataacggtctctgattggatgtagagtcagaaattgggaattagctgaattgaattttttttttgagacggagtcttgctctttcgccaggctggagtgccgtggcgctatctcggctcacttcaacttccacctcctgggttcaagcaattcttctgcctcagcctcctgagtagatggactacaggcgcacaccaccacgcccagccaatttttttttatttttagtagagacagggtatcaccatattggccaggctggtctcgaactcctgaccttgtgatctgcccgcctcggcctcccaaagtgctgggattacaggcatgagccactgcgcccgaccgagttgaacatttaatgtcagactaggccagagtttctcaatctttttattctcacttcccaaaggagccgttggagattttcccctcaatctctctccttcatgaaatttcataccacaaatatagtatgttttatttatgtactgtgaccctttgaaggatcacaaaccaatataatagtttttctttttaacccgtcaaggaccagtttttgcccctgttggaaatgcataaactggactgatgaattggtatagatggcttttatcatgaggatcagaaaaacttgaaattccttggctacgacactccatatttatcaccgtatagggaggaccttgttatggggagtagaaacactctacactttacagcagtagaggttttatgcccattttatagatcaggaaacagatctagaggaggctcacttacttaagggtcacagagccaataaatggtgaaatacaggataggaatagatttggctgactcccagccttttaaaacaacttttacaggaatgtagctcagattgttattctttatctggtttctcttaaataaagaaaaatgaaatggaagggaggaggaacattaaatactgttaaattacaagtttatggactgttataatgaagtatttttaataaagtcttatgttgagtaggaatatgctgctcatttggcaagtcattttaatgaatttttactgtggttcatagcacctagtaactataactaggcactgttatttatccttttatttataagttcctaattaaatagttacataccaggttgctgaaggaaaacattcatttaaagaaaatcaattttcacatttgaaaaaagcccttgagccaaattgattttaaagaatgatatcttgacagcaaatttcaactcaagattgcaagtcacacaacaaagatttagacattagctgcatatctctttccttcttcttatcgatcctgttatactgagtgttttatttgttatagatagtgaaatacataaatatgaaatggggaaggagcaagcataaattgcctactgataccctaggcactgctcgtggagctttcaattataacaacgcttatctggtgtagtggtggtgtctcctttaaacagttgagcaaaaaggtgaggatcagaggggcaggttatttgtccaaggctatacacttggtaaatagcaaaacaagtgggaacctcggctgcagtttgctagtgcgtccgtactttactatgagtcacctggggatcttattaaaatataggttctgatttggtaggtctgtgggggcctgagattcagtagttctaaacagttccaggtattgtcagttctggtgatctgtcgcccacatgttgagtagcagtgtggtgactaaaaatgagtgcttttgagccacacggacttgggtttgtgcactgttctgccactaaccatggggccttggacaggctttctgtaccttgacctgtttttaaaatggagatagtaattaggaaagaacttctgatgtgaaagcttgaaaaacgcttgacacaggtgctgatacatagtcatcatgcgataaatgctattaatttaccaggttctaagcgttaacaggagcagttctccactgtatccttagtgcccagaacagattgatagctatcaggaaatcttcgtatgtatgaatctctcacaagtcttttctacaactgcagcctatgagctagagaggttgggcacagctctactaatttgatatcatggaatttttagcttttatatctaagattcagtttcatcaagtcttgcactgtacttcttccatgagggaatttggttcatgcttatctttgtgaattatttgtgaatatttattcaccatgttgattgggtttggcagaaatagaggacagttttttcacttgattttgggttttgattttactttaaaaaatattctaggggaaaatgtagccaacatatacaaagatcttcagaaactctctcgcctctttaaagaccagctggtgtatcctcttctggcttttacccgacaaggtaagagatgaaatactgtcacaatttaaatgactgtaaagaatagtaagtatacttaatattcttggtgagtatgacatctgactgccctcttttctgctcctggcgaaatgttcctcttctaagactaagcttaatattccttaagtgctatttactttatctttgtatctccatgccattttgtacatatttttattgtagtctcttttccatggactataattgttgatatgatttctttccacctaaggttgggaataccttgaaggtagggaatatatcttacttttgtattcttgtggtctagcatgaggtcaggtacataatagatgctctttctctctgtgtagatacatatatatatgtctatatagacatatatttagatatatatgtctatatagacatatatttagatatatatgtctatatagacatatataaataatacatggtctgtaattggatctaagtttttttttttaaaccatttattggaggctctttgcaggcacttagttggatatttcacatgcattcttatttactgctaatgacttcgaagtaaattatgtggtacttattttatagatgatgaaatcataattcaataaggtttataattcactcgagatccttatattagcttctcatttttttgcagttaaaaaaattaaaatctcagtgtcttacagtgaaatttacttctcactcgtgtacatgttgtgtgtgggtttgctttggctgaaggagttgtctttatccaggacatgctcctcttgtagtagaaggaaaggagtgccagtggcccaattatgtgttggttcaacgcttttgcccagaaattatatatgtcacttccactcacgttttgtcagaaaaaataagacaaaaatggccaagcctgatggtggtgggatggggaagtataattatgcgtaggaagtgattgagaaccataatacaatctaccacaattctccaactagtaggtagtttgacttatatgaatagatagtggcttttatttgctctctatatgtagagaaataagtaaaacgtttttggtgtcaagttgaatggtggcatgtctattattacagtagtcttctctgtagttggtgataagggaaagggagtaatgccaattgaaaaacatgtagatatgtctgttggattttgattatttttgctagtggagaatagtatcacaaatattttgaaggtgctaataaccaaaacataattttcattgaacttgggacatattatttttcctttcctttcttggctttgtttctgaatttatctatctctttttagcctgctagacttcagataatagtaatttgctaacacttgagtgcttatgcttggtgtgccaaacattgttctaagcacttaatatgtgttaatacatttacttctcacaactcattgaagtaggtggaatgtaatattaatccattttacagatgaaattaagatagcatttaaataacttgtccaaaggcacacagttaataactggcatggaaacagatataaaagccagtgaattattcattttctgtagttgaatgaagaaattttgttgtattgaataatgtttgagacagaagagaccattggctagtatttagcaattatcatagttatttgatttatattaaaaagcatttgtctttccactaaaacataaagggaataagggcctagagttatatgagttaatagtaattatagtcaagctggggttaaaaatttgttgtagatgatgcatacttggggataattaagagtaccatctaattttctgtcactttagaaaggaacaagtggcaactttgttgactatgtggagaaagccagatgttctttactcagtaatacctgttacttctctttttttccttttagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgaggtgatttccgtaatgacatattcacaagaaagggctcttattgtcttgattactcagctcaccaaaagtttttagttgtaggatttttctgttgcaaatgattacaataaatagccttaaagagactgactctaagcttcatatacctgtgcctgtgtccctaaaactctctcatttttgtgttttgcacaacacaaatcactcattagactaagaagattatttcaggatagagaaatggaagtaaaacaggcttattttctcactagagaccatagtcagtatctgacgtagaaacgagctggcatttctgaactgctttcatggttgagaccaatgtgtaagttaggagagttttgttgacctgttccaagttgctagggtagctttatttctgtatggtcacattatggtgacctggtaattattttggcagtgatgatggtagaacttgtgcatcaggatttcctgctacaaggccaaaagcctgattgtggaacttttttttctgctaccaccattttactacatattagtgttttcagaatgtttgaccctggggtgggtcatgaaatccatttaatgggtcatgttacaaaaaaacaaaacccacaatggaaaaatccatatttattttataaatagtattcctatttataaaataggagtaaacttctatttcaattatgtataggtaggtgtatactgtgttgcaatgtaaaatttttatgtggttcacataaatgtttgaatgatactgctatatgtgatgttaacacataccaccttagtaactgtaaaaatgtggtgggtagatagctcccttaaaaaaaaaaaaaaaaaaaagaatatcatgtagagtcatttggattgctaaaatttttttttcttttaaaatttcaaaatgtgagaagtgtaaatgacctggtttgttccttttcttcttctttgattcctgaggtcctctttctgctttatttatgcccctgaatttgacatttaaaatgttattttgtcacaattggcagcaagaaagcatcatctcaaaaaataattcaattttatttatttgtgtatttttgagacagggtctagttgtgttgccctggagtgcagtggcgcagtcatagctcactgccacccccaactcctgggctcaagtgatcctccctcctcagcctcataagtagctgagaactgtaggcatgcgcccccacacctggccaatttttgtttgtttgtttgtttgtttttagtggagacaaagtcttgcagtgttgctcaggctggtctccaactcaaaaaagaattgaaaatatagtaaaaaaagaaaagacagaatgactgatgtatatggaagcaccgagaaaaagcagagtatgatataaatacttataaaagcaacaaataccctttcacttgtatattcaagtttaggattaaagcacaattattctttaatttttagattgtggcccacaagctcatttgtaagctgttcagatttttctgtagataaaatgttacggagctagagcttttataaatcttacttccatgctaatgtagtaacttgtagagaagatatcatcttttattcaaactcttttgtatacttaaagttgaatgggtttctctttcctcatttcacatatttcaaataaataagtacattaaaaaatacttagttatggtcatgcttctgatagccgagtcattcaggacatcgttgggagaaagtagtgtaaccagaatatggatgaaagcctaagtcagcttgacctccagtaatgaacgtgggctgtaacacagaagctcagaggttgttgcccagtttggtgtaacgtgagatgttggattagaagcaggtgacacacctaaatgagattagggggagaagaggtagtgtaggaccagttaatgcaggaagagagtagccacatgttcctccatagtccctgaggaatcacactgcattgaattaccatgtagcacagagcagcaatgatcacccttaaccatcaataaagtgtttgaattagataagaaagtacaaatgatatagtgtgtgttatataaatggttagtttttttttttttttatgcttaacgggtaagtttcacttttcttaggagaaaaacaaaacccactgtttaatgcaggacgaatgaaatgtttttaaatccttatttttcccttttcctttgtagacaatactgtcagagttcaagacacagattggaaagaagtaggtatttttaaatattaagactaatgtccataacacagaaatgactagtgaattaatatattaagggtatattttcacttttatatgatgtagtgaaatctgttttaatttattgctaaatttcagtaaatgaaaatgttttcaacttttactttagactcaatccttattataattatatggaaaaaaatgttatcattgtgttatttttcatctttattataaaacattcttttttgcaacaaaatttaaatgagttgtctgtgctggagtagtcatcagctgttcagctagttaagatagtaccttatgaaaagaatatattgtattgtttcataaggtactattctaatgtctctataacaaaaactgcaaggtggagcagcaagtgctgatggaaaagctgctgcaagttatccagaagatgtagctaaaatcactgatgaaggtggctgcattacacaacagattttcagtgtaggtgagacagctttctattggaagaagacgccatctatttcatagctagagagaagtagtcagtgcccagcttcaaaggacaggctgactcttttgttaggggctaatgcagttggtgatttttgaagccagtgcttgttgaccattctgaaaatcctagggcccttaacaattatgctaaatcaggccgggtgtggtggctcacgcctgtaatcccagcactttgggaggccgaagtgggcggatcacctgaggtcaggagttggagaccatcttggctaacacggtgaaaccctgtctctactaaaaatacaaaaaattagccggatgtggtggtgtggacctgtaatcccagctactcaggaggctgaggcaggagaatcgcttgaacccaggaggtggaggttgcagtgagccaagatcgctccattgcactccagcccaggagacagtgtgagactctgtctcaaaaaacaaacaaaaaaacaacaaaaaaaggaattatgctaaatctgtgcctttgctctgtaaatggaacaacaaagcctggatgacagtacatcatttatggcatggtttactgaatatttcaagtccactattgaggcctactgcttataaaaaatactccttttaaaatactactgctcattgacaatgcagccagtcatcccagagctctgatggagatgttcaaggagattaacgttttcatgtcagcaaacaactgcattctgaagctcatggatcaaggaataattttgactttgaatcttattatttaagaaatacattttgtcaggccatagttgccagagatggtgattcctctgatggatctggacaaaggaaattgaaaaccttttggaaaggatttagccttctagatgccattaagcatactgaggattcatgggggagataaaaatatcaacaggagtttggaagttgattccaatcctcgtggatgactttgaggggttcaagacttcagtggaggaagtgcagatgtgatggacctagcaagagagctagaattagaagtggagcctgaagatgggactgaattgctgcagtctcacagtcaaacttgaatggatgagaacttgcttcttacggataaagagagaaagtggtttctttttttaaaaaaatgtcaatagtttttggggtacaggtggtttttggttgcatagatgagttctttagtggtgatttctgagattttagtgcacccgtcacccaagcagtgtacaactgtacccaatatgtagtcttttagccgtcacctccctcccagcctttccccctaagtccccaaagtccattatgtcattcttatgcctttgcatcctcataggttaggtctcacaagatttggttttccattctagagttacttcacttaaaataatggcctccagctgcatccaagttgctgcaaaagacattatttcattcctttttatggctgagtagtattccatggtgtatatatgccacattttctttatcagtggtttcttggaatggaatctattcctggacaacaaaggatttcgaatattacataaatttagttgacaaaacagaagcaaggtttgagaaggttgactctgattttgaaagttttactgtgggtaaaatgccatcaaacagcatcgcatgtacagagaaatctttcatgaaaggaagagtgagtcaatgtgacaaacttcactgttgtattattttaagaaattgccacagccacttcagcctttagcaaccagcaccctgatctgtcagcagcaacgaacatggaggcaagaccctctattagcaaaaagattgcaacttgctaaaggctcaggtgattgttagcatatttttaaattaaggtatgtacattgtctttttagatacaatgctattgcacacttactatagtgtaaacatagcatagcatttatatacactgggaaaccaaaaaaatttgtgtgacttggtttattgcattggtttgggactaaatccacaatatgtctgaggtgtgcctatagatctttactatgaaagcaaattagaactaaagggaaacatccagatcacttaccttatcttgttcttttatttttcttttttctacagctgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattacatggtggtcttgacttttattacagaaagatatgtagtaaatattcagaacagatacacaatgttacttggacatttcagaattatcagagaacatagcataggcagataatttttgtaagggttttctgtttgtttgttttttttttttttagcagcgctctgtcttctaataaaggcctgatttatgaaatgaatgaaaacagagctagtttggttgaactggacttggggtgggtgctttggctacacacctactcaaatccacctcttctctcgacttctctctctctgcagctctttcttgggttctgtggtggaactttctgggctgtgaagcaatgctgttgaaaggccatttggtattagggactcctgtttgtggctcctgggatgaggtggttatgattttgttttccttgtgttttgaacacttagcccctaatttgtaacttaagtagaagatacctttttaaaaagttttactgctttgagtgctaatcaggtacttgttcttcaaagatagccttttatttgaagaacattttgcttttcagacttaaatacacaaaattcaagatttattttttctacaagaaaaaggccaaacacaaatgacttacacaaacaactgtagaaacatgctatagtgacaatctgattcacaacataggaataaaacactactagcatctacagaaaataggaatattgccaatgtcttcctgcttttttaaaaattctgttttgcatataaggaaatggcttggaatgttatgtgctgcaagaatattttgagtcctacatacaagtgaatttttttttttgctacacatgtatattgaggttttttttttttatcacagtgaagaaaatgcagtgaataatacgattttcttgaggcctgttacttttagtagcttaatgtgtagtaaagaattggagttgttgacatttctttctgtggtattttgtaatttctgagctacaggatagccttttaaaaatgtgttcactagatgccatatggctttaattgggtctaacaaggtcctcctgaagctttgttgggtccatatactagttctctgatacatttctttgtggctttgcaatgttatgttgcactatgcaggggatgtgtgtatgtgtgtagtgggcgtgggaggacatggtgacgaccagaagcaccaaatactataaaacaacaagtgttcagaatgcaggcttttttgagtggcccttgagaactccatggatggtgctggtgtcctgtggatactggtgctgctttccatcctcacctctgactaacttgcagacattacagatctcacttagtttaggatatcagcagtggcctaaacctaaatttgcagatctctcacaatagtttttttataattcttaagacgatcctcaaagcatttgctcttgaaaagctgaatttatggttagaagcttgtgaaatcctacattcttgtcattaaactgagactgttgagctgtatgtattgctggtgtataatgagaggaaagtcgtagtttcacagtagcctattcactgcacaattttctgagatcacctggatgtattgtcatggaagcaagcaagagagtttagagtgccacagcaagcaaagcatcttagtaagatgtggttcaacatcactgatttgtcctatgcctttctgtagccccttattccccccaactttttttttttttttgagatggagtcttgctctgtcgccaggctggagtgccgtggtgcgatctcgactcactgcgacctctgcctcctgggttccagcgattctcctgcttcagcctcctgagtagctgggactacaggtgcccgccaccatgcccagctaatttttgtatttttagtagagatgaggtttcaccatgttggccaggatggtcttgatctcttgacctcgtgatctgcccacctcagcctcccaaagtgctgaggttacaggcatgagccgctgcg

SEQ ID NO: 16739 - DNA, 66213 bp, Human; identical to SEQ ID NO: 11803

SEQ ID NO: 16740 - DNA, 14952 bp, Human
agggaatgatccttttccagtttgtcatgatgtgtatatttcattctttttactaatccagaaactagctgtcaaccgtgatccaacagtataattagttcttaggaattcctctctcacaggtaactaggttttacacacacacacacacacacacacacacacacacacacacacaactttgcatttggatttaaatgttcaggactccattgttgccagatttcctgtctcaagactatcaattcatttgaataatcagcaaaatcatcagcctcctttcagcctctaaactggatttaaaagattgacgtttcttaaaactcaaatcgagtcgggctgcaactgcatgcccagagggacctgaatcatacacacactggataatgaaatacacttagattttattagtgggtaattcatgctcagaatcttggaacaataatataattaaataaacaactgggagaaggaaccagataagtcaggaggtaaaattatttagctaaagttagaatggaagtaaggaactgcatttcaaaattttgaattcagccattaacttgtggaaagagaagagatagagaaccaagtaccaggactggcaaggaaggagggcaagagtctttcagcagtaatgtcatcaatgcagtaggcagaaaggttgttgttgtatgtgtgtttcttgtgtcaggaatcacagaaagaggtgcatccaattcagggtgtgtgaatgcataaagatcatcaacactttctcattaatgtcccttaaaagttaatcactttaaccccacaattttctctcacttcacacaaaatcaaataaaacgatatatatttttcttttacaaaaggcagtgaaaaagcggttaaagcatggattaaattgaaatttttcagtgagcctttgacattcaagaataactcagtcacttcattctactgattaagtattgcttttctttcatggagataaaataatttctcatactcaagcaaccttcttgatcctcatttctagaggattctagaaaacagcaaatggagcacactgagcctgcaactttggggagtggcaggacagagtggaaggggagaggcttgtagctgtcgtttcaggacccttcaaaaaagagctctaaaagaagtggtgggagctttaacacattgcagagtactgtctcccaggctgttcacccttctgaaggggggttcctgaagggcaaaggctggtctgattacatgcatctttccagagcctctcaccaggcctggcgccagtggaggctcaataaatgtttgtggaaagatggggtggagagataaagcataatataaatatgaatgggtttcttcagcagaacttgagacaatgggaaatgggagaccctggtttataggtggaaattcccaagaaatgagaaaaaaaaaatcaaggcaaaataatgcagttgatagagcaaatatttcctcctctacatcaacttttggttagcttcacgggcgtgtgcacgcccagggatagggagacaactttaggactatataagtattgcccaaaatgggattcttgtgtttcagagactaacttcaaggggagggcgccatggacagagctgtaaagatctttcccgctttctatgaagagggcgggcagagcgtcagcccctagaaaactacatttcccagaatgccatacgcaggcgggagagggcatgaacagagccttggcgcgatgctccttgggaggtgtagtttccacgcgtccagctcgaacgctgatgccccagcgcggtggtaaaatgagcccacgtgatcggaaaagcagcggtttccctttgagccggaacaggatgactgggttgaccgatgctgggcagctgagcggaccaatcggccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaaggtagggaggcgaggcgacggtgtgcgggagcgggctctccagggacttcccgggtccgcaactggcagggccgttcgattcgcaggggatcccgtttcgtttctgttgttttccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgtaggtgccctcccgccctgctcctgccctcttactgtgttaacgattctccacgtgaggagcgtttcttttccagtgttgggtagaggcgtctgtcggtggggttatttggacagttctttagcttttcaggagcatctgccttgaacctgtaccgttttgggttggagacatgcagacattggaaactccgtctccccttttctgttacacgcttgtggagtaactctaaactttctgaaaatacgatcattatatttgcaacaatactgttttggctgccgtattgaaaggaaccgtttaggggaaatgtatgtttaccctcagctagcgtgttggctaggataaagcagccctcctttaatttccagacacaggagtttagtgaccacttgcttttttatgctgttttttggtttgtttaccatgaatagttgagcccagtgcatatcccgagcataaactgaacacttgcttgtagaaataagaatgttgaaaccctttcaaaagttctagtttttaaacggttcaaaactattttataggatccaacgcatgcctggagtggaggactagatcatcaattgaaaatgcatgatttgaacactgatcaaggtaatgtgaccatatctttaccagtttgttttcttggctagtgttcttaagtataaatgtttatgtaggaagagtggttcctaaattgcttagttactaagttgcttaagtacaggtggcttgaatttaggatttttttaatttaaatgataaccattaagttactgattacagaatattatgcatgtatttttgcagtaaagccagttatggtcgccattgtcagtgtttacataaattgacactcaagtatttggcctttattttgtccttagaagtgggctggatcccagactggccagcgtttcattaggattttccactacaatgctgatgttttgagagttcagtttttagaagctaatttagttttcagaagctaaaggtagatttaaaacctgacaaaaaataggcaatcatgtctatattaattgtgtttgttttaggtatttagcaaaatatgtttccgttgcattttttgaatgagtaactagatgatacatttcctttcggttaagtaatttcttagagatccagatatgaaatgacttactcaaatttttttggtgacattggcacagtgttagagattggactggagcccaaatgcatagagctctctagctgaacatttgtttgcatgtgtattcatcagacataggtattctaaggagataggagggtacagagatatgactagagagaagatgagttgagcaacaggagaatggatggaggatggccacattttgtcaaaaaactaagcacccaattagaagaggcttttgcatgaaagctacttcttctgtaacttatactgcaggtattgggttttgtttgccagtagcttaccctgtgtaataagtaagcttgtaagtctaggttctatttgttcagaaacttgtaggggtagggagaaacactgaaaagcaaacgtctcgattttcagtgttacatagagaattagctgtttattctatgaaagtcactgccaaacttcatgaaatcctttctttttctttcttgtttttttttttgagctagagtctcactctgttgaccaggctggagtgcagtggtgtgatcttggctcaccacagcctccgccacccgcattcaggcaattctgcctcagcctcccgagtagctgggactacaggtgtgcgccaccatgctcggctaatttttgtattttttagtagaggcggggtttcactgtgttgtccaggatggtcttgaactcctgatctcgtgatccgcccaccttggcctcccaaaatgctggggctaatcttactgtttgcaggtcaggaccatatattgttcattcctatatccttagcagttggcacagattctggtacatagtagatgttagttgaaggaataaatgagatatagtgagaaggttcaaattgaaaagaaaatgtctattgaaaatttgaaccacagtggaaccaagtgcagtaatgagaggacttcactcccagttctcataaccctttagccatgtaaataagtttcttagcagcattggcttaatgttcaacataaatgttgttgatccagaagaccagagttctccattcatttgtttattcaacagatatttcttgagcacctagcctgtaccagaccttgcactagatacgggcagagatcacagaggtaaacgcagttcctgataggaaatctagaatcaagtgaggaagataacagacatgccactatgttaatgtaatctgaaattcaagacagcctttggtatgtgcaatactagtgagtcatgtgaagtgtgcactgtaaggtgaacagagaggaacggataactttgtagtcatggagagatttttctgtctgtagtagacatttccatggggttggatgaggcaaattcattacagttgaatgaatgtttcttttaattgtttattttaggaatctttagtaaaggtagtaagctagatgttggggttttttcccctttttttttctctatagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtaggctctttatattcattgcaggagttgatggttttggggtgatttttgtcttggtgcatgattgttgactatgcttgttgaatttaaaggtgaaaagtcaacatggggggaaaaaaggttgacagttggttttataaatccaactacatagaaatgctttaatgcaaaagaaaattaactttgggattttgggccaacttttatttgtcagttgttatatttgcttccatgtattgttaatgctttaaatcgcaaaattgagaagcaactcactgccttttcagagaagtcatttagcagactgttcgattgtcttaaattgacgctccatcccaaaccagaagattggatggagcatcacttattttcatttgttatctgaggtttctttgggttgactgttgagagggcaaaatgggttatcatttcaagttcagtaagaaaggtgttttatgttccctggcttgtactgttcgtatatttattttttaatactgacagatgtagtttcaaggcaccttagtgaacaaagctttttaaaaccaaaactttgtgtattattctaaccttttgatctgtatgataaaagtgtaattgagctttccttctgtatcctcatcagactttatcaggtggtagttaattttaaagattgattgtttaagcagtttaaaggtatccctcacttgagtctatttcctcagcgtgaatatactattcaattcctgttagccatcattatttacaatagtgcatccaaagagccattatttttgtcacatcacagtcgaatctactcctggcaagacctttgttcagaataaaataattgcattgtttctagttttgatttatggttgtatgtaacatgttaagaactgtgataaattgctgacagaatatcatataatggacagccacactgaatcaagctgcttattggttcagcaaggttcattatgtcactttttttaatactttctttgataaatgtatatacctagtcagtagcatgacagtggtttcacttgatttatgatcagtggggatagaaagcactattagaagcttgtgtgtcacctatatagtaaagatttaagataaaattcccagtatgattgtaccattataaatcgatctctttctggattctttatttttaaagtttggtactttatacatcttaattttcattttactgcaaacattttgttttctgagtaagctatgataaatcttaacatttctgacatttatatctgcttatattaaatctattgttttgaatcttaattttaattccttatttttcccttggtcacattaattgttgaattttaaggccagattctagagaggggtgggacatggcgttgttaaagctaacttggttcttcagctgatggtatgtggttaacatactagtgattattaacatatggcttaagtactgaatgttgaagagacatcatcttaccttgccatggggcctctctgcattttttatggcagttcttcaggtttgaaaatgctaagtcagattagagtttcttattaattgaaaataatagagcacagttgtgaatcgcaagtctagatttttaaaaagtgactgaacatgatcaggagaatatttttttgccacctttttaatgagttggctacctctgttttgtttccaagtaacactatatttgcaaataaaccactaaatgtttgcttgtaggaaattctatggtttattataaaggaatttttgtggaaagtttaatattgaagaaagacattataaggggaaaaataggggatacactacttttaaaaattttccctaatgttgaacttctatcttgaatgcatagtattacatcagggcacaagaattgctttgtcatatgtcagaccactatcttgtcttttaattttgagtttgtatgccaccaaaggctgctaaacatctaattagtggtggctccctcacccttcctggaaaggcctatttattccatgtaacaactggggaaaaaaaatcaagatttttagagttgcaaaatgaaatattctaaaaggtggttttagaaaaatagttttgaaaatgattgttttatgaaaagccagaaacccattaagctctaccttgaattattttatggctctattatctcatttttgaatttttttttacacttttatgttgtctctaaatgaaacatgaaggctaggaaaaatagtttaatttgttttagtaatggagagaattaagacttcaaaagctcctttacagaattacttagaatgtacattatatgatgcttggtgaagtatggagagcatcatgggtttgctattttatgtgaattacttggtttgaataattgcagtatctaaaattgttatctgtgattggggaattcagtcagctaattttttatggtcttatgatcagatggactttattttggggcaaaatgccattttcaggcaagaaggtgatttttagcaagttttgatcttttttaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcaggtattgaactatacctcctcttctttctggaatttgaaaataatatgatcttatattataatgatttggccactagcccctaaagccttctttttttttttcagtagtgatttagaatttgctgttaggtgtattcttccttgatatttttgacagccatgtgttaacaggaagtgcgttaacccccattttagagacgaccttgatgttcagagagaccaagtaatctgctcaggaagtggtttgaatagaggaggttttctgaccttttgttgatcctggtccaggatgcttcataggtatacagtaatcaaagagcgctttgcagatatttcagtttacaaaatgctgaattaaaatttatatctggattttaagcttatggaatttgctgttttctttttgcctttttgtaaccctaatgcttatggagttctttccccagtttgacaatagaactttgatagtttttttttttcttaaactcaactgagattagagaggcagggcccctcttatgactgactcttgatgtacagggtgggtcaccttccatcatcgctaaatgatattagcctgtttattagtgagctccctcctccctcaagtccttaaagttctaagaggagatggtggtgtggtcaggtgcaataggaattttgcaagaggaaaagtcattaaaaacagaaggtgtctctggtatcttatggctgtcctttggtggttgtagaacttgaagcaggtatgttattctctttgctttttaacctgcaaaggccagtacctcaaatggtgatcacagttcctttttttttaggaaattgtaagtttccatcgaagataaagaattgcagttatgtgaaacttcagagatttagatatgtgattaaaatatgcttacattgtgaacattattttaatgccattatatctaatattttatataggattatttctactttgtaatggaagttaaaaagtaggattttactgacttatatatttcttcataaacagttttcaggaataaatctttttcataccttgaaggattaaaaaatcatagatttcatatttggtgtgttagctcttattttttaagatactgtcatttcaacgaaagatgaaaaaacgtttaaaattgtaaaccacttttgaatgtccctgaaagtctttgtgcaaacctgacttgctgtattaaatgcaagaagtagtatgactgagatggaagactggtgttctagttgatttggattattgatgcccccaatgaaggaaacacaattcttaacagttgttcgcgatgaagaggcacagaacatagaagaatatattttaactgagggaacaaatttgagtctgctgggcaggacaacaaataagcgacactaaaacactttaaatttttgtttaggtttgatgcagtaactagatattttttattgtaatgtgcaaggccctggtacctgtgaggaaagcatgtgatgagtcttattttctttttaaagtcgtcataaccatgttagtacagcctaaacacttcattaaagcctgctgtacttctcatttctgaaataatcactctttagtgtgggttgaatttgggaattagcaccttgtttttggaagctggaatttaccatttttttcctctggttctctcttggcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtaaagtatggcatgctgacctatatttaattattatactatttggtgcttgctttttatggtatttagtgaaaaaaaatctgtacagtgctttagggaaatgtaacttctatgaccttaaaaattaactgttaagagaatggttatttctgtatctggtgttaagaaccattttaactgttttgaaattacttccaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtgagtatgcttcacctgtatttgagccttttcttgcattcaacccaggatttattaatttttctaaattcatgaatagcattgttgatgcctgctcgatattacagctgactgtagggttggagttgatgttatcatgttctcccaagctttcaatatccgtaggttgatagacgtctgatggataaaattgtgcctagttgttttgtagagaagaatgtcaaactcttattcttcttgaataggctctattatttgaatctctggagttattaccagctcattgcttcaaaattaagttgaggaattcaagaataatttattttagtaaattctatttaagatgtttaagaatttgaactgccaaaaatctttcctctccacagaggttgtttctttaatattaacacaaagtaagtgaccttcaggtcttattggaaactcagagtaatatggccttgcctggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtaggtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaatgttggatgtttttgaatgttggtaattaatataatttacttaaaaaggcttgtgtaaggcaaaactcgtcatcacaggcatgttgggggatgacattttacctttaagtccactctccctcgtttaattgtctcctctgatgtgtgttggggattcagtcctgcataaagtgatttgttggagttcagccatttccctcatgcccccttgtgccctctcggtggatcagcagggcctttgagccaagtgtgcagcttcactcaggatgggcagagactatgtggcagcctctggggaccttttggctcagtgctttactagtgccagcgcagtagtgcttaggtagcttgtgcatccccgtgttgatgtagtcatagtccacacagagccaaataacagacccttctgtacttagccatcaaatactaaatcacagtgaagcccttgggaaggtaaataatgtaatagccagggactgatggtattagttctttagtgtgattatgtgcttctaaaagtccctaaccacttggttgaggacagaccataagtttaaaacattgtataagtgaaagaattaatatagtattgttataggtaaccaaattatagtaatgtggacttgtttttgaggtggtgagggagggcttattttgtggttccatctggatgtcctcttgtctctggaaatcaagtgtgcctccctgccatctctacataccccttaaccagctctccacaatttacttgtttatggttatagctaccttttccccaagttacccaggtgtagttaccttggccttctcattggtttccctcacccacattctttaagtgtctcttctgtttatcttttcttcctactgctaccatcccagggccttttgggtgaatgtggcagcctccaatttctgccttaagtcctccatctaatagagtagtgacttttgaaccttgtagttgtgacccaagtaagaaatacattttgaactacagttcagaacacagaggtcagtatattatacatgacagaaggatcctgaaatatgacttgcccttcttgcatgcgatgtatctggtgcatgtgtgcatttttttctttgctttttaagaaatcctggctatgtcaccttgaattgattttacaacaaatgcctgtcacctgtaatttgcaaaaactgcttgatcagattctaaaaaatttctaaaagatttttaaaaaatgtattctgatgtcatacttggaatcctccactgcttcctgttgctcatagtcacccttcagtgatttcataaggaggtgtgctgcttcccaagcttctagatcatcaggaaggggccgcggactgtaaggtgctctcagaagatgggactaacctttgttgggaatataaataagtggatgggatgggaagtgacagcaatatctggttctgagttctgttgtgtaaaaacttaaaggtatattagcaggttagcctttgttctgtgggagatccaggccttgttagaaggaccaaggccagaatgcccagtttagccttagcattcaaacccttcattgtttttcctccattatctgttaaactcctgctttgccaaaggtatcttctataccctaataacactagcttccttccctcagtggggactcaacgcacattagcctactgagagcttagatcactacaacgaatccttgtaaatttgtttaactcagttttccccaaattcatttaagccggttctactttttctggtcttgttcccacaatcattttaccttttaccactcccccagaaaacactggggttcttctcttacgctgagagccaggttactttcttcactatcactccgacgcttgtgttgattcccaaatctcagtctgcccagggtcattctctttctgaattgctctttcaggatttaatttgaatcctgcaaagtcctgttcaaggcccccttttccatgaagcccttcttccttgttgca

SEQ ID NO: 16741 - DNA, 94758 bp, Human
  misc_feature (1)...(94758): n = A,T,C or G
agagcttacagatgtttcagctccacgtggtaagcttctttgggccctcacctgcatatggagccgaagaggtctgttttctgacagagaaacaaacccccagggtgctgagaatggtgacaggatgaacaggttgcaggatccttgccaccaagtgacatccaatgctgacagtgagtgacggcttccccgggaggtgctttccagagcacacctcgtcacaccaccccgacagccaccttccccgcaagattgacataatcattagctattttcatataaatgcaaaagtaaaccttctcagtgtttctgggaaatttcatgctgttacatcccagaaaacgatgttgatcctctggcattctgtttgacactgatactgaataagagcagtggaaagtcagtccccgtgaagctctggaactactgtgacctcgagtgtcagtatcaaaagagcccatccaaacatccttggccacgtcgctagaaaacagtgtattggaggcaattttaaaatgctttgaacaattttgtttttattttcttttgcttttggccacagtttagatacattttaggctcactgccctgtgggtgaagacaagctgggaaatgtggaagagtcttccacttacccatcagaggttccatttgaattcagttgtgagtctgggctgggagcgcaggaagcggttgtgttgaatgtacagcatgaggggatggtggggttcccaggtgtgccccaaacctcctgtacctatacagagatgaactctttctgcagcagcctccagtgaggaggctcaggatctcaagtcttgagggtttctgagcctgccataggccagggacagggatttggctgctgatgggtgacatgctgccagctacagaatggggctggctgggcactgggagcttggtgatggggtgtcacggacattcctacaggcccagcccgtgtttagaatcacagagctgagccgatgcatgtcacggagaactgcctttgccctgtacacgcatgctgcattaggggcctgccttgggcggctcagctggccgcgcctctgcttgtttagggtgagcctttgcacagggcttggctttgtggagctcatttggtggccaaagatggtgttgcagccccagcccgctcgcaggcccagtaccttttgctccctagcttgccccaggccctcagactgtgcggtgcaaaggtccttggaggctagccccgggctggctgtgaggggagagccaggtgccgcagctctccctggtacagacttcagctgcctccaggacccggggcctgaaggaggcagaagccggcggtggaaaagggcgcacgtctctcccagcgtcgctcccgctgcccgctgcccactgcagcctatttacctgttcctccagccatccccttagtcctgggccgggagagaccatttcctccttcctggagggatgagccaacagggctgagccccctactctctcggtggtcagcccgcccgaccaccacgcccctcctttctagggccccagctcccgggccgcggctcgtttgcatttcaaagctacacaatgcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgtaagtgctccgcccgggccgccccgagtctcccggggaggaggagaggatgcccgggctttgttagtgtcgcctttcctaatgcctgtgcaacctggagcccaggctggcctggggttcttcgcagccttggaaagctttacctggggctgctctgggaggagcatctggtagccccaagttactgctgtgggcagaaacgattccctggaattcagttttggtcgctcagcagtgggtgcatggctggggggcttctcctgccgtcagcatctttcctctgcacccccggcacagtggtatttcctgcaagggaacagccaggcatcagcgactgcctcctcctaggaagaacccatgagcgtggcagctccgtgcccggggcgacagcccagtttccgggcagctgcgcttgtggctgggcagatggcgtggtgcgctctggtggacgttccgtctagttagcctaagcatcatccacatactctggtgaacactcgaggacaaggccgcttgctattattagtaaagggccgaaccgtcctgtcattggtggaggcagtgcttgactgtgcatcgatccaggaatccgatcttttctctcaaccacagagctaacgtgctcagaagtggcctttatcctggccgagtgtttattagaattcacgtttctgttatggtcgtctccattacctacccaggcatgtttggacgatggggcgtattgaatgggtctgccggccgggtcgcatttcagcaactcaggcttgtatccaaagtggacctcccagcctcacctgcccccacttttccagagagaagactatgtttcagagaagagtattttctggggacttgggggtaggggtagtaaagtgggttcttaagagtcatggatgtgtagattaaaagatggtggggattgatctgtgtgttgtaggagggatggggccccggggggtacttcctcactggtccctcgacccctgggcttcagtgaggagctggctcggcgtagtgatgtaatgctaggctgagcctcgtggttttctgggctccagctctttagcagggagtcattcttccgagcaggtgtgcacccatcatttgtcttcacccctgtagcttgagaaagcatcgtcttacaatggaggcacatcgcgtttgaggattttctttttaaatgttatgatccttgtgctgtgcctgccttgtttctcatgcacgtgtagtgttgctaggtgcatggaaatacaactcgagtctaggcagaaaagaaccactttaacctattttttgcaagtccctatagtggaattgagttaatcagtgacaggcactggccaactctcacggctcagacctatctagtgaagagcttaggaaacagaaaggacaatgtgactgtacgtttgggaaaatgtgctcctcagtcattggaaattcagctcgccggtccctaacgtccccgccctctttttcagctgagttaataaatgatcagtgttccgtcagctgagggccgagtttagatagcttctgttaggtagctgtgcctttttggataaggtcccttaaggttctgcccactgggatagtggtgtttaaataaaatttcaggctgaatggccacattgtgatggaagctgtttatcaaatattttcacagttgagttggtccatatgcccccgcctgaggcttctctccctagaactgctgcctctgaaatgtctctaaatatagatctttacgatagtatattcactcattcacaaaatcccaccctccatcccgtaacatttttgttctaaaaaaatggagagagaggaaatatttggggccagtgccattgctagcatctgtcctcttcaaaacccgtctctgctctctgaataactggggcttatttttctagtgcagatgtgctctttcccagtctagaggttttaaaaatatatattcggagagtgcctcttttctgcccaggcacaggtctttcttggtagtatttccatgcagctaaaaatgcatgcacgtgaataatacacaagacagcaacagagtgtggggcccatggcaggaaagaggttgcattgtaagatgatgccgtcagggctgcagggatggtgacaaacacagggtgcgcacctgccgcgggggacagctcctgacaaccggaatctagagtgaatgtttccctttttctctgctggttccctgtgaaagactggcttaaggagggccatggtgtaagagtgaaatcaaaagatagaggatttggaagtgactgaaggatttttttttaatttaaattttttagttttaagatttctttccttccaattgcaggtttggggtgcctttgggcagcttttgtagctccagctgacagcttcattctatgcaggagtgcattgggctagggagggagcgacttttgtatctccccttttgagaactcaggcatcaagattggagtagcagaagtcccatgggactggggattgaagcctgaggatgaaggtgcaaatggtgaccagtctcttgctactcccagggtcggccacacatgacagcatcagcttcccaaaggggcttgctagaaacgcagagcctcagacctcaccccagaccagctgaatcagaatctccatttcatccagggacttgtaaagatgcccaggtgatttgtaggcatctcaaaatttgagaagccatgagctggttcagtcttccctccatcctgtccatgagaaacagctggccacttctctgactgctcctttcctatctggcaaagaagttcttgtagcaatagtgaccatttgtttctaaatagaatatgagtagcaaggggagggagaattctcccacagaaaacacttatttctcagtatggatggtaggagacacaggaatggacaggaagtacttgagtaaatgtgggctgcagctattgatcagacctgctgttcatcccttgattctgtggcagccccatgtggtgcggcttctgctaagtggggcagcattaagtactttgtcctttatgtagttggagacccccgtttcaggggttccctcagcttccaccaaatccccacaccctggccactgaaaaccacccagggggccattatcagagagcaaaagcggtggttctgttggcaaagtcggcctgccccgactgttgccctactctcaaagtgagcacgtgcccttggctctaaaaaacaaatcacaaatatggaaacccatactctgtagacctgtggatcgaagtagaggggccagggtggatgggagagaagcgatggaggaggaagcaacaggctctgtgattgatgagatgggggagggaagagaagagacagtggcaagtacaaaatggaagtttcataccctggtaactaagagaaagaagtggcattggccaagacagacaagaaaactggattgggagctagttcggggaagttgatgagttggctgagatttcagaagtgggtgggatcagatgtagctggagagaggccaggcaaaagaaggatctcgggtaccaccgcagtaggtagagagattggagctctccacacatctgtggttagaagtggggttctggtcccttcccttatgtggttcctgaccttttctttgggagctgtagagaaaatccgatgactctgatcctgcccctcctgcctcgcagggtttttcagaggtgagatgccacatctgcaaagactcttgagaagacgtaagtgccagaaaactgcaaaagtggaaatgccctatgcctgaaattgccagcctctcagtcactcagaaggccagaaacggtcgctggggctctaagcaggactctttctttagctctcattagatctttttctttttctttctttttttttgagacagtgtttcactctgttgcgcaggctcatatgtaacagtgtgatcacagctcactgcagcctccaccttccggactcaagggattttcctacctcatcctctcaagtagctgggactataggtacacatcaccatgcccagcttttttttttttttttttttttaaataattttttgtagagacagggccttgctatgtggcccaggctggtctctaactcctgggctcaagtgagccatctgcttcagcctcccgaagtgttgggatcacaggcatgagccagcgcacccagccatagatctttttcaaggctttgtttcttggggcagcccttggctaaatgctttagcttaaacgacagcattcctaatgtgagttgcagccagtttctgagttcctggacggagattttactttggatattactgttggacacaatagagttttttctcccctaaaatagaataagctgcaacattatctgtagagtgggagggggagattgattcccaaaggaagcttgggtgcatttttccctgccattattcctagatatcaccagcgtggccctgtgcctgtgttcataagggtcctgggccttcactatcttctctgggggacttgcctggaggctttctcttaggtgggctgaaggcaaatatattccgaggtcctccaggtagctaccaatcatccaaggggccatgccatgctagggccctgggacagggtaccctgtcgaggatggggtgaacagctaggacttggatactgattgagtgtggcactgcaggtgaacatcagatcaaggtcagtggattctgggttgctcttccatcgaccctcccattcccatccctgtgtttctttccactgtctacagcctgtttctgtggctagatttttggttgcctaggaaacaactttattctgaaacatgattggctgttcttgcagatggattacccaagctagggcagtgttctggggtaagcaagtgatgctgaacaattctgtttcttccctttaagattaatggtgaggacttaggcattgtaagcaattgttctgtgaaaaccaattgttcatggactgatgctttgtttcaggttggacaggggtttaggggagactggttggccacaaagaactgactgagtcagaactgctcacacacatctatcctgtgttggaagcagtagctcagatgacatttctgtttatatttacaaattcactttagcagttgtttctggagtgcaggtgtgtgctgtttaaacgccattgccaaatatggaaacagctggatgctgcagtgttgaagccaggagtgaaaagcccactgagcaggctcagattcagcagaaactcttgtgtaccatgtctgtgtgctaggtttttttcattatagaaataattatatcccttaatcctgcaaggtgggtgacttctatagataaggaaactgagtcctctggatggtttaaattaagggagcagtaaactttctgtaaaagacctcatagtacatattttaggctttctgggccattccgtctttgtgcagcatctctgctgttacagttcaaaagcagccagagacaacatgtaaatccatgttccagtagagttttagttgtaaaaacagactgcaggttgtagtttgctgattcctggttatacggatgattggtacagggctcagacttatgtcccctttggcctgggcaatctttgttttctgttctctctctctaagacatctcatttatgctcatggacttaaataatatgtgccgataatgccccaatttatagccttccctctcatctgagcactgtaattttccttttttttgagacagggtctcgctctgtcacccagactggagcacagtggcacaatcatggctcactgcagccttcatctcccaggctcaagtgatcctcctgcctcagcctcccgagtagctgggaatacgggtgcacgccaccatgcctggctaatttttaaattttttgtaaagacagggcctccctatattgcccaagctggtcttgagctcctgggctcaagtgattctcccgccttggcctcccaaaatgctaggattacaggcatgagcctctgtgcccagccttaattcaatagtttacttcatatctcctcttggatttctcctggatagctcaggctcaacatgtccaacgtagaactctgatgaccatcttcctcttaaaacaaaaacaaatgtgcattcaaacgaacccagccccacccccatcttcctcatctcaacacctgggaccttattcacccaggtgctcaaaccagaaacctgatgatcaagtcttttttttttttttttttttttttgaggtggagtctcactctgccccccaggctggagtgaagtggcatgatctgggccacattgcagcctccgtctcctgggttcaagcgattctcctgcctcagcctcccaagtagctggaaatacaggtgcacgccactgtgcccagctaatttttgtatttttagtagagacggggttttaattttgtattttcagtagagacggggtttcatcatgttggccaggctggtctcgaactcctgacctcaaatggtatgcctgcctcagcctcccgaagtgctgggatcacaggcgtgagccactgtgcctgaccatgataatcaagtcttatcttcacttttccctcacctctcttctttctagaacggtccatgtcattggacttccatggttaaaacctgtatctgcttcccattgcttttagtctaaaatccaaatcccttgctagcgcctccaggccctgccacctggctcccgccgctcctcccctcgcctgatgttcaccaggatctggtcgcctgtcagttctttgaacacacaacaccgtccagcctcagagacttagcacactccatccactcccctcagcgggcatcttctgctccgtcccttggctggtctcttttttcctgtctttatctccttccacccaaggaagttgctggctgggtagaccaggagtctgctgcaagcactgcagggcttgtgaggaggctggtgtgtggctgtgagcagtagattaggggccgtgagcaatagatttcctttgttcctgcattcttagcccttacaaaggaaagcagtgggccttttaaaaaggaaggtgggtcttttgtacagtgcaccccatggctgtgcaataaatccggtgggggtggtgggcctccccgcaggttttgtacctgtctgcctccttattcagaaggacttgtttcctctgagtttctgcttttgccttttcgtctgctttctccttaaatggaagtggatggatgcagctcttcatgcctaaaacagaagccttgggctctgggcagagcagtgggggccgaggtaggggggtggaggtagggtggggtggcccctctgctcagggtttcccggagccctactgacaggcagtcacagtggctctgtgtccttatggggccgagaactcaggccagctgctgggccaagtttaccatcaacattccagcttcacttactccaaggtgtttgtggagttccagagtctgcggatgttagaactggaaacatcaggattttagaaataacagagggtttaaatcccccagcacttcatttgtgaaatatgacttaggcctttccggctagtcattattcaaaataagtcaggtagtcattttaatcttttccctttaactttcaatgtgctaaaagaaaatgtttgtaggtggacgtatcatttggtaaactcaaatcagaggcctcttcccacgtggtgaaacagcttagattgcaaattctttgtcccatgaggaaatgcaatggatggttaatttgggaataaaaatgagcctccttgggcccttggccaggcccttccatgagtcttattagccttgtgtctttgctctgaagtatttttttcttttctgtctccatacatctccttggggatgttctagaggtcagttccaaggaaggtgggtgtttactgtgttcagcccaagtggaaaatagctgtagccatcttcagagaaagctgacccctcctgaggaccagcaagcccagaggtggttggacaaacatgtgggctctcggtacctgacacctgttgagactggcctgagttaaaaccatccaagcctaaatgtggagccctagagatgagctagattgtactcaaggctgcagggatatgacccatgactcctggggccttaattttatgttttgactcgtggttacagcaggctattggtctaggttgaagcttgacatttagaaaatacctgggctgctttccgtctactgctgggtgacagaatcaggcaggggagggcacagcctgttgttgctgcccacccaggaggagctgagtttgctgcagcagtcctgtgccagcaccacccttcctggggctcagatctgggtctctgtacttgagaagcagcccacattccaaggggctccagcctctcacggtgactcctctgtgccacttatccaggcccctggtggaagctgcacattgttcattgttctgcgttaaagggaggcgcctacagtggtctggaagtattttccctccaggaagaaggcgggagaggttggctttattaactttactttagggaaaacatctgcgcacatttagatcctgcatggaacttcccagctgagcctctttcagaagaggatcctgtgactgcccattgcctttcatgaatggccctaagacgccgtcctggggcgcagggctgctgggggagtgaggagcatccctcacagcaccaggctcttgtgggaggaggaagagccaggagtgcacagagggtgagcaagagcagacggggagggcagggggtgaggggcaggctgtccctttggcattctggcctgtgtgtgagagcgctgagtttggacccccaaacctgtgactagcggagtttgtgtgagcaggcgaaggcttgtgaccaggagcctggggcctaaagaggtgtttctgggcagagctgtacccagaacatcctcagacaggttttgcctgtggcctcagcttgggtacctttggttgcaagtagaaaaaaaccaattcaaactgacttagagaaaagagggcatatatcgcctgtgcctgacaggtgagattcctacaggggtaattgctaggatggctttagagaaatgtgccctcctcaccccagacaaccccaaaaagtccaaagcatcagagtttttgggttttagaatcacctttgatctagaacagctgacttactcctgtggcttcctggggctgcctcatcctctctgcaacctccttggcagacatactggcttccagctgctggggaagtttgtgccccagcctcagtgacccagagccaggctggggtctgaaaagagagcggggctccacgccctgggctttggcttggcccacgaatgccccttaacagctcagatcagtctcctgccctaactggggaggctgtgggaggcaacctgctcctgggcaacttccagatctggcacttgtcacgagcatctttacgtgccagggcacagcctaagagaagtgacacgagacacagaagaggcaagaggctggaggagtgtggtcatatgtggcactgtgttcccaggagccctgctgctgatggccctggggtcagtggggaagagcaccaggcaagaaaggaaaacatgtctgtggaaggtggtcctttgcctgccctgcgagatgaggggaagcaggacttcaggagccagaggtcttccttcttcatgtccttcctgcccagcctttctggtaacagataagggaagagcatggctgagcctgctatggagcacacaccatgaaagccagcccctctctgggggcacagctcttaccctccagccccatgcacgttccaggctccatgacctggggccagcagccacctgctcccatagacagggaagtgggctaggctgggctgggctgagccaagccaagcctaggctgcggccagcggagctcttctgcccgcctcctctctccctttgtgggatgggactgtcccttttgtcctggtcatgccacagggctcggtggactgtccaagggttctttgtcctgattgtagtttctccatttcctctttgtttttccactgggtgcaactatcagtccatatctgtgacctgcatattttacctggaccaacaagacaggtggcctaggggctgagggtgtgcctggtaaactcagccagcactcccaagatagagcctgcccagatcagccttagccagcgatctctgctgttaagaacagtgcaacgctttggcaatacctcccagaaaaatagctagtgggcaatggcactggctcagcgcagacctgccctaggtttctgggcacatgacagtgcccactcactccatgggcttgagaagactggcattcagggcctcatttatgatgtcggtgaaatggaattaacctcccacccgtgtctccctctctgttgctaaagaattctgtaggtaagaaagagaatgcataaagcgtttagggaaccaggagaagaattggtgcataaaacgttcgtgaaacactatgctcctgtttttttttaaattgagaaataaaaattccattgtagaatggctaaatcaagctaattaatgtattacctcccctcctttttgtgtgtgtagaatacacttaaaatctactctgttaccaattttcaagtatatagcacattgttattgactagatagagtcactaagttgtacaatagatctaactgttgaactaaccagtagttgaactaatttctcttagctgactgaagttttgtgcctttgaccaacatctctcccccatgtcccagcctctggtaaacagcattctactctctgcttctatgaatttggctttatttcagattccccatgaaaaggcgatcactgtgggtttcatttatttttaaattttatttacttattttgagatagggtcttattctgttgcccaggctggagtgcagtggcacagtcatggctcactgctgcttcaacctccccaggctcagatgatcctcccatctcagcctccctagtagctgggacacccctggctaatttttgtattttttatagagatgaggtttctgccatgttgcccaggctggtctctaactccagaggtcaagcaattctcctgccttggcctcccaaagtgctgggattacaggcatgagtcactgcacctggcctggctttgtattttaaatacagcataattcttggtgaagaaaaacactgaaacactgatgcattgtggaaaaggatacattagttaatgtgggaaaggatacattggttaatatgggaaaggatacattagttatcactcctgaactgtttgtaacaacaaggaaaccccttcattcccgtgctaatcctcagaaacaaacctgcccagaccccgttctgtccagaatgcagtttctgttctttgtgctcactccttgggttcacatattgcatttctcgatgtaggctcaaaattatgtgaatttttatttttctggatactgtttttcttccacttcttcaaatgtgactatgctttcaaaaattcagagcttaaatgcctgtgagaggaaaggaaccgaaggtgtaggggtgaccaggtacggactttcctggagactgtctgaattgtctacaactcagggaccagggaaatatcttctcactatccagagataatattttattggtcaaaaatattagaaaatgggccgggtacaatagctcaacgcttgtaatcccagcacttcaggaggctgaggcaggtggattgcttgagctcaggagttagagaccagcctgtgcaacatggccagcatggcaacatggcaaaaccctgtttcaaaaagtacaaaaattagctgggtgcggtggtgcacgcctatagtcccagttgcttgggaggctgaggtgggaggatcgcttgaacccaggagttgaggctgcagtgagtcgtgtttgcaccactgcactctaacctgaacaacagagcaaaaccttctctctctctctctctctctctctctctctctctctctctctctatatatatatatatatatatatatatatgaagatgaaattggagtagtcaagttgtaagatagaaaaggccaaagtagaatggtggctgcagatgaagattgggtaccactcaagatggctttcattctgagttttcacatttgtaaactcagaggtctggctcttttaatatatgggtccttattcttagaagtaggaggctggctttgtcatttaggattgtttggaaattggcattcctgaaattctcccttcaggtcctccctggtcaataaagaactttgactcttgcgccctcggttggacagtggttttgtgcatcagaggctcccacaggggagttgttgggaataggctggctcttgttctgtgagggactaggggactcatgctggtgctcatagctcatcaagagtcgtagcattttacttagtatcccattgtatgtgtagacaaatatagatttttttttctctgtaaaatgtgtggccttgtagataaccatgcagattcaagctgctgaaaggcctgatgtggccctagaaagccagaatttgaatgagattagtcacagcaagtcagcaaatgtgggagatggaaaactggcttcctccacccacctaggttctttggctgggctacaaattaaatggacataaaatagattaacaggagaaaaaacacagtaattatgtgtatatgcctgggagtcccacaaaatatgagactcaaaagaagggtccgaagagggaagcttatatagccccctgagccacagaaaggaatagggacctggggcttctggtgggtggtggagacaagttatggaagagtgaggggaggaagtgtagggtgagtaaatgtggtcttgttatgcccataaaatctcttggtacatcacagttgcctggagcagccccagtcctgatagagatactttactaatgtagattttcttgatggatatcattgtgttttacaaaagggcagcttttcagagccactcctgtgtctgcagtttctcagaataaccagccccaaatatgacaagtatagtttggggtggtatattctggcctcctacagttgcattttggggtggtattgtcccgagccccaacacagaaaaggagggcagtaggaatttaagaatttcagataaagcattctcattttggaaggagcagtggagggaggctggaacagagagaaagtcaactgcatttggaagatgcagtttgaaaaacaatgagatgtttgtgcacagggccttttaaaaattataatgatgggaggatggagttgcagggatgatggcatgaacctataatcccagctgcttgggaggctgaggcaggagggtcacttgagcccaggagttcaaggctacagggcacaatgattgcacctgtgaatagccactgcattccagcctgggtaacatagtgagacctgtctctaaaataataaaatgatggcccagggagtggatggctcataggtgaaaggttttctgagcagcaagagaatgaagctggggaggagataaggcccaagcctctggggccatgatctgtgatcgcaaacaaacaggattattctgtcgcagaaagaattgggagtgtggattttagaggtgtacaggggccaaaccttggaatgggcccttccagaactgccatggtcccttgctaaaaactccaaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggataaagggtcaggcgcagtggctcacgcctgtaatcccagcattttgagaggccaaggcaggtggatcacttaaggccaggaatttgggaccagtctggccaacatggtgaaacctcgtctctactaaaattacaaaaaatcagccatggggttgtgcgcctgtagtcccagctactcggaggctgaggtgggaggatcacctgagccttaaagtttgaggctgcagtgagtggtgatcaggccactgcactccaggctgggcagagtgagaccctgtctcaacaaaacaaaacacaggataaacccctactgtttttaaagcaatttacattacaattccaagtgaaaccagaagcatgacttttaagtagcaggaacattgagataatggaaaacttggagcctttgagaaaacaaagcacaaagctgctcttgaacaccttgccatgaaagtaacaaaacgctgaagcatgtttataagtcagggctgaaaatcatgatgaagaggaaaagccaggtgactgctgtcagtttcaataccttatcctgtttcttttatcatgaaattgagtagttcgtcagcaagaaggtcaggtctgagcatctatttaaactcttaaccttgagactgtgatgcttatgtgatgtgggaaattgtatctgctcattagagctctgatatgtaattgaaatctgagattacttatctgccttgtcgtatttaaaccactgattatggctctgacatttttgttactcttcaatcaaccagtatataaaggattcagaatctcttggaattaagaaaaagctattatcttcctggtatcaattatagcgcaagtaaaaagcaatgccttttttagccaaaactttgcaaaagtacatgctgggatctcagatctttccttgatgcccttcactttaacccctacttttatgtgtgacacaaacccggccacttctcaccttggaggcgagcaagctccatacccttcttccactcctgctcctgctgctgttgttacagctgtcagaatggccttctaaaaacaactcaggggccaggcctgggggctcatgcctgtaaccccaacactttaggaagccgaggcaggaggatcacttgagcccagaagtttgagaccagcctgggaaacattgggagcccttgtttctacaaaaaatgtttttaaaaaattagcagacgtggtggcttacacctgtagtcccagttatttgggaggctgaggcgacaggatcacttgagctcagtagtttgagaccagcctgggtagcatagggagccaccatctctacaaaaaataaaaaaaaaatatagccgggagtggtggcgtgtatccatggtcccagttactcaggaggctgaggttcagaggatcgcttgagcccaagaggtcgaggctgcagtgagccatgattgcgccactgcactccagcctgggcaacagagtgagacggtgtctccaaaaaaacaggcgagtcctttccccgtgtaaccctcagtggctttcagactcctcatgggtctcagcgaggccaggtcattgtcattgttacctgcttcttgggtctcctggcaaactttctcctcgttgcctgctttgttttcttaaatggcctgaagcccattccttgaacctgccaccctccttccccctcccacctcagggctcttcatctttttgttctccctgcctgaaactttcttccccccagttctttttttttttttttgggttaatagtctggctttgtcgcccaggctggagtgcagtggcgcaatttcagctcactgcaagctccgcttcccaggttcacgccattctcctgcctcagcctcccgagtagctgggactacaggcgcctgcaccacacccggctaatttttttgtgtttttggtagaaacgaggtttcaccatgttagccaggatggtctcgatctcctgaccttgtgatccacctgcctcggcgtcccgaagtgctgggattacaggcatgagccaccgcacccggcctcttccctcgagttctaatgactgactcttttttcactcttcatgtctcagctttgagaagcctcccttcccagggagtgcaagaggaataacttattttattttttattttttttgagacggagtctcgctctgttgccgaggctggatggagtgcaatggcgcagtctcggctcactgcaaacctctgcctcccaggctcaagcgattctcctgcctcagcctctcctgcctcagctgggattacaggcacgcgcccccatgtccacctaatttttatatttttagtagagacagggtttcaccatgttgcccaggctggtcttgaactcctgacctcaggtgatccacccacctcagcctcccaaagtgctgggattacaggcatgagccaccgcgcccggccaagagggagaaattttaaggcatcctagagcctagaacaaacaatgccagccagcccttcttctgtttggctgattacagtttctctcttgagtggctgtgaattaattcagtaaatattcaagtgaaatttattgcttagttttacaattcctcgcccacagccactttagcagtatgtgtctgtgtgtgcatgttggagggggcattgttggatgtgtgggaagagcaagaaaatcacattctttttgcatcgctctgtaaactcatgaatcattggtacagctgtcccctggctactgggagcatggccgtgctttatgtttctttattgtgttaaggtgaaagatgcaataattttggtggtagaattttaacactttgaggactggagccagtaaataccttctaagtgcctgggattgtgcaaggtgctttacaaatataaactcagctctgaaagcaacccatctactacctactgttgcccattgcatagacaaagaaactgaggtccagggatgttaagtaacctgtccaaagttactcacctctcatgaatttggaaccagatcagttgatgctcatatttgatggctgtggtgctgttttctcctacaagatgtcagaatcgtgtaattcgtatattaagtgctttaatttagactttatcatttcagaatttttaataagtgggttaaagagtgagttgaggatgctgcattatgtatgagagaacagtgtgaaaacatcggaagcaggaaaagcacattttcaaggcattgaacaatacttattccctacaattagtgtgctgtttaccagctattctttttcttttttttatcatgtaaagaggttagaagaaaggaacaaaagatttaagtcttccttcctcgtgattgtactgctttattgcactgcttgcagactgcagtagaaaataagcttttaagactttctagattttcaggctttctactaagctgttgtagcttctccatcccacatctgggtttgctcactttatttctatgtgccaaatcatgattgagactcgttgagacacacagtagaccacaggttgccatatttagcagagcagggaaagaactctggagagtttgcctttttgattagggagaaacgctgtgggaggtatttgttgagcagctactctgggcaggaccctgagaactatcaatttttggatgcgtgaaatagaccaaacatgaaacctgctctggacgcaggttctctctgaatcaggcaaagcttcaggcctctgaaggcctcattcaggagcatgttatccatggcagggagggtgtgatgcctgattaaaattccagctgcttggctcccaccaggagctcaccacgatttctgagttgcttgggatttagccaactggtttgcaaactgcatgtaaggtgtgtctgtgtttgttaaaaacaatgacttctcagcaggactcagtaatgggtttccacggagagaaacattaccaagagatgaatgcaggggcgtgattgtcctgtgcactaagagccttcaaatcctttccccatatttgcaaggtgttgaagtaccgcttttaaggcaaaactaaatgacgagttataaagtcaaaacacgtgagctttaattattgctggaataagcgggattctcatcagcagggcagcttccagatgtgcttttcttcattttgactagatagggagaagagtgagggggcatggcgtggagaaagaaaggtagatatacaagaggcggagactcaggcgcaggtagagtcagaggcaggttcaaagacacacagagacacataggtgaagatacattcgatgtaaacagcttaggagccaggtcgggcctggtggcttctaagctcatatctgtaatcctggctctttcggaggccaaggtgggtggatcgcttgaggccaggagttcgagaccagcctggccaagatggcgaaaccccatctctaccaaaaatacaaaaagttagatgggcgtggtggcacgtgcctgtaatcccagctagtcgggtggctgagggatgagaatcacttgaacctgggaggcagaggttgcagtgagccaagattgcgccactgcactccagcctgggtaacagagtgagactctgtctcaaaaaaaacaaaaaaacaaacaaaaaaaacaacagggggtgggggcttaggagccaggattctaaggccatacctgctcctgctctgaatcctgtggcctcctgtttgcaagagtccaccctgagattagtcatcctctcagtctcccgttggctctatgatggtgttgccctttgcccaggatgtgagtaatgagagtaacagaattcagggttgacctgactttcctgcagaggtctgggaagacctccatgtgacagccttcccatgtcactccctgcgggttccaagaatctcaggcctttgcagctgggatggcatggcatagacatgtgagacaccccctccttgtttgtatgagcgaaagggccaaaagaatagggtggaggtcctggctggctgcccccgtgggctgctatggatctagatgcagaaactctgctgattcgttcccctggaggagaggttgctctgggaaactgcagctgccaaacctactggagactgatttgcaaataaggactccagcctgttcacatacaggagcctccgtgagtggggagggcagttgggtcaggctgaggctcagaagacacgtatgcctgtcttggctctgcccttgcccctgagtggttctgagctctcaggcaagatgctgaaccgcttggctccaagttctcatcctcagaacccaggaggacttgagcatcttgagagtgggagcttatctgtctggttcaccagcccaggtgcccgcaggtgatggggaataaataggtccttctgaaaccgtgaatagtcagggaatgatacccatgtgcctctcctgttgtaaggatcagtcatgaggaagctctgagggacggtaacatgtcagctgaggtgagcggccgtggggttattcccattcctgacacttcgcagcccctggctgaggcacccccatcctggtccttgggtacctgcctgagaaaccacacttggaatcggaaggacacttggtgagtgtggaacatcagcctccgatgcagaatggatgtgtcttgctggctgggggagcacttggagggggtccccgaggcacccctgataatacagcctgggggtgggggggtgccctggtgggtgtgtcttccctggccagtgcagagggggacagctacatttttgtcactcctctgtttcttccaaactccttgttggctccttcccttaatccatgttgccctggacaaaatccagctaaccggatcccagctgggttccgtgtattgtatccaggacctggatgagatttggaagaacttgctgagcacatctggggagacccctgcgtccccagcagtgtggctgagctctgccttgttggggcctgcatcctcccttgtacgaaggcaaccttgttgctggtacccgtgtttaaatatctttttctgacttacataaacagcacctatgtgttgcttttatgtgtgtgtgtctgtacatagacatctgtgtacgtgaatatacatatgtatttaggtatctttgtgtaagtttatatataattatctgaaataagctcatattatatacacatttcttaatttgctgggttttttttcctacttatcacctaactgggagttatcctgattgtacatgcaatcccactcaccttcgttaacagccattatgttactgaggggtgatagcgatggggggtctgtcccctgccaggtgcttggggaagctctagtggttggccagagctgactgctctttgagttcttgcatcttctttatggtttttccgtctcctctgtcacttattcttttttttttttttttttttttttagtagagctgggatctcatcatgtggctcaggctgatctggaactcctgggctcaagcaatcctcctgcctcggcctcccaaagtgccgggattacaggagtgagccactgtgcctggcctatcacatactcttttctttctttttttttttttttgagatggagttttgagttttgctcttgttgtccaggctagagtgcaatggcgcgatcttggctcactacaacctccgcctcctgggttcattcaggtgattcccctgcctcagcctcctgagtagctgggattacaggcacatgccaccatgcccagctactttttgtatttttagtagagatggggtttctccatgttggccaggctggtctcgaactcctgacctctagcggtccacccgcctcagcctcccaaagtcctgggattgcaggcatgagccaccgcacctggccatactctttatcagtgctatctatgtgcctgcctccaacattaccctgccccttctcatttaatttggattctgaaaccagataccaaacctattagactagactgtaagagaaggctaagtgtgttttttcagagaagaccaggtggagctttttattgagtaatgtgcaggatcctttagtgcaagctctgtgtcacatgacttggttgaacagaaatgtttgtgttttctggggtcctggttgtgtttcagatgggtaagggggtactggtttgcttgttaagtggcttgtgaataggtaggatgttactgtaattctcctctctagagaaaatacaaggactttaatgacaacttgttgaaagctccttctgtgtctttttgaattcagttttatattcttttcttattagtattcataagtaactcattttcctttcttccttttttgaggtggaatttcgctcttgttgcccaggccggagtgcagtggtgtgatctcggctcacctcaacctccacctcctgggcaagctattctcccgcctcagcctcccgagtagctgggattacaggtgcccaccagtacgcctggctaatttttgtatttttagtagagacagggttttgtcatgttggcctggctggtctcaaactcctgacttcaggtgatccacccgccttggcctcccaaagtgctgggattacaggtgtgagccaccacgcctggccaagtaactcagtttctattatattttttaagaatctcactttagtggtcaggcccagtagctcatgcctataatcccagcattttgggagaccgaggcaggagggtcgtttgagaccagcagggtgtagtggcacacagctgtggtcccagcttactcgggaggctgaggcaggaggatctcgtgagcccaagagtttgaggttacagtgagctgtgactgtgccaccgtactccagtctaggtgacgagcaagactcagtctctggggggataaaatgagtttatttatttatttattttttgaaacagagtcttgctctgtcacccaggctggagtgcagtggcatgatctctgctcactgcaacctctgcctctgggtttaagtaattctcctgcctcagcctcctgagtagctggaattacaggtgcccgccaccatacctggctaatttttatatttttagtagagatggggtttcaccatgttggccaggctggcctcgaactcctggcctcaagtgatctgcccaccgtggcctcccaaagtcctgggattgcaggcatgtgacaccgcccccggccaaacctgagttttaagattccaatttaagttaatcaaggagtttagctacaaagagattttggggagatctgtgtgcgaaggcaaggaaaccaaaagggtggtccgaggctcttttttctttatttctcctgacacttgattcagtctggcctttctccaggaaggcgtagcaggatctagttacaaatcggtgaaatcatgagcccagggtgtgggggccggcttagtgtcactctgcgcttcctgcagtgggccctcagccactagaaagtcacttctcttttgcgaggaacctggtattgtcacaaataagccaatttcaaaactaagtatgtttgtgttggggagtgaggagtgagtttcagcagacacatgtatgcacacccacatgggcacagtgccacactgagcccccttcattctggaagcagtcccttggccctggacctggttgtgtgccccttgaggggaggatgaagttgacctcagcactacccggagctcgccctttcttcggtacactctggtgtccacaggtggcctggcttagcaccagccacagtttgttcctggcctccagggtctctttcctgtccagctcagcagctttgaccaagtaaaatagaggacttggtctgcttgctagcagaattacatttccccaaatttcttttctttctttcttttttttttctgagacagagtctcgctctgtcgcccagactggagtgcagtggtgtgaccttggctcactgcaatctctgcctcccaggttcaagtgattctcatgcctcagccccgtgagtagctggaattacaggcgcctgccaccacgcccagctaatttttgtagttttagtagagacagggtttctccaccttggccaggctggtctggaactcctgatctcaggtaattcgtcccacctcgggcttccaaagtgctgggattataggtgtgagccgcggtgcccagcccttatttccccaaatttctaatgcttggaggccaagggcagatcagagctgcaataataatggggaggcattatccttatggtcattaatatccccatttatgtgacagtcccagggcctgggaggtcaggtgtcttgcctaaggtcatgtgcttgtcaaggggagctgggaggcatcctgtagtagactatggttgtttgtggactgcttgccctcccttccacatcctgcctgccttttggggaagtctgtctccccattctgttgagtctcagcaggttgctcctttgttaaggttccctaccctcttccagccaagagacccaagaggagccaagtagatactccctccctggaagttaaaccgtgagctgagatccagaaaatggttggaggactgaagtgccctcatttctgtctcttcagatgtggttccttagcctccttgggttttcagtaaatcccattcttgctttagtttatttatttatttatttatttttttgagatagagtctcgccctatcatccaggctggagtgcagtggtgtgatcttggctcactacaacctctgcctcccgggttcaaacaattctcttgcctcggcctcccaagtagctgggactacaggcatgcgccaccacgcctggctaatctttgtatttttctttttttttagtagagatgggtttcaccatattggccaggctggtcttgaactcctgacctcaggtcatctgcctgccttggcctcccaaagtgctgggattacaggcatgagccacggtgcctgaccatgctttagtttaaattcagaattgggttcctgtttcttgcaactgtattcaattaacacctggccataacccaggcatgggactcctcaatctgcagtgctctttccacttggtcatgctgctgctataacctagcgatggtcaggacggcgatggccagcgccccgggaaccccagtaacatcacaacatagccacgaagtgatagctacttgattctgaaaataggacctgctgggaatctcggggtaaatgtgttgtcatctgctttgatttttcgcgaggcagccgtaggtgtcagcctggaaaattctagcagcctggcttgccagagctagcttggtgtttgttcatggaaggcagtacctggctggctgcttctcagtcacctgaccgtccaagatgggtcttggcatttgcttgtgttgaaatcatgttcttatttagctaaatattgatacaacagagcaattccttttgtatatgcaggatggatgaattgaagtgaaagatcagtttgtcagcccttaaaaaaaatgaccggtctgatcatactgttttatgccagcgaggtgtgtgtgtgtgcagagattggggaggggaaagcttttattggcaagactatctgaaggtctcattcagcggaatattttgttgaatagaatctagcatgcgcagtttcaaaaatatccatttactcacagagtcctcaaacccttacacaagatgaagagatgaatgagactgtctgatctgtcgccgagggctcagttttgtttctggaaggtctccctctctcttcagggatggcagctgctctttcagcctggacaatgctggctggctttccccgaccagggcttttgtccagagctgttgcttttacctgggcttggtcttcaagggaaaaagaggtgggaggaggaggggagctcagaagaaggaagcccctgtctttggcctgcactgtgttctttcactctgaggagtggtcccaagaccctccctccagttcccagatcactttcatgttgggagctgcaaagtggaattctaaggaattgacctggattcgaatatggaagtatcctcttccccttaagcaatgctcaagaaggaattgtttcttgataatcaggtaacattcaaatgttatataaactttagatttccaggatgagtgttgtatttagagcaaaggctcttgtttggaggcagtgctccatgaaggtaggcctggttctatggaatttccagctctagctgtcatgaatgggctggttaccttgggcgagccactttagctctctgggctttagctgggataagtgtgttggaataggatatgatctctaaattttcttccaacttccaagattttatggcctttgcaatttattatttcaagcccttaaattatctccagtaaaacttgagcaaatgtaaccatttaatgatatactgggaaccatatctatagtacctctttattacaagatgcttatgttttagttagagatatactcacatgttcacatatgggtgtatatatgtgtgtatgtgtatattatgtatgtgtgtggatgctgatcttaaactattttgttgtcgtagttcatagaagtaaaaacctgaaaatatttaaaccagatcacaaatacagggaaataggctcttagggtctgcattttccagctacctgactcttgctttggggccaatttccacgcccttctttcacacggtgtgtcagctgtggaggtgtttaattcagcattgtgtggagcagagcttttccgactgtgctctgtgggactctagagaccaagaaagtacttgaaaaaacgtttttaagccgaactagtacacagtcgaggagctcggcagggtcctgttttcgtggccagcacagtctgtccccacctggggttacgttgttccctctttcctgcttggttgtacacaccgcactgtgtgctattggataccattagcacattgattgcctggtacggatagattaattcggttggtacagctggttgaccctcctgccctgtctgccttattaaaaattattgcatgaacacaggacaggccgttaaaaatcaggggctgtttgtaatgactcatgggtgcatctcaggactcttcccagtgatgtgcagcggggggagaaaccaacgggcatccggctacctcatgtctccagcccccagtgtcaggtttttgagttcctccaaacaacttaattgctctcgatgatggaccttatacaagcatattgtaaattgctattacattacatatcgtaaaatgctattacaagcatattgtaaattgagcttgctgaaaatgtttggaagccacagatgtagcgaaaagggcacagattttagagacaggcagttctggatttgagacttagcttccatcatttagtaaccatacggcctctggcaaaggaatttgcacctctaatgcctaattgtctcatctgtaaaatgggcctgctgtctggcagccaggacccttttttttttttaagagtcgaggtctcgctctgtcattcagtctggagtatagttgtgcgatcatagcttgctgcagtctcaaactcctggacgaagcgatcctcctgagtctgcctccacgtagctgggattacaagtgtgcaccacgatacctggctaggcaggacgtttctgaagaccttagatgtgtgtacagtgggcctactcctgtgcccgacacataacagtatattcaacaaatgctggtaattatcatgcttttcatgctgagaattaaagtgttacaagccaggggtgtccaatcttttggcttccctgggccacattggaacaagaagaattgtcttgggccacacataaaatacactaacactaatgatagctgatgagctggaaaaaaaaaatcacaacaaaatctcatagtgttttaagaaaatttacgaatttatgttgggccgcattcaaagctgtcctgggccgcatgcagcccataggccgtgggttggacaaggttggtttacactatagaaatatagatattttattgcatttgcatatttacttctgtggtggacatagcatatgcatagtctgataaatatatttgcctataatttagagatatttcagcagattgtaatgacaacatttctctttctgctacatttttgtagcaaattaaattaattttcttttctttcatttttaaaatgtgtggagccttaacagaataatttcttgtactttgggttttttctagtaggaaaagaaatatcaaacagccggtgggaattgtgcttatacactgggcctccaaagtgctgctttatttttatgtacagactcgttgggggtggactgccgaaatccttgctcttagaaatgtatttgagcccctgggaaactggatagggaaaaaagagctaattaaaaaagctgccatccacctcctctaattaacttgctgtctgctcccaagagagggttcagaaatatgaaaacaagacaggcagcaccggaagtgaatgccattctcgtggtctgtggtggtccctggtgttttgatgcagagatcgttcatagtaaacaggcaagggaccacaaagaggcttggtgtgccctggcccaccccatgctctgccttccacacagggcgatcgtgaacggcggtccctctgagcaggtgcacaggctgggcagttgctgcagcggagaactcattggaattcaggggctagaaccgaggggcatccggccctccctgttgcttgcttgtgctgttgagaaagagcagagccctttgtgcttcagagcctgctgtcgccagtgcccaggaatgcagaagccaggggatggacgagtactcaggctttcctcgaatctctgcttgagtggggcagcctcggggcctccggacgctggagaagctcacagcatctgtggccggtggtgcagctaacttttttggtgacattgaaagagatttaggtccaagagatacgagcaggggaattaggggtgggaatttgggggacagaggctgttcttcagcggaaatggcctatgcctcctggcagaggtggtccccagtggaatgggcccggtggatgtggacagcggtgaccagcagtggggactccagtctgctggtgcttcagggagactctggaaaaaggcaagttatctctgtgtatcttgtcagtgttgctcatgatggtgcagtgctgggggcctggtgaggaagctgggttcccggggcagcacccggggcagcacccagggctcgccaggctgatctgaactctcattcttctttgctcctcagttgtgtgacctccttttgttttccacaccgataaacagatgcttcaggtacctcgatctgttgttgtgcaagtgcggatctttccttctccccatagacaaaagctaagccctttgatattaatgagtgtttgtaagaagtcagtatcttctgttgggtttgcatgaattatttcctcatgaaatttaatagtagactaggtttggctcattggatcccatcaaaagcagctatgatgtttcttttaaaccctttggttccctggaggctttgtggctggttggaggagccaaggtccttggggggtggaggggcaagggtgctgatgaagtaagtcactgacaaactagttgtaaaagcattgatacagattttctgaagggaactcaccaaatagctctttcttcaggtcccagtggatagtggagggattggtttggttcctggtgctctctgccagctggctggtggtctttagaagatggtggcctctactggggtccctggttctttgatctttttggaagctcagcaacgtgagcatctctcagcattgggttgcacggctcggtgacaccggtgcagcttggtgcacacactgtccgtactcacctgccaggtcaccccgatttcatgtcttcaccagatttgcttgctgggatcattcgtgccattcagccactctaagtttccattctcttaataattagccccctcgttgcaaatgaataaatcagtatttcagtctgtttaacccttccaaaatgggactcagcccaactgcgactgctgctgccaggctagctgttctccaaggcaaggctgggctcaggaccgtgggcccttgggcatcttgagcataggtggagctggcttagtactgggggaagccttattctttctggcttaaaattgagtcaccggtggaagcagggtgatggggagggctgtctgttggttcttcgttttcttctttttatttttttaagagacagggtcttgctctatcacctaggctgggatgcactggcacagtcatagctcactgcagcctcaaacttctgggcttaagtgatcctcctgcctcaccctccctagtagctgagaccataggcacatgccaccaagcctgggtaattttttatttttatctttttatagaaatagggcctcactgtgttgcccaggctggtctcaaatgcctgacatcaagcgatcctcccacctgagtctcccaaagcgctgggattagaggcatgagccaccgcacctggcctgttggttcctcttcaacccaggccaaggcttggccagtggcctctccttgttagtgggcagagtttctccacatggatttttggtccagttctctgggtgaagagtcttccttgagaacagactttcctgcagaccagcgagggccattttcactgtgtcggggttggtggccgtgctttgtgtcttggtctgatgcaccctctgcctggccggcttgctggcttccttcgttcactccattcacccactcaacacatgttcattcccggccctccactgtaggcttggagatactgtgataaacaaggccggctgccctcctgtgttttgagctccgtagaagagaaagacagtaaacactactagaataagtctatactcacaagttatgagaggcgctgagaaggcaggacagtagagaggatgatggggtgggatcatgtgggtgagttggcacaatggcatcgaacatgcagaatgcctctctctctctatttgaatcaatacctaataatgaacgcgtgcggaagttcatccagagtccgctgtgtgtgtatttgccactaaggcgagaagcgtgtatttccagtagagccgagttcaaagaatacatcatttgtgtgcaatcagagccagtgataagattcaaccttaggaatcacgactgagaaaatgactttcctctcatctgtccctgcacagtttaactgagcagcgagccagaacccactggctctgggtgcgaaggccacaccggctcagcagaactggctctgggcccctgtctaacctgtgcttctccctctctcatcaggagttccgattctgaagaggcatttgagaccccggagtcaacgacccctgtcaaagctccgccagctccacccccaccaccccccgaagtcatcccagaacccgaggtcagcacacagccacccccggaagaaccaggtaaccaagggcagggaggcccccagacagccctgtagagttgtgagccctgggggagatttgcagcagttcctcctgggtcaggctggaggcgagcactgactcgacctcttggctttgagttgtgcttgacgtggcttttgtagttttcttgaaaatgaagggtgaacagatacactggattattttgcatttgctttgcagaattttagggggggcctctggggagattgggtttggaggagggcagtgggtctcggaagttcacagcacagtcttggattccagcacttggccccttgctcttttaagaacattagctgtggacaggcctgtgaatctacatgtgtatttccagcactaggcttggggaaggaaggtagtcagtgggcggggatagagaggtagacattcacagcagatcatggtggtttgtttattcctcatgaatctcgtgtcacctgatttcatatcactttcccacaactttctcccttagtgtgagtgaaaacacctttatgttccttttagacgggtggttagtggacaggtggaatagatctcgtccccaccccacccctgtggggcatgcattctgcgcctcccagttacaccagcacagagaaccacctctcacatggaagattcacaggagactggaagagatagggcctgccagaaatggtcccacaggctggccagggggcccaggtggtattgtccttgggcctggacagctctgggccccacaacttacaggaccccactttggccttccttggcccacagccttcccgtgtgatgagaagtctgcagggccaaaccccttctagaccacacgctggatacctgggagcggccactgccaggggccccctcgtccccttctctggctcttcctcccgagggcaaactgtacctgagaaggaaccaaggatggggctgggtgcctccactgtgtacttgccctggccaggagccaggtaaactgaacaatacaataacattttgaccttgatgttggttttagaaagaaatgggtggaattctttttatccgccgtgggttcgagcagcccgttgttttggaaaggatgtacactcccggagctttgttcctaaaccagcaaacccccgtgctgggacaagggggcaggacagttttaatgagagctgatgcctttggtggagtctgccgaatactgctcccatgtcccccgtctttgacggctcatcagtctgcagcagtgtctggattttgctgagtcagtgtagatgccagactctgggaggatagtgacggatatttctttgatttgaaagtagagaagagccaggagggctgtctgtagttctcagagcatcgtttgcatctcttcctttattttgtatgaccaagcatataaaactgtatttctcgtaatatttttaaaaacttacccataatttttaatggaaagtggctggatgacaaacacattgtaatctctaggtcaaatgtgtgattaagaataaactattctggccgaggcgggcagatcatgaggtcaggagatggagaccatcctggccaatacggtgaaaccccatctccgttaaaaatacaaaaaattagctgggcgtggtggcgggcacctgtagtcccagctactcgggaggctgaggcaggagaatggtgtgaacccaggaggcggagtttgcagtgagcggagatcacaccactgcactccagcctgggtgacagagcgagtccgtctcaaaaaaaaaaaaaaaaaacaaaaaaacaaagaataaactatgcttggccgggcatggtggctcacgcctgtaatcccagcactctgggaggccaaggagggtggatcacctgaggtcgggagttcgagaccagcctgcccaacatagtgaaaccccgtctctactaaaaatacagaaattagccaggcatggtgccgcacgcctgtagtcccagctactcaggaggctgaggcaggagaatcgcttgaacccgggaggtggaggttgcagtgagccgagaccatgccactgcactccagcctgggtgacagaaccggactctgtctcaaaataaacaaacaaacaaatgtttagaagaaaatgatagcatgttatagggcatgtaccatccccagcaccaaggagtgtgcggagaggccacttgtggccacaggtgcgtcttctgggattcccagtccgacatcctgccagctctgggatgaatgggatgccactctgttctcttctttgatcctgtccttcttccttctgcctaacttcctttcaacaaagcagagaacaatctccattcttaaaacgaacacgcacaacatccatctttttcttagatggcagttactaaaagaatgagcattattgaggattaaaagataacccccaccagggaaggggatggaaacgttaattgctgtggagtcacagcccctcagaaccttggattacaccaattggagtgtttgaacggggactttatgtttctcctcctttgaaaacggcagcaaggctagctgtgtgaggattgtacactcaggagacttacggttggaactgtgtctgctgaaagcccccctagcttgggctgtacaaagatccatttgatttgctgccctggttagaaaaccgcctcccaggcggagggtcccctcgtccattctgtagaccagcatggggcattacgaaggcgtgggaaggcagctgtgcttgctagtgtaggtggctgtaggagaagaaagatttgttctctcaaccataggaaagaagggtaccaggggaaaatctattgtttactttcctctgcacagtgcccgggatgttgcgaaaggtgctgtgggaaccacgtgaattaatacacaacacctttggctgtgaataaagatggtttttccccctggcaacctacattttataaagcactcacttgccctacattgggtcctaccagcgtgtctgggctccctgggatggaagatgtgtgggccagagcagtcccatgagcctgtcctgagggctgtagcctggaccacactcctgaggcagaagatggggcaaaggattgcacctgctgccagctggggcgggccaggactcagctcatctgaacgcagttcccttatctgtgaaatgaagagggtgatctgtgggtcccttcagatccttccagctccggcctcccgaggtcctgtgaagggaatggttggctgatgtacagtgaccgtgttattagaactcaaaaccggccaccaagggtcataattacatgtcatgtaattaaataatagctcccattcaagcatttgccttgtcagggctatgctaggtcctctgagtgtttcatctcccactcaggtgagggaggatcagccgtatgcacacagcatccctgtatagtggatgtcttcccctgattccccagtgacacgcggaggttacgaacctcatacgccatctcacagcgataaggggactctggtgtcagaacccaggcctccccacttccaagcccggctcccttccatttggaaccagactgctctctgcgcaggtacagtgagctggtgcctttgtgcgcctagcctggggcaggcccttagtaggtgttgagtgaaagttgttgctggacctgctgttgcttagatgtgtgctggggcagtcctgccagcctgtcctgagagctgcagcctaggccacgcccccgaggcaaaggatggggcaaaggattgcgagtcagtgggtgatcagtgggggcgacatggcaggagagctgaggcaggtccattctgacagttgcccacctgcccttcagggacattgttcagcattggggaatgcagcttctttactcattcttgctaggagattgccaagcccagggaaaggcccgtgttggggccttggaggtaatgggggcctccctgtgccctgcgtgcctatacctttcctctgtctcccaggacatggtccccaggcactgattgtggcactgcacctgggggcccgagccattgagccaagggtatacagattcacagccaccagatccaagcaccagtgtcctcgccaggcactcgttgtgctccaagtggctgtttgtggacagctgtcctcacattgacttggaatggagctcagtgcccagcctggctgcagagcacacagtggcttcccttttctttgggcccgcctctggttttcgtatacactgtcacctgcttttgtctccaaagaggccatacgtgggtgctccctgtagccacgggagacttcctggcatggggtggggcatcccagaacccagctgaggcccttcccagcctggggcaggggcacaggggtgggtgtcaccatggcgtgtgaagagcagggggctgtggttgccttttcctgacacctgctatgacctgggccaggtgcttacagactctccctcttcacccacacaagaattccctatgacagctgatgacagcacactgtcttaggtctgatcacacggctatcaacgtaaccatagaccaggtacctgttagcaacagaaatgtattgcttacagttctggaggctgggaagtccaagctcagggcactggcagatttggtgtctagtgaggacctgctttctgttcatagacagcacctcctccctgtgtcctgacatggtgaaaggacacacagtcttcctcagtcctctttcgtaagggcactaatccactcatgaggacactgcccccatgagctcatcacctcccaaaggccccacctcctgataccatcaccttatatgaggatttcaacataggaatttcggggacacacacattcggaccagagcacacagcaagctgagggccgagccttttcaggcctggatctggctgccacaggcactcgggccctcttgggccggctgctccctcttcacaatgtgagtgtttcatgggcccaggaccagggaacaggtgagaccactggagattctgatgcagtccaggcagaggctggcactgcacctgggggccctggccattgagccaggggtatatgggttcacagccaccagatccaagccccgttcatcccaggctggaaggacgatggagagtttggggcctgcatagagccaggtgaggagacatgagaggatggcgacctcacctgcccacagtggccacatctacagtgagaggacgggcacctcacctgcccacagtggctgtgttcacatggggaggacagttacctcacctgcccacagtggccacatctacagtgagaggacgggcacctcacctgcccacagtggctgtgttcacatggggaggacagttacctcacctgcccacagtggctgcgttcacatggggaggacggccacctcacctgcccacagtggccacatctatagtgagaggacggccacctcacctgcccacagtggccacatttacagtgagaggatggccacctcacctgcccacagtggccatgttcacatggggaggacggcgacctcacctgcccacagtggccgtgttcacatggggaggacggccacctcacctgcccacagtggccatgttcacatggggaggacggcgacctcacctgcccacagtggccacatctacactgagaggatggcgacctcacctgcccacagtggccacatctacactgagaggacgaccacctcacctgcgcacagtggctgtgttcacacggggaggacagcgacctcacccgcccacagtggccacatctacagtgagaggacggccacctcacccgcccagagtggccacatctacagtgagaggacggccacctcacccgcccacagtggccacatctacagtgagaggacggccacctcacctgcccacagtggccacatctacagtgagaggacggccacctcacctgcccacagtggccacatctacagtcagaggacggccacctcacctgcccacagtggccacatctacagtgagaggatggccacctcacccgcccacagtggccacatctacagtgagaggacggccacctcacctgcccacagtggctgcgttcacatggggaaaacggccacctcacctgcccacagtggctgcgttcacatggggaagacagccacctcacctgcccacagtggctgcattcacatggggaggacggccacctcacctgcccacagtggccacatctacactgagaagacagtgacctcatctccccagggtggccacatctacactgaaaggatggcgacgtcacctgcccacagtggctgtgttcatatggggaggacggtgacctcatgtgtcctgtgcaccttggatggagacaccaccaacctggcagggccccaaccctctggacgcacattcacttcccgtaatgacctcgctggaggggcttgactgctctccacatccacacaggcacagtgggccatggatggatcctgggatgctcggggctctcacagaccccaggctggtggctcagcccattatcctcccgggaagacaggggtataaccaagcaccgcaggtgttgtcctgttacagatgacatttgataataataatagaaaaatagtaacattgtggggggtggtactagagacagtgacagcgaggcacagcaaggttaaggagctttggccaaggtcaccaagccgattagtggcaaagccaaggtttccgctgctttttatgactctgcgctctttgaaactgacctcttttgaatctgacattatgttagtggtctgtcttcatgctgtcttctttagcttttttttttttttttttttaattcataatcagtgtttttattattttcgatgatggctcatttctaagttaagtgatgtatactgtctacatttcccatctataagcttttgtttttcctggacttttgttacctaattttgatttgcttaggttattatttttttaatctatggcatgtcttcctatcgctatgtacaatggctttcagtagaactttttacaacttcaaactcatcagataactgtgttttaatatctttttctgaggacattcctcccaaatccctctgttctgctccacttggggctgataggtccttttctgttttgagacagggtctcactctgttgcccaggcttcagtgtagtggcacgaccttggctcaccgcagccttgacctctgggctcaagaggtcctctgattgttctttattcttgttgcacagctgttgtttggggacttccctttgccatcatcctgggatttccctttacctccttcctgtgtgatctccggtttcctaaaatccctgtcttcctctctgttaggttattccctgttttggtcagtacatcatccaagagtttcctgacaaaagagatgggaaggtaatttgtttctccagaagtagatttttctttctttctttttttttttttaattgatcattcttgggtgtttctcgcagagggggatttggcagggtcacaggacaatagtggagggaaggtcagcagataaacaagtgaacaaaggtctccggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccatgtctacctctttctacacagacatggcaaccatccgatttctcaatcttttccccacctttcccctctttctattctacaaaaccgccattgtcatcatggcccgttctcaacgagctgctgggtacacctccccagacggggtggtggccgggcagaggggctcctcatttcccagtaggggcggccgggcagaggcacccctcacctcccggacggggcggctggccgggcagaggggctcctcacttcccagtaggggcggccgggcagaggcgcccctcacttcccggatggggcggctggccgggcagggggctgacccccccacctccctcccggacggggcggctggctgggcgggcggctgacccccccacctccctcccggacgaggtggctgccgggtggagacgctcctcacttcccagacggggcggctgccgggcggaggggctcctcacttctcagacggggcggccgggcagagacgctcctcacatcccggatggggcggcagggcagaggtgctccccacatctcagaagatgggcggccgggcagagacgctcctcacttcccagatgggatggcggccgggaagagacgctcctcactttccagactgggcagccaggcagaggggctcctcacatcccagtcgatgggcggccaggcagagacgctcctcacttcccagacggggtggcggccgggcagaggctgcaatctctgcactttgggaggccaaggcaggctgctgggaggtggaggttgtagcgagccgagatcacgccactgcactccagccttggcaccattgagcactgagtgaacgagactccgtctgcaatcccggcacctcgggaggccgaggctggcggatcactcgcggttaggggctggagaccagcccggccaacacagcgaaaccctgtctccaccaaaaaaatacgaaaaccagtcaggtgtggcggcgcgcgcctgcaatcccaggcactcggcaggctgaggcaggagaatcaggcagggaggttgcagtgagccgaggtggcagcagtaccgtccagcttcggctcggcatcagagggagaccttggaaagagagggagagggagaccgtggggagagggagagggggagggggagggggaggggtagatttttctaactgccttctttagcttttaaagaaagcacttttccagagcgtctcatttcatgcctgcttataaaggatgaggagtggccccaggtcacagccggtgttatttcccccattgccctctccctctgccttcaaatgagcagttaagtcagtaaccggctgagcccttgtgctgatgctggggctctgcctgggggactgtggccccttggtcggcagcccaccagggaagcaccccagcaggacaacaggtggggatgtggcaaggaaagctgctcatctctggctgacaccagagaagtgacagtcagcaaagcaggacagagagggacatgtgggccgggtacggtggcccatgcctgtcatctcagcactttgggaggctgaggtgggaggatcgctggagcccaggagtttgagaccagcctgggcagcatagcaagactgcatctctacaaaaaatttaaaaactagccaggtgtggtgtcacgagtttggctagccacttaggagggtgaagccagaggatcacttggagttcaaggttgcaatgagctatgataacgccactgcactgcagcctgggtgacagagtgagaccctggctcttcaaaaaaaaaaaaaatgacgtgtggcatgctctaggtggagccaggatcagcccagggctgctgaagtcccagctgtctgaaccgcccgcacagcacagtggggctgtcactccaacagtgctcctgggtgccttcttacttcttaccctacctagcaaagcctccccttaggtgctccccatcctcactatggctctgtcacttagatgctcacgaggcggactctgctgggaacaatttggtttatgtaaagacactttaatttcttcatcactaagtgagttagcacggtcagtaactgtccccacagtgcctcgacggcacttttccctcttggtttctgggaattgaacagaagtttgagagcagacatacgagagcaagatagacctcaggaagcagaggagcacagccccacccggtgggggttcctggggtctctgtgagatcctgaacacccactggtctgaggacagaaggcagccatggcacgggcctcctgctctcttgctggtcggttttgggtttggtttcttgagctgtctgttttggaccacatcagaggagggtgggcaccaaaggacagcctctgcctggtacttctgcagcactgatgcctcacgcctctggggtaaaaaccccacaggaacttggagctcaaaggcccatccaagcttatcctcaaagctgactcatttttgtggccaaatactaaagtgttacccactggaggtttaagaatgaggataggcccagatagaagcagatgaggtgagatagcccagttccagacttcccgatgaggaggcgcacctgtggcacctgttacgatgggggccctgagcccccaccccagccctgcagaaggaagtgctgctctgcagaggaaggggcggatggaggcggagtctggggttttaatgagtgtctcaggtgtgtcttaggctagacaaatttgggaaatgttgaattcatcacggacttgctctgagctacccacagcaaccagcaaactgccacagaaagaccaagtactgctttgtatctcgttagcctacttaaaatggacaccttttcccagaataaatattactaactgaagattactatttgtgtacttagaagatacaaagccatgctctctgtgtaggagaccatctacccgtgatgcggcagcttaagagaagagtctgtgaatgcctgggcacacctctggccctctgggcgccaaggattcctgtgcacagtgaactcactggggggcggggggaaagaggggaggatggagaggcgccagtgcgggggctggcagcaagtgcttctgtgagaaacagtccagcaaggctaagggtgtggcctttggagaaggtagggtgacatcagctgggtgatgtctgctgccctgtcctggctttgtctctttcctgggagccccctgtcatctctaacacattcgctttccctcaacttgggcattttactgggcagcactggtgctatggcctgaattgtggcctccaatgtttgtatgctgaagccccaacccccaatgtgattatttgtagggaggacctttaaggagacagttaaggttgaatgggttcatacgggtggggccctaagcccatggggaccagtgttcctatacgaagaggaagagaccaggagtgtgcagagaaaaggccatctgcaaaccaaggagagcggcctcaggagagacaaacccactgatgccttgaccttggacttgcagcctccagcactgtgagaaataaatttctgtggtttaaaccgcccagtctgtggtccttggtgatggcagcccagcaagctcatgtaactgggataccctagtgacccttttcatctgatgaactgcgggtgctgactttgtcatcagactgagccagaaacctggagcctgtgtgcaaggcactgttctctggggcattgcccagatctgtgtcagtggagacatgaggtggaggaagtgttgtgtatgtattcatctgggttcctatccttccttacctctatgtcctcggcacaccccccagtggctgatgtatgggaggcaccccaggttatttgtggaatgaacaaatgaatcacacagttgattgtgtctgcattggtcttcatgcagatatgccgtgtggatgtttagaaatccagtaggggagcagggaggctgggtgtggtggctcacacctgtaatctcaacactttgggaggctgaggcagacggatcacttgaggtcaggagttcaagaccaacctggccaacataatgaaaccccatctctactaaaaatagaaaaattagccaggcgtggtggcacacacctgtaatcccagctactcgggaggctcagacaagagaatcacttcaacctgagaggtggaggttgtagtgagctgagatcgcaccactgcactccagcctgggtgatggaatgggactatttcaaaaaaaaaaaaatgcagtaggcgagcagggaggacttcgaacccagttggaccacaggagcccttctagccctgtgaggggccccgtggagcagcctgctctggtaaccaacacaataagacagccgttcccaaccagggaggattttgcccccacaagggtacatggcaatgtctagacacagtgttggttgtcacagctggggtaagggtggggcctactggcatccattgtgtggaggccagggatgctggtaagcatcctacagggcacaggacagcccccagcataaaaatctgactgcccccaaatgaccataatgccaaggataagaaaccctgcagcaagattaggtttcctggttcatgatgagctaatgagagcatgtcagttctaaagaggaaagccatgctaagcaggcagggagctctttcttctggaggaagcaatgagcagatggttaagctcattgttgcgtgataactgctgacatttgaagggcctccgaaggcttccttctgcaggctgcagaggcacgtgtaacggcctgagagggagagggttggtgtttgtgggccttgacgacgggataggctgaggctcgtgcttcctcctgccaaggcccatttgaaagcacctggtccccctcagcatcccctggtcctctgttccctccgtgtatccaggggcaattacagagcaggaagaggaggtcacggctggtgggaggatggggtacttgagagtactagggcctagaggaaacagggagttgattttagaaagaagcgaggcaacaccttttgaaatgagaaggaaggagtgtttggagaaaccgtttggtagaaagagctccgtatttagggcgtctgctccaggtaggccctgggtggagaagaggagagtgagaggcttgaaaccaggactagctcatagatgtgcttccaaatgatgctttcaatccaagcgtttattgatcctgtaagaaagtgtgaccagtcaagggggaaacaaagccaaggccagttcctgaactcaagaaccttgaagttttcttgtgttgtgagctgagttctctgccaggtactccaggagaaaggttgctatgagcaaagcttggtaagcactctgcagaatactcactgcccagagatttgcagtcgggagcatgaattgctctgagaaaatcgacaggaagagaccagttcaggggttaattgtgcatttcccaaaccttgtttgtttgttgggatgagagatagggctccctgatttagcaaatgaaaatacagggtgcccattaaatctgaatcttagataaacaaagaatcatcgagacatgggacatacttatattaaaaaacatgttcatttatctgaaattcaaatcagctgaacatcctgtcctttgtctggcaaccatgccggtggcagaaggggactgggggtacataacacctgtcacgaggcacacattggaaacgctgtcccaggtcttacctgtgccagctccgtttactcctcattctgcatctcccagtacttaggcctgcagaccgctttatcgtgtttgccctcttgtccaatgacacacttttagttttctggcatccttgactgcctggagcagctgtgacctcagaaatgcatgaaagatgccgctgggtgccagcagaacctagagtagccaagccaaagctggggctggccggatccccatgggcagtagggtggtggcacctttgagcatcatttggccaacatttgcagcatctgcagcatgtttgggaaataggagcaacctccttgactggcaggggctgatgaggtagaaaagctgagaggaggcagctgggagagcagtgagactaggcaagaggcagggccaaggataggcaggcaggactgaaggagaggttacaggtgatggctggagcggcaggtggcagacagcaagtgctactacaggtgccgggggcctccgtgtacaggctcccctgatcttcacagtggctctgaggagtcaagaacaggcttgctggtggccgtggctagtatgaatatttatggaagcctccgtatgccttcctgcaggatttctctgtcttcctgtcccactcttgacccttgctttagccacactggcctcctcgctgtttctgtaacgcaccaggtgctcctgccgcagagcctttactcgcactattccttctacccaggatgcttcctccccaggagtcctcctgtttcatgcacttaccttgattctggcctttgcttagatgtctcctcagaagatcttgcctgactaccttattttaaaagtgaaactctcctatcccggctttatttttctccttagcatgtatcaccctctgaaattctgtacattgtttgtttgtttttgagacagagtctcactcactctgtcacccaggctagagtacagtggcgcaatctcggctctctgcaacctctggctcccaggctcaagcgattctcctgcctcaggctccggaatagctgggattacaggcgctcaccaccatgcctggctaatttttgtgtttttttagtagagactgggtttcaccatgatgaccaggctggtctcaaactcctgacctcaagtgatctgcctgcctcggcctcccaaagtgctgggattacaggtgtgagacaccatgcccggccctggtggtttattcgctatcttcccctgaagaatgtgacttccaggaagggaaaggttttgtctatttctgttccttgttgaatctctagtacctagaaccatgtctggtcctgattaggcacttggtgaatgtttttgaatgaatactctgagctgttctttaatcggtcctcatgatcctcattgtacagatgagggaactctgggcgaacctggcctgggtcttgagctaattacgggtaggtcaggttctgtacccaagtagtacacacagtgatgggcggggtggcctggggccgtggtttgtcaacccctacgctggagggtgatgttttggtacaagaggagaggtgccccaatgcgtcctgtgtctgtaattgatggcgttgtctgtgtttccccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagacgtaagttcaggggtggaggtggtaaggatcagaggcgggggtgcgcattggctgtgacccttggtcatgtgcctggataaccttcgactgccctaaccttgcccctgggtgctgtgatgatgccacgcttacggccgttgcaccaagcagacaatgtacgtgttttccttcctctctgcggtcacagtggtggcattttcccatccacatacccctttgtgtccttgatcttttgctttaataaatcaatgggctggagctttacttgtagccaaagacctaatgttcaactccagagcaatctgggagatcccatggaaggggaaaggtccttagagatctggttcatctccctgttggtgactgattgctttttggagaagctgggagatacaccctttaaaatattaaaatgtatagtacttgtttctgcctattaatgagacattagcccaacctacaaacatagtagattccaggaggctcaggaatgagagatgtggcctgggcccctccctgctgcactccaaccagcccgtaagaaacacccttctttgtctccttccttctctccagtcatcttttgtagacaaagtccctgcaagttctgaagagataaatggaacctgaaagtggggagcaaatccccacaatccccaggaagccattggtccttggctctatggtccccagacacttgacaaggccaagtacatcgtgcttaaatatcaaacacccatgcctccagaatccaccccaggacccggctctaatgtggatggctgctggtcctttattctttggcccctgtggttaatatcttggcgatttccttactcttacgggaagtattgtcagtaatttaacaaggctgaggagatcagtctcccaggggcagcagaacagaccacagcgctggcccctctgggtctgcctggcacgaaagagacagaacgacatgtttacctcccattctgggctccccctaacattgaatttctgagaagaacccagggcctcctgagaggaggtctctacagcaggttaccttagatcaacctgccactgtctagtggtggctggaggccatcctggccaaaatggggactttgttttagatcagttactcaactaggtccctactagagactctctagaattcacgttggaaacttgatttcaagcctggaataggagaagtctgcaatggctagactgcaaggccgtgctctctcatctggaatgagagccaaccttagccgccacctcttccttctccaagatatgttctgtgtctcataggcgtccccagtcactttcttgtttgaatattagagctaacaggggtcagggaagtttacccaactgtgtcctcacctctagtgcagacagggactttggcgtggaagaccctgcgtgggtctgacaaagctcttggggcaccacggctttgtgggatcattaggatcaagagaggaagctgttccccagcagctccttccaaaaagctggggcattgccctacagcggtggccgccatatcctaacccattaataaccagttgtctgcagatttatcttttttgtcagttccttctgtctgtctctctttttctttgtcttcttgtcttaggatggttgaagatgtgatgtctgtgtgttctctgttgtaagtaaatttaatgcaatctgcctcttatgccaaatgtgcttatttttctgccttttgtttctgcttccaagccatttttatttcccctctggctgctactgatgtgtttctgtggtgggcctgcgaatgatggggcatggggctccccagtagcaaagattacttttctgtttcatagtgatttgcataagagactgcttggctgtgaaaatgtgattatccagcatctgcctgcttatcaggaatggaacttttttccttcccttgcatattggatgtcttcatctgaaatcaaacattttttttaaactcttcattacattttttcattttaaactgggctagtgggcgattgctttcaacactactgtggcttcacgttaaaataactgtctggtctaaccacaggcagcgacggccacagcttattcttgctaacatgtaaagcagaaatatttgggccgttccaaattgaggcccacagagtgccctgaaatgcagggtcagtgcagagtggagcacacagctgtgagagccatcgccaggctgccccagtcctgcatcctcagtcacccaggacctggctgggtgtcggcatgccttgtctgccatctgtgggtcaccctgccacttgtcagtagaaacagagctgaccatttctgtgcctctgctgctttgcctcccatggccaggagggatctgtgggcagctcgggggggtccaaagacatgcaacttttccctgtccttagaagggaagccggccagtccaggtggccagcagtcccaggatagggtcgagtccatcagactctcttctgcccaagggatttcttgagtatttttgagccacttagcaactataaaatatatggttatatatttatatgcatgaataaatatatgcttcaagctgcgattgcactgttttaatggcaaatattataaatgctgtaaatagccatttatttttttttcatgattaaatgccattgttggagtgatttgagagaacacaaggaaggaacttgaatgccaaattgctctgcccacccagttaacatgcaaagcaggggagggtggtgggatctaaggagagggatcaccccccaaagcctttgctttgctgggagtgggaccaacccatggaggggctggagacggggcaggggccagtctacagggtggaaagagcccccattctgactgtggaagtgacccccagactgctcggtggacttaatggaactgctcaggctaaaaggcatccctttctcctgggatctgcttccttgacccttcaggagtctgatttggtggtttcctttgcctctcagccccgctattcatatggaggagaaaaagggagagaagagctgtgaatcttgtctgtttaccatggttaggagaagacaaaaaaaatcatctctcccctggccctacctttagtcaggattccacctagaagccttcagagcatgggaatccattgagctcaaagatcctgtgatagggaggattcaggaggttctccttgaggaccccgaactttctatttctgcgtggcccccttcagttgttcattaagtgaggtgtcgccttgcccgtctgtaaattggtgtcctgagcctagagcccctcccctagccttagttgggttcagatacccctggaagaatccagataaattaatctgctcaccagaaatttgctttataaaatacgaacatttagttaaatttagcttcattttctgggtcattctccaaaatggcatctctttaaagatctccagcttgatggatctttcccttgggggcaaaaataatagctgttaaaaagtgagagtgggtagccggcgtggcctctcgctggtgctggagtgacagaggtgggagggtggcctgggccagatggctccgcagaggcagtagcttcggtccgctctgtactgctctggagtgttccgtccctctgcttgttgtgtttacgttttccattttgtttccagtgacacatttagggtgaaaaagtcgccaaaacggtctcctctctctgatccaccttcccaggtacagtgttcctttgatcttgatggttttatgccccccccgggggaggttttcttcgcttgttgacaaagctttgctttctgctcatcccgggcctgtttccaagaccctcttcttgcattctgtgtggagggtccctcgatgtttgcttcacattgttttggtcccttcactttgcggaagatcagagtgtgtcccgagagtgggaagacgttcaggaaaaacattagttgggctctggaggacccactctgctccattcaggccagttcatctgctgtgaacttctaggactgtcgagatgagaaagtctcttgagatgaacaaatatgcagtgagaaggtgaagaaactcagcaagtgtcaggagcactgaattgtgcagccaaaattggagtgggaagaaaagggaagcccctcccctaaagaagtggggcttaggttctgtcttgattagagtccctcttaccagttcctccatcagatagattccatttcttctaccctgtttacagaccaaggaaagttatcgtcaagcctgtcagtatgttagggctaatttctgggtcataaaacaaaacagacctgccacccctccaaatctgagccagcaaagccccagcctgcagaccctggccagagtgggggcagtggagggaagcactcagccctggggataggggctcaggtcccagctgcagctctgtcctgacctctctaggttcccaccctgccctactccacttcccactctccagtggaaatggagataagatccccctttttctgcctccagggactgatgagatgcttgtcaggtgattctggtgatattgatgtgcaggcctgaagcactgtgtgagcctcgcacagcagtcacagtcgtaaaactagcaggaatgctcaagtaactaagacacaaaatcctgattttttttttttttaaattcatggtcattccctgaaacaaaccatcataaaaggagattcatagagggaagaatctgtgtgtccatctgtttccttaatggaccatttggagcagagtctgagaagagcatgcagaggattgtgaccgggacctgtcctggctaatgggtccccagacctgagggtgggcacagtttctgaccaagagtctgatgagacaagaaacagtttctcttctctttgcaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgagggtaagcaactctgtagccagctggacccccactctgcctcggagaatcctgcccctagggagccaaaggccaggagagaaacttctcagccaggtaaccacgtgatcatcattgtgagatcgtctgcacgtctcccgctgcacttgcagctcaggctgtgtttgaaaacagcctgagacttgaaagcagctgtcccttgacccaagactcctgctaagagccagcacggtgccctctaactccacctcaggactccatcgagtgggtcctgagcgcccactcgagctttgcccatggcttatgtcccctctgtgattttgataaacacagctccaagggagtgtcattcaagtcaaactctcagtgtaggtcactgacctggactcgcttggtgccaccgttattcctaggccccatactgtgttcagacactatggccacaccttttaatgaagcctcaaaccagagattcaccccaggcttgctgagagggcatgattccctcctcagaaatgggcagaaatgggctccggacaactttgcttatctcaatatccttcctcctatgtatattcaatttcagtgttttttctttttctttcttttttcttttttttttttttttttttgagatggggtttcactcttgtccaggctggactgcagtagtacgatcttggctcactgcaacctctgcctcctgggttcaagcgattctcctgcctcagccttgcgagtagctgagattacaggcgcgtgccaccacccccggctaattttttgtatttttagtagaaacggggtttcaccatgttagctgggctggtctctaactcctgacctcaggtgatctgcctgccttggcctcccaaagtgctgggattacaggtgtgagctaccccatgcttcctttttgataggaaaacctttttgaaggagagctagcacctttcttgggagggatgaccccattgccctgacctgttggtgcaccacgttcccagtcctccaacccattttctcctccagccacctctgtgaggctgcccagttggcattttgacactccagcttttgtgatggttttgagttttcctttctcgatttctaacaatttattttattatttttttgagatggagtctcactctgtcgcccaggctggagtgcaatgatgtgatctcggctcactgcaacctccgcctcctgggttcaagcgattctcctgcctcagcctcctgagtagctaggattacaggtgcgcaccaccacgcccagctaatttttgtatttttagtagaggcagagtttcacagtgttggtcaggctggtctcaaactcctgaccttgtgatctgcccacctcggcctcccaaagtgctgggattacacgtgtgagccaccgcgcctgaccgatttctaacagtttttttgaactgagtagaaatcactgtgaagaagatcacatgtgaaggtctggtctccactttttgctgctaataagagactaagatctcctttaaacggcttcctccctgtctgagtggagtggtggtgtcatgagggtgcaggtagattttaatcgtaactcaaaaactcccaaccttcttctggacgctcttccacagtcaggcccggaggcatggtttgctttgtgcccacgaggtcttggaatggtaccagcatgcaattatggtagatctatttcatgtttttcagagtattggatgcatatcttctccctacccaaaactgcctttctaaatttgacaatgaaaagatgatccaaattatgtatacttgtaccttttggcattttgttttctgtaaaatagagccttttggttggctgtcaggttggccctctggtttggggtttgagaggtccgaaagtgaccatcttggccaggcacagtggcacacacctgtaatcccagcattttgggagactgaggcaggcagatcacatgagctcaagacccaggtgttcaagacgagcctgggcaacatggcaaaacactgactctaccaaaagtacaaaaaattatctgggcatgctggtgtgtccctgtggtcccagctgctcaggaagctgaggcgggaggattgcttgagcccaggtgacagaggttgcagtgagctgagattgtgccactgcactccagcctgggtgacagtgagactcgtctcaaaaaaaaaaaaaaaaagaaaagtgaccatcttgctctcccctgaccccagaggccctacgatctggcctcagcctcctttggatccttatttctctctgcacctgcatccgaggcaggagcctgttcccggaacacccctcactcagctgcctctgcagtgctgctgtagaccccgcctgctggaacacccttccccccaccctcactgcactccccccacctcatccctgtttcacaccctttccttagtgctagcccctcccagcctttccctggaattccgctcctggctctgcccgccttcagtgcttgatctgggctgagctggggatatgaaacaccgtaataatgatgtgtgtgcatttcttgcttcccaactagcttgtatgtttcctgaaggcaagaactttgtcaggttcatctctgttcctcacagcaccctcaacgtcgtaggggctaaagacaggtttgtgaaataatggtaacacaaggtcaggcaggtcaacagcttagtaatgtcagctcagcaatttgatcctgcagtgggcatcacctgcgtcagatgtggagcactgcggggaaggtgctttatgttccagaggcagcaagggacatctgagcacaggcctcagacttggccattttgatagcacctatggtgggttacatctcttgagcttggtaagagatttctaaatatcggagaaaagcatttagaaaccatcctgaggttggggccgggcgtggtggctcacacctctaatcccagcactttgggaggctgaggcaggcagatcacttgaggtcaggagtttgaaaccagcctggccaatatggagaaaccccatctgtagtaaaaatacaaaaattagctgggcatggtggtgggcacctgtaatcccagctactagggaggctgaggcaggagaatcgcttgaacccaggagacggaggttgcaatgagccaagatcatgcccctgcactccagcctgggtgacagagtgagactctgtctccaaaaaaaaaaaaagaaaaaagaaagaagccaacttgagctggacatatgattttgatatgtgtgtgtctttagttttaccatcaggaaccaaatacatgcatttttttttccttaggaaatataaaaatactaacagtacttttagggctaatatatacctcattcaatggtggcatttatttgtccatcttctacattgtactaaaacagacaacttactagctgagtgacatatttgacagttgtttttttctgtaaaaattgaacaaatatgtaaatatatgggtttggaacaaaacttggttaaacccattaccttagaaaatgggaagatttgggaagtcatgactataatttaagctggtagacaataaaaaatccattaatgtgaagacacaacagttgcagtttcaggaggtgtgggccccactgcatccacctcgctaacacacccagggtccccccagcatctggacgtggaaataccattaatgtaatgaggtccagtctagcagcaccagacacacacccaggggtgctgatgtgattgatcgtcagaaagaatccgtgtggggcggggccccagctgtgatgtgagacttacactaaagtcaccaaccacaggaaaaggaaatgttgggtgagaaataataattatgatttaaatacatattcactatcattaattctataggtaacaataataagctagggcctgtcattgggtgaggacttactttgagctgtgcagagtcttttacattcatgatttcatttcatcctctcagtctgcagagtgcttttctacagttccccattttaggaacaaggatacagaggcttggagctgttagtgactcccccagtgtcctggcacaaatccgtggagagccaggtgtgcctgacttaacagctgtgctctttatgtgagcatggaacaggcttgctgcctgcgtctgtagaatgaggctgttgacctactcacactttcctacctaggtccataggagcagaatgttgcagagcttcaagttgtctttaatatttcaaaacacctgaatgtaactaggttagaaagatgcccaggggattaaaataccatatttgggctgtaattgtatcaactcactaggatgacactggtcatcttccacggatgaagaactcattgacaattataaatggttttctttgcgtggttgcttagtaaatgcccttttttggtgcagtcttttaaagcgtgatgcagtgggagaaaacttaacccatgtagtccttgtggaggaaaagattaggaactattggtctacacagctgagtcctctcctggctgtccaagagaccctgacagagtgcagttgttttagattcagaagtctcagtgactctttggtggtcacccagttgccctgtgtcctttaacacagctctgttagtccctccttcccactctgacagaggggaaagtgccctccttggaagcctcagctgttctttaacggcaggcgccgtctctgtcacactgcagacacttagaagggtgacggtggggaagctgggagcagcctccctgtctctttccctggactcttttcttctcccctaatataatgtcacttaggttaaaagttccagaaatactagccatgagcaggaatatatctgatcatgctcctttacatttgtgttacccatcgaagggtttttatcttaaagtatttcattttagcctacaaaatataagcactttgagctccacttggaagataagtcaataggcaaggagatatcaggcgagttggcttccctgatcctagcaatggagacctggactcagtggcatccttctggcttctgcatggggctctttcctgttcctagcaagcccccagcaattagagacagacgaaagcagcattgaaggcccctcgctgtgcagtgcccccatatgaaataattaccaaaagcagccctcagaaacgacaggacccgtgaacgatgactgagcctcttcagctaggagcagccacacacgttagcaaggaccatctcctccagttgagaatatgatgtgccacttggtgtggtgacatcacccttcctggcctgccagctgtgtgtggcatggtgtgaaaatagggctgaaattggatgtggtttcacccccatgcctgccctttgaggcttaggatttgaagcagatgagtgaaattttgaaaaccaagttcaggaagatgttttctcaaaatagcagagatcacccaagatgacaggaggaagtatttattttttttacatcctctccaggtcattctgtaaattataaatcaggatcccaaatgaccgtgattgcaacaagcagggcgtgttctgaagcagcatctccaggcgtctgccactcatctgggattgatggggaggagtgcgggccttctgaaaccaggcatctcacaaatgcaaacactaatgtgggtgtcagagtaccccacttttgcaccgtcagttgctccttctgaagggaggaatggggacacaggacagtgggaagggacttccttttggcaggtagcagagaaggcagatgagtgagctccgtgacctaaaactcacccagattcagccaccagaagagctgaggttccaagtgggacactttagtgaggcgagctggttaccagagccgggcactcgcccggggccacaggcccctggaaaaactctgcggtggtctgttgctcgtttggtgtgtcctgggtgccctgtgctgtactggagtgtgcttagagatttctgttacatcatttagggcatgtaatgccttggaaatcgtaatgataccttagaagaggcagctgattcactattattttctcaacttaaacagcttataatagaacagtaaaatgatagtcccagagttttatacttggaaagtgatagatagatctggaagagaccctaaatatcaccctgtccatccctgtctccttcctcctcctctctctctctctctcttttttttttttttttttttgaggcagtctcactctgttacccaggttggagtgcagtggtgcgatcttggctcactgcaacctgtgcctcctgggttccagtgattcttctgccttagcctcccaagtagctggaactacaggtatgtgcccggctaattttagtatttttagtagagatggggttggccaggttgttcttgaattcctgacctcaaatgatccgccagcctcagcttcccaaagtgctgggattataggtgtgagccactgtgccctgtcctgcttctcatttttaaggtgaggaggcgattaagactttacaaattaatgcttctgtgttaagttggggcagaccctggggttcaggcttggtgtgagagttggaaacacactttctctactcatctttattcaggatgcaacagggctttctggcctttaatcacaaaactgtcttcgatttcatgagctggccatgctgagtagaaggatatgtttgcctcaccaagggagatttagagattcctgaaagattgtccacgtgtttaagtagttgaggttattcagccatttgcaggttttatgaaagtcctccaggaaatagctcattttaaagctgatatttttttgacgatgcctttagcaataggcagaaataaaggggctttaaaccagaactgctatttatctttattttcatcttaaaaaaagttgaaagattaaacttgatggattgccactgatgctttttcacagtgggtttctgagcaggtcactcttcacctcttggttttctttttaagtagaaaagaggtatctggtagctctagattgtggcttctgtgaagacagaagtccattctggtcttatccaccactgtatctgctatgcctggcactgtgcaaaccatataggaggtgcttcatccgtttgctggatggggagttcagttgagtgtcagcttagtttccaggtactcgaggcaggcagtggtgtttgccgtctccattgagtgtatgggattttcaccaatcaatttgaaacaggtcatttctccacccattggactttactagtctttgagtttgaaaatagatttggaccagccctgaagacactggtagaaccctgggaaaggctccaggtgacttacaaagcttctcttaaccagcagcgctgaaggaacaatatcgtccttccctcacttcagagggtggccagagctgaatacccagagagggacaagtaagggtccagttccaaaacatcatgaggatgtatcatcccacgtgtctcacctgacagttacagaggaaacccgcacccagaatgcacgtgctgtcttatgggaacactcagcgcagagtgctcaggtctggccacacttgggctgtgcttggtcgtgccatggaattcctcaggactttctcagcctccctaatggcagaagcccctttacagcaagacatttaccgtttgtctgaaaatagccgaactgagccttttcttcaggctatatgagaagtctctagacagtgggcaccgtcagaaagcccagagccttgtgatagctcccaccctgcctggctcagatcttcccatttttttcctctggcactaacctcaccttttgtttttttgtgtttgtgtttgtttttgtttttgcagagttggattacagaaactcctatgaaattgaatatatggagaaaattggctcctccttacctgtaagttcgtctgcctcgggccacttaggggactcgctttcctgccttcaggggcctcctcccctgtgcagagtgtctctgggagctcagaccccaaatcgagtgttttctgtgtacacagcttcccgggtgcacagcagtgatggactggggctggggggttgaggtttgtactcaatccacttcgtttgacattttcagggagaaaatgatagaatacaattagacgtcctgcagaattactttcctagactgagaaagagctagagatttctttaaaaaaaaaaaaaaaagaggtggtgatggtttttcaggtatacgattagctgtttttgagaaattgttttaattaactgaatattttctctgggcaataagcctttctccctggtttttcattttaagaggttatgatgggcactgtctttcctggcataatacctgctgccctagggcatgttattccaagggtgacctcttgctgttgtcagcgatgccctcggagacgtgtggcacacaggagggcttgcttgcttacagcactacgtggccctggatatgttgctctttatctttctttgcattagtcatagatgccggggttactgcttccaaactgcaggttgctgtaagttagacctgaaggttgggtgggagaatgtccccatgcacaggcttaactcatgcgccacgtcagtgagatcacagcttcctgagtaaagcacatgggctttgtcatcatccccttgtgcgttgcttaaagagcttagctctgtggccacacctgtgtccccagtagctgaggccatatacataatactgagggcgagacattttaccgctgaaggggaactgtcgtgtgttttgagatctttgatttaaatggattgaaaccacaaggggccccttcctcttgtgccaccacccactgcctggtgcgttggcaggcctcgcggatgaattcgtgaggagcatgccctgctcaggaacagcagagccacccagagatttcatggcagtgcagagcagcatacctgccggccgttgcagggacttatttggggaccccagcagggcatgtggagggggtctttcaaggtcttcccatcactgagagatgccagtcccacagcccctgtttctagtccagctgagttgctctccaggccctgcccctgccctgggctcattcagctatggtcagcccaggtctaggctcttgccctacctctctgtttatctgcagtggccagcacagctcctggcccagagagcgtgctcagtaaatgttggtgaattgaacaaagtccagctcaccaacgccgtggcgtcttctcccctggccacgttcctacttgaactcagttgtactttctctgcatcctccttccctcctggcctccccacctcactcctaaccaggccccacttcctcctctcttcctggtggctccagaacaatgaaggcttttccctgatgggttatttgttctctgttgaagagtgctccagttttcatctccgttgcacgttcaggccaactgtacccaagctgatatgtgattttgatccctgcagcaggacgacgatgccccgaagaagcaggccttgtaccttatgtttgacacttctcaggagagccctgtcaagtcatctcccgtccgcatgtcagagtccccgacgccgtgttcagggtatgacttccatgatgagagagttacacatcatgctggatgttctaaagcctctgagcaccttcatgctgttattttgacttcatttcagtgcatagattcaggcggctgacatgccacatattttttttttttttaatagagacagagtctcaccatgatgcccaggctggtttcaaactcctgggctcaagggctcctctcacctcagcctcccaaagtgctgggattataggcatgagccacaatacctggccagcccacacttcagtctctctgaatgtccacagggacataaacgcattggttttgttactggctaccctttggactaaagtgaaatccttcagcagttgactgtgtgtcccactccctataatctcgcccagtgcacacacactttattccatcatttgtctaaagggggacactgtggcccagcattcaaagctcgaatcccacctgtaccccctcctggttgtgtgacctgaagtgaggtacttgcctctcctgggcctcagcttccttgaatgtaaagtaaaagtaataatgaaatggaccttgcagggatttgatgaagattaaaggaggctatccgtcttccagagcgtccccgagctgtgtgacggggagagggcactctgtctaccagagagatgctgtgtgtaaagctcttgttgaagtacctggcacacctcaagtgcctggtaaatgtacattattgatatgggtgttcatgtttgcatttatgagggctgatgtttggagcagtgcattgtttgatcaagtaagtgtgggcattgctgtgagatttggaccagcctatttttgtctgcctgcccctttaagcaggagtaaaagtgcttgcattgacttctcagacttacaaaagagactctgcaggctgcccagggtggtgagaacaatgatgatggtggttatgttgttaaaacagtagtggcaccaggtgacaggtaccacattaagtgctttacaggcatgcagcatctcatttaatcttcacagagaggtccattgtctccatcttatagagaaggaaatggaggcacggtatccagtcactttcccagagtccacaaccaagcagcgggtggtctgctgaactgcagagctcgggtctgtagccagtggcatctgtgcttctgcccctcccttgtcacttggtcctggggtgactgcccagcctagaggctgcatggccactggagacctggctcatatccctctggaagtccaggattccttgtgatattgacttggtcagggcatcctggttgatttcagtgggtttcccaatgagaagactaaagaaagatgccctttgcttcccccaggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattgtaagtggagttggagggccccagatcacaggggatgaggtgtgggccagctgcgtattgtcaccaagaaggccaggccttcagagcaacactcacctggcacctgccatgggtcccaccctgactccctgaccacagaagccaacctgggaaatcccataccatgaggatgaggggaaggttctctattcccaccagtatggttttgcatttcccacttaagtactttatatgccttcagggttatttagtttccattttttgccacttaggactagactgttgctttagggcagtcgttaagcagtcctctgccgcttcgtccttgatggcagagggcaagggacccttttttgggaaacagttagttttcctgggacttagtgatgggaatttctcctgttcaaaaccaggacttttcctctccccaagccctgtggggtcttgcagagcaaacagagctgagctgaaggcctcacctaccccccagtccctgcacagcacacgtgtcacatggccttgtgcattccccaaagtaagcgatgcccatgccacggtcttccacacatctgaaatgcaccatccttctaggtgaattttagttttatttcctctacctcccgcccagcaatccccaagcaggtgtgaagcccttgatttagtgtgttatttttgttgttctgtgttagtaggccatttctcttgtgcatcaaatgtttattgagcacctactatgtgtttggcagttggatgctggggtggatactagaaaaacaatagcaaaaagagggtctagatgtgaatcaatctctcacatgaatactctgaagcacacgtccatggttcgccttctacaaagctggcttctgattgtgaagtctttctgatctatcagaagacactttttcatttgaaatcatctttccgtgatttagaaaatgacctttaccaaaaccttacttcatatatatatatatttggaagtatttcttgaagagttatgttacgtttggaaaacccaccagctaactggcctttcaccttccgctggctagctcccactcactgaccagggagtgagggtggcgtgggggtgggaggacactgaaggctatgcttttggggagggggtcgggtctgccaatctcaagatgtgcattgtcagcatgtgggaattagtctagatgaaaccacaagtaatggcagctaattgatactctctttagcctcaaggcaaaaatgtccagcaaatggctgcatggcccttgcttggaatcaatatcactctctgttctcctctatttttcttgtgtgtcctcctctctgccggctttcagacagctcccgagggctcctttgcctctgctgacgccctcctcagcaggctagctcaccccgtctctctctgtggtgcacttgactatctggagcccgacttagcagaaaagaaccccccactattcgctcagaaactccaggtttgtagcccacgtgtgaccttttgggagtttgtcaaaacctcagtagagaatgaacccccgaggcccaaatgaaataaggcaggatttgatgaggaactgccgagaacgttcccagtgacatatcttcccctcaaaggatggtatatgtgacgttctttccccacgataccaaagtgatgtaaattgtgtgattacatattgaacaaaccatttctatttcaatttacaaactgggcccaaatagtcattatttagaagcattgatagcccccaaagcagtttctgtgatttattcactgaaccaagaatattagatcaccactgagccaagccgtttatatatacgtggctatctcagactcccagtgagataacatctgggctcagtcttgcatctggaaccaaaaacaatgatctactctgtgctttaaatttgacaacttaatttgatatcctctagactagggtgttcagagcaaacctagagagattgttaacagccatctgagagatgcagctccattcatggaaactattggccaactttaccttaagaaagaaaaagggaaagaaatgaaagaaaagagaacagtaaaaattttgatcccattttgaaaatcatttcgtattcaactgcacaatacttcctgacaatcagaagggtgatttttagaaaaggaaattaaatgcttatttcatgatctgctgaggtgctaattgtgagagaaaggcggagcgcgtgtttttcccgagtgcctgtcatgacacattttcgtggcacgttcatttctcggatgtggaaaccattgacgtctgtcttgatgcatttccctgcggtttgcccacactccctgtgggcaggaggagttagagtttgccatcatgcggatagaagccctgaagctggccaggcagattgctttggcttcccgcagccaccaggatgccaaggtaccggtttgctgctgcgtgcgccacctcctgagaatgtcatgtgtgccgctggggtccagaagctgctttgctaaccatccgccaggcgggcatcatcggtgtccagcaaagagtcgtttccaaaaagctgaaagcgtcactcttgcataaatacacactgagcacatagctaagatccatttaagtcgataatgctaaaccgcgggatagtaatgctggttaaatgagagagaatacagagaccaatgtatgggtcagtagggtaaagaaggctagcctaagatggcaaagttggatagaaaactggttagcaccaattcaacagagcaaaacaaaatcatgacctttgagggttttttttttctacagataccatttgcttctctattgagcaaacataatttgcaacttttctattttctgcaagttaacatctgactttgttgagacaaggccctaatcaataatacatagtaagtgaaaccaagacatttgataatattctagaccaggcttaagcaattctttctgtaaagtgcaaatgataagtatttccagccttgtgggccgtactgtctggcactgttccaataaaacttttatttgtctgtttgtttgtttgtttttttacaaaaaacggcagtgggccatttggcctgtggagtttcccaattcctagttttagcatggagtatgacattgacagggcatgcagaaatcttttcgcctggcttccaagtttggggtaacttttattaacaatttgaatgagttgctgatgacgtgcagaacgtgtgtttgcccctggactgcccatgcaaaccttggtctctgagggcggcctcgttcccacccctcaccccaccccaagttggacagcccgatgaacctggtgtgtcagactgtgctctgtggctttgaacaagtaggtgaacctcttcgagccttagtattgccgttcgtgagatgaggccaataatagccagtgtacaggttgctgtgaggatgacagatgtctggtgtgcggagagtggcaccatgcttgacacatagtaggtgtgtgataaaggaaagctgctgttgttagctgacacttccctcttgcttctgttacctgatcaggtgctcccagcatctctcctcggtgggtggatccgggtcccattttacagatgggagatggagccacttgacagtgattcaccagcctgttggggactagaactcaggtctccaagtgagaggcccctcgctgggtgtggtggtacacacctgtagttccagctactcgggagactgaggtgggaggattgcttgagcccaggagttccaggttacagagagctgtgatcacttgattgcactccagccaaggtgacagagcgagaccctatcttttaattgaaaaaatacaaatgggagcccctggcctgcctgcctggagtaacagctcatctgcaggggggcagtgaggtctgtgtctctcatccttggtacaagagtaggagttccggctgctgctccagccctgagggccccgcagtgaggtctccttggccatacccaaaagagagacccctcccagagacagtgggtgcttacactgtgggtgtgcaggctgggaacagcgagacccaaggcagggacaagaatgtcaatacagattggggatgtcctcgttcttgttgccaaaccataagcttaggttgaatttccatgaaagcgagatttttagaaagcatgaagcagtgaggattttccccccactagatttatttctagacatccttggggcctaaagacagaatgaattgcatgcagtttggccactgtaagtaccatgtattcctgtccagagtttgaggtggaattgagcatgtttggtgagtagctcagggtggatatggagtgtgctgagtgctttggtccccctgccacctcctttggagagcggccagagatgactgttggcaaataatggccaggagttgactttttgtcaattacaggctgttctcagaatatgtgccccaattctgagttagaaaatagagtcatgtgtgttcatagtatataggtcggagaggcagcccaagccacctcttttatttcagaggcgtatgctcaaaggagtattctgtgactgtcttggagtatatagggaatatttttctctagcagagtaacttgtattgcttttgttaaaaagtgcattacctggtgatgttggcctgtggaaaatagatggtgttcctgtagctacccagcccgagggtggtccacgggcctgacctcaagttggtccctgtgggtttctttttcatatagaaagattgttccttgctgcattggaaactcctgatgcataggaagagaaaacagcagctgtgtatccaatttgcctttttttctggccatatatttcagcggtaggtgacacagctctgtcattttgccaacatggtcttaagctgttgctagcacaaagatgaaatcacttggaatgaaaaatatcatattgcatggatgaaaatcaccataagctagagtggggagtgattttccggttgttccctagagcagctttgacttccatatctctctagactgatggagagctgagtcagccttgcaggagctgcagtgggggtttctccatctcagttagaaaatgtgagaaatgaggagaagtccttaggggccggggtgtcaggctgcagtctcaccattactttccttccacatccttctggtcaaacggaatttggttgtgtcctcctgggagtgaacctgaccaaggtcactggaaatgtggtacaggagccctgaatttaacactcagccacgtcagatagaacctgaatgttgtgtctgggtggctctccaagaggcacaggctgtgggcctttctggattgggggacccaatataaagacggaaggatgtgtctgggttccttaggaacaaggccatacaaataacaagcttcaggaagggggcaagtcctagcaagaggcccccagcacggttgagtggtgtggcccctcagtcctggcttagaagaggccgatgcctggagcttacatgagcaagagaaggagttggggccacctgtgttgtcgttgagcagcctggcagcatgctctgtgtttccctctccattgctgtgtcacagactacccccacccatacacacacattgagccgaggttcaaaaggagggagacgtgatgcccaaaagccacaagtacagcctgagaggagtgacaaggaccagctcgcgagcgcctgtgtatttggccgtttggagcctctgtggtcattggctggaggctgtgtcttgactcggtgggcaggagcggctggctgttgccagtggtgccacctgtgggagtggcataaggcctgatgctgagtgcctccccatgatcaccgctcctgctgggcttggggactgcctgtggtcagaattggatggggcagcacccagcggaggccactctcctgcgcgggtggcggcacatgacctggacaccctctgagcaccaggcctgtgtccatgcaccgtggccttggtccaggtggctgtcatctccctagctcatcctgactcctggcctcacccctccgtggcccctctggcatggctctcccagcctcggatggcaggtgctctccccagaattggcctctctctgctccaggggacagggatcctgccacagtgctagcccctcccctccatgtctggcagcagggaactgtcgacaagggggctacgatgccacccccagctgccagcaggaaggaccccaggcacagcctgcaggtctgaagtgggtgacagtggccagaggttctcacaggtcgcaggacttcagtggagtgaaggttggaaattggttacaaaggccatgccttctgcgtcacagccatttcacatttcaatttgtgattctagtggctttttttggcccctctaaagtagcaagtgggggttatgtgagagaaacaaagcttaatctaaaaatgtctgatcttaaaatatcagcgacagacaaagctatcaatttctgttaaaaacaattcttggttgtaaggggaaaccagagtgtacacaatgcatttcatcaacatgcagatactcaggcagtaattcaagagggctctgaagtcatctgttcctttattgaaaacaccaggtggccgggatgaaggggtcagtgaacagtctacatggtagtgtccatttgaattttcttagaaaccccattattttacttattttttttcattccctttcttgttttacaaaggattttaggcagcataaagataattaattccttcattagtcatatttagtttctgcccactatgataaagttagttttaattaaatcaattttctcctgcgctgcagggagcctgcttattttgatcagaattgaatctcattctgggaaaccttgtgccccagtctctgagattctccattttattcatcttcagaaggtccacgctgagtttgatggtgacaaatgttgttttcattttgaaattttattgctcattaaaaaaaacacacacatttgttgactttaaaagtgaatagtttttgtttttccttttaaaatcctttgcctttttaaaatttttttaagacagagtctcactctgtcacccaggctggagtgcagtggcgcgatctcagctcactgcaacctttgcctcctgggtttcaagcgattctcgtgcctcagcctccccagtagctgggattacaggcatgcaccaccacacctggctagtttttgtatttttagtagagacagggttttgccatgttggccaggctggtcttgaactcctggcctcaagtgatccacctgcctcagcctcccaaagtgtttggattacaggtgtgagccactgcaaccggcccccaatttttttttattaaaaatttttctagagatgagatctcacaatgttacccaggctgttctcaagctcctggcctcaagggatcctcccacctcagcctcccaaagtgttgggattacaggtgtgagtgagccaccgcacacggcccagaatttttttcagaattgtgtgtttatgaactttctccataaggacaaatattgagtcttgatctctgtgtcatttttcagctacttcctgagaagttcccccatgacaagcagaactgtgaaacccattttccaatagcagagatgaacccctgcatgtgaggctccggccctgcggcttggtggtgcccttgcttctgggaggtcagcctgcctctgctgagggctattagtatatattctggtcaagcgtccttaaaacggggacttcttgagggcctgagcctgccctgttctcacatgagcgagtctctggggtctgcttgaaggggactgtgtacttccatctctggccagtggatcatttgggtcctgcttcagggtcaccccaagtatgcaaggccaggcaggggccaagaaacccaggcaacagacgttcaatcttccaggacaaccgaaactatatagtttcaccctgcatgtatacagctaactaaccggtcctaactcagtcatctccggtcctatccattaaacttcttgagttttccaagctgtctcccttctcgggttcattttccctgatgctgtcgtagggtaggcacgcctgttctggtggtggaagagacaaattctgcacaggtacctttaggtcctcccccttcccagttaatgttggctctttaatcttacctgctgtccttgataagccctcattattctttccccaaatctctctctctctactacactgtggtagccttccaccattcaatttcttctcataatttcccaagggaagaagcagcctactctgcctgttagagcactctagtattgataactagggtagaggttcgctgggcagccatgacagcgccacgaggttaatgcataggactgagagtgtggttggtttgatgtttcttttgcagtagaagtagactgacaacccggctgtgctggtcagtgatgctgctaacaccgcatttcaactgtgttgcaaattgccgagcattttgtgcaaagggaaaaagaataaccacagactcctcctcacctgtgggaggccagtatctgtcctccacaaaaggctgtaaagcctcaaccaacatcagttgggtgggttggggtggtggatcatgccacttgttcagggtctaatcagcagatgtggatattgtcattgacccagtttttaattttcccattaacgtaacagacttcatggcaacagaactcttacataactctaacataactccaacataactcttacatccagagactctacctagccaaaggtgatattggttgacaactacagtaggctttaagctttgcgtgactcacatcctttcaaacagagctaaacaaatgcccccaaaatggaaatgtaaacagtcttacaaaagtgatcaaatctgtggttattcaaaactaggcaaacatagactagaattcaacattattcaccattgagatctcattttggaagtggaggctgctgaatagtgccctgggttctcaggcgctgtgcctaagtggctcagtgagtgataaatggcagagataagcaggtaccagacatgctggactccaaggcctcggagcttaaggggcctctgccattagcccctttgtctgcctgcccaggtgcagaatgatagatctccatccatagactggactcggcatttccctgttcatcagtctttgcactttctcatacttttgatgttctttgtttcaaaaccatacaattggcccattcatgagagggtgagtgtaatcctctttgtcgtatgattaatgctaactgttttttttttaattaaaaacgattccacagagagaggctgctcacccaacagacgtctccatctccaaaacagccttgtactcccgcatcgggaccgctgaggtggagaaacctgcaggccttctgttccagcagcccgacctggactctgccctccagatcgccagagcagaggtatcgtggcatgtggtgtaattaccctcttcctgccacttataaatacgtatgctcgtggtccacaaagccagagtctttggagacagactttgtcctctgaacgctgcaggcaaagatgtgtggcacaccatgcgttttgatcttcctagacgctatcgtgtaatgggccttttggccttgttgaatttacaacaaaaagcatgcccctttcagttgctccccagtgggcactgtgaaagtctgatatctggctgctttcttttttatgctcggggaagttctctgaatgtaattatggtttgttgtaggaagttttcattccacatttattcaccgtctccttttcttgatctatgaattgctcagagctgaattcactcatttggggctaacctttctcttcttctctctgaaactagatcataaccaaggagagagaggtctcagaatggaaagataaatatgaagaaagcaggcgggaagtgatggaaatgaggtcagttggggagctgggccttcctcgtgcctgagggatacttacctgtggtttaataatgaccggagctggtgtggtccacagaagagtgtcttctgtggaagttctctcttctttattacacacagttcatatttttctaaaagtatttttactctattactattactaaaatagcatgcacatgaattaaagaatgcattcaaataaatgtatgtacaatgcaaaacagatctccccactcagcctccagttccacaactcgcaggtgactatcttctgtttctggtggatccttccaagaattttccatttctcatcacaaatgtaacaatgagtgtaaacagcctcttttttctccaaaataaatgagagcttgcagtatacatcattctacactctttttaattaattaatttatttttttgaaacagagtttcgctcttgttgcccaggctggagtgcagtggcgccacctcggctcactgcaacctccaactctgccaggttcaagtgattctcctgcctcagccacccaagtaactgggattacaggcgcctgccaccatggctggctaattttttgtatttttagtagagtcagggtttcaccatgttggccaggctggtctcaaactcctgacctcagatgatccacccgcctcggcctcccaaagtgctgggattacaggcatgagtcgctgcgcctgacccaccactctttttaaatttaatagcatatttttgacgtattttttattcctctctgcctcactctgtttaacaggtgcttaatggtccattgtatggatataacgtaattaatttaaacagtctctgtggacaaacatttaggatgtttcctgactgtagcttaaatgatttattttcatttgtggtatgttgtaatagaaatatagtcaccatgtatagtgtacataagtgcaatggccgatactagttttttttgtgtgtgtgtttttgagacggagtttccctcttgttgcccaggctggagtgcgatggtgcgatctcagctcactataacctccgcctcccgggttcaagtggttctcctgcctcggcctcccaagtagctgggattacaggcacctgccaccatgcccggctaatttttgttttgtatttttagtagagatggggttttaccatgttggccaggctggtcttgaactcctgaccttaggtgatctgcctgccttggcctcccaaagttctgggattacaggcatgagccactgcacccagccccgatactagtttattatcaaaatcaattgcattcctggctaccattttaagcagaaaagcgaactgtaggtaatcatatcccgttttctaggtcatcgtaggatcttcctgaaaattctcctgttcgttccttctttctgctgatggttccctgtgaccacctctggacattgagcctagcgtgctatttcacattcaaacgaaagccctgcatttgcattatttttaaacctctttgttttttctcttatttgggggtatgggtggttctagtttttttacatgcactgaaaatgaggcatggcacccaggaaggctgtaagttctgtctctaatttcttttgcctcctgggagctttgccttcttggtgcctggggagtgcttattcgtggtttgagaagtcgtaccactgaggggcccccaggaggtgccatttactagctgatgtggtaggatttcaagatgtcaccagctggtgcagatgtaccggcatttggtagcccgaatgtcagcccgtcagcctctggagctagactaggtgaaaaccaggctctgcttcccagccactccggggcatcttacttaactctgcctcactttgcttattaacttgaaaatgggggtaaataacagtgcctcaacagagtagagcagaaggattatgaacaaaggctgcggagtgtgatgcttggattcacatctgggctctgccacttggcagccttgggatcctggaagagtttctgaatcactctgactccaccccagtgtcttcatcagtaatgctgggaacagtgagagcactgcctcttagggtcattgtgagggtagagtgaaaaaacagcacagctaaggtattttcaggtccccggtctctccacgcttccaaaaggacacgtcccttacctccttgtgtcctcagcagtgatgagtggttagacagggcagcctcaaagatctatcacagcttggtgattctgagatgcaaggaggtgttgtttaatggcagaaaacacagaattgctcctgtgtaggatttggaaagaaccctcggaggctcatctcatggttacctttcttgggagtccattctggggtgagacactgaccttgggaccaaggttgagcagccaagggcaggcacccagcattagactttgcagaatgcattctaccttcattatcccttttacccttattgaatttcccatacagccctgaaaggtggggtctaggaaaatccttactctaccaaggagtaagcagagcgcccgcagcttccatgaatgtcgtgctcagggtcacacagctgggaggggcaagctcagcgggatcccaggcctcctgaccggggtgggggtctctatggttttctgtcattagggtcctggatcttcaacagttatccgctcttggttctcttgtggggaataattattggataatgtaggtgaacccctgattctttttgagaagtttcttccagcagattggctttggagaaaagacgtcttcacacatcagtccttccatttggggacagctgggaggcagtatgacaaacaggggatcttagtgcttttgtgcagttactgtctattgaggcttcccaagaagtttactctgggccagtaggagatgagatttgtgttcagtgatgccagatgcatgagatgctttggaagaagatgcggataaaaggtaatagggttccaaggagaaatcaaggaaggcttcttgaaagagacaccatttgaattggaccttgagaaacagactgtgaggggtagaaatagagagaaagtgaataacatgggcagaggcatggggatgagaaggccgagagcaaacaagaaatcgttggttctcgctgagccactgtgttcatgacgtggtgtggaaggaggtaagatggatgagggaggttgggcccaggttgcaaagacctcagttgtcgggctggaggtttggctttatttttaatttttaaatttttttagagatggaatctcgctctgttgcccacgctggagtacagtggcacaatcatagctcactgtagcctcagactcctgggctcaagtgatcctcccacattagtccctcgagtagctaggatcacagacgcagaccaccacacctggttaattttgtattttttgtagggatggtgtttcaccatgttgcccaggctggtctcgaactcttggactcaggcaaaccttctgccttagcctcttgagtaggtaggactacaggtgcacaccactatgccttattaatttttttttcatttttgtataggcaggatctggctgtgttgcccaaggtggtctcaaaatcctagccttaagtaatccaccagcctcagccttctcagtacctgggactgcaggcatgcaccactctacctggtttgattttttttcttagtgggcagtgagggatgttgaaggctttgcacaagggagtggcatatttagagtcacgcaccaggaaaatgagcgtgcagggcgagggctgacattgaaggtgaccctggaagttggggccctgctggacatgggtcaggctgtggcgtccagctgtgtgagatggaaaaccattctgttgtcatgactccaacgtgtctttacttctcttataggaaaatagtggccgagtatgagaagaccatcgctcagatgataggtaggtgtcctgacctgcggggcctcaggccggccccgatgtttctgaactatgaggaggccttggaagataggaggctcagagtgggtttctggtagagcgtgaagcctttcagggaaggaccagagcattccagaaaatatggctttgccccaggacagagtctggggcttcttggtaacacccccctgaactgtgccatagcattattcacacccatggaaagccatggcagtcacctgccagccaccatctgactcagccaaggactctctaccttgtggggaaagagattccttttgggtgggatatttgggggattttttcttttcgcttgtgggagataataggaatcaaatccctagaccctaacttagtttagactcaaatgacacctcagcctttccacaaggacccagggacaaggacagtggaccacggcgtgattgtccgcctccttcctcccgtgaccatggcaggccctgttcactgaccccagcactgtttctcactgagattggacgctgcctcggaatccttcttaacacggcgtccctggcagccagtactgagaaatttgctttggctcacaataaaagaaggcctcaagttataagctacacatccctgggcttttttttcttttcttttctttttttttaaataatgagaaaagatcttgcagaagttctaagcccaagtttttatgctaatggtcactattcagaaatcatattataactgggtctgtgggatttttttaaaattaattaattatttgcttaggtttatgataatccattttttgtttgttttgggatggggtcttgctacgttgcccaggctggtctcaaacttctggggtttagcgatcctcctgccttggttgcccaatgtcctgggattacaaggcgtgagctaccatgcccagcccatgataaccagttttgttgttgttgtttgagaccgtctcgttctgtcacccaggctggagtgcagtggcacgatcttggctcactgcaacctccaccccccaggttcgagcaattctcctgcctcagcctctcaagtagctgggattataggcatctgccatcatgcctggctaatttttgtatttttagtagagacggggtttcactatgttggccaggctgatgttgaactcctgactttaagtgatccacctgcctcggcctcccaaggtgctgggattgcaggcgtgagccgctgcacctggcccgataaccagttttttttcttctaaggatatatggagtaaaaactccaggtcactgcagaccacgctttatgtgtccaagtttgacactgtgctggcacctggtccccacccccaagcatatggatgtatgagtcacatcacacctctagcttgtcccaaggtaaatataatagtagcctcaggaatagtgaagaggccaacaattgagtgctttccattcaaaggagcttcaattttgatttattgtaacaaagttcatttcacccagaaaagaagccctttcatgtttagcctcatggtgcatgcttcctatcaaagtgaaacttctttattaaattggtataagaatttatgaacacatatggataagataaaaaaaaaaactcttggagttgaaaatgctggcaaaaatggtcaggctaagggattgatgtcttccttatgtggtgtttggcaagtagaacacaactttttggcctcctggagtcttgggatttgagaacatcactcaggccctccatagttcatctggaaacatcctgctccatctcagagccatacactttcatttttgcccttggtgatgacattttggtaaatgttgaaatgcgggggaaagggtgtgagcttttgctcctgagagaaagctacccaagccatcttttattgctcagctggcgaagttgatataaacagacattccctcttgaaaattaaaagtggagaatttctctagttggcataaatgtcctgtccttgtcatgacagaaagattactcccacggtttcctcaaagaatatctgcaggtgacagcagtgaggaccttttcaatcctaggcagtgtgagttccctccaagccctggagagaatgccacctgccttcctctcatcctggtgccaggggttagggccacacatcaccccccatccccacccctgctccctgatgtgtttggcctgaggggccctctcttcaagagctgtacacacaatcccttagaacattttcctgtccttggggtactctctgggtggcccctgagactgctccagtgtccctggctgggagcagcactgccacacagaggggcatctcactgtgtgtccgttccccgatccccatcctcattcacccattgaccgtcctctgtcattccaaggcttttttcatcaggtgacaggcctgtggttgtcattccttcagccactgttgcaggtcattgactaaggtcaccgtagatttcaaggtccttgtgtccttgtggaagacagcagggggctgaggcatggctgggactcactgtggctcttggcaggacgtgccttctttctggcacggttcaggtcagggtctctccatgcttggtaacatgcccaggaggcccacctgggttccatgcttttctttccattttcactcacgtaaccagcatcccttgtgaaagaggaaactcaggcccagagagattggcagttcaggaccaccgtgactgtagtcgtattttgaagtcaaaccagctccagcccacatgtctagctcttcctggctctgctccattcagctttcacagatgctccacaccagtgtgacatcagtcctgccgttgttattcatttgcatcaaatgttactggagagatatgttttgttaagctcacatagtgactatttagaattcagaagagagagagacttctgtgctttctgcattccaggttgttgcaattgatttttttctgcttttctaacaactgccctgattatctgttttgcttccattttctgttgcatcttgccctttgcttgcaaaacaaacaggcaagcctggtaagtaaacgcttttccccctaatttgacacctgcccattgcaaccctttgtttgtttgtttttctatttttgttatttttgctttgtgtattgctgcattccccccacatgatttcatgatgttttgcctgaaaaagccagaaaagtcttcaggagcattgttttgttgttgagtgtagggtgtctttctcctgatttgaagaacctaactgcgtttgtcatgtacaaaaggatttgtgaagcattcttgcctcccccgtctcctgggaacggggtaattctatttttaaaaagggttaggttgagaggaaaggaaacctgaggcaggtgaagtcttggatccaggaaatcagatggacttggtttggtaaacagctcctttaccaagtcaggtgaaacatacacatgggctcagatcagcccagaatatacaccatacagcgtgctgggaactaagaaagcagccagaattccaagaataaaaacaagcatttgattattagagacatgttgaaaggccctttcttttaggagtgtgggtgtggcaagcaggttgttggcgattctatgttaaaaagctccctcttcgcaagccactgtgacactgttgctctgattccaggggtcacagagtttattatggacaatgaggctcttaataatgggttaccaatacaggactcttcctccttcttgggggctttatatacattttctcatttaatctcctgcaaatgccaggagatacaaatactctttcttcctattttagacaaggaggctgagactcagagagtttaaaaccctgctcaaggtcactcgtatggaaagtgtcagagtgagagctcgaactcaggcagttcagaggctcctagccactggcctgggcagctctgggctccagaggctcctagccactggcttgggcagctctgggctgctggtggtgagcgctctaggagtcccacgatcgcagaggcaggtgggaaggatattcggcatcttcagggccagtggttctccaagcagggtccctgccccagcagcatctgcgtcactggggaacttgtgacctgtgcacgttctctgccccaccccagacctcctaatctcacgccgtggggtggggtgtagcagcctgcgtgtgaacaagcccttcagctgaataaatccacactcacgtgggagagtttttggaaatgaggtgctgggaccctaagaggtcagaactttagagcaagcttatgtcgggaccggagctgaaaccgaggaaatgaccccaccacaccacacggtaacagtgtgcctagtcctggggtatggcaaggtgcagatatgtccggaacctaagggaaagaaactcatacaacaaaatctccctgctactaagggagctgcatcctccaaggtctgtcattacatggggcccgtgtagagacgtggttatgatcacggcttcaggcttggctttgggctctgccattttctcagtgaacagtgacttagcttctcaaaccctctgttccgccttctgtaaaatgagggtgagaaaagctgcccgggtggttgtgatgctctaagttgttcactcgtcgcatggacatgtatcaagacatcctgtatgcccggcactatcctaggccctggggcagagcaagtggacaaaacagactctggtgcctgccctcacagagcgtgcattcatcagggagatgagccgctgatacaccagcataggcacgcacgcacacacgtgcacacatgtgtgcacacatctgatacaatgataaggggtggctgctgctgcaaagaggaaaatgaaggactctagaggaagaggagccatttccagtacctctggggaggtgacatgggatcagagccctgagagaatgttggagagccctggaagccctggggcgggaccccctggggcattggaggccttcgtggctggagcagagaggcctgggagggtagagggcagagcatgtgggcaaggatttgggtgttatttccatttcagagggaggtcactgcgggggagctctgagcaggagtgaggtggcctggtttgcacattaggaagctcagtctggctgctgagtgctggcttagggacagtcaacacctagagcaatcagcagggtgcccgccacatggaagggtccagtcagcgctggctcccgttgttctgttatttccagatgtgatctgtctatggcagccagccctcggagtcattccaggtggcaggcagccccctccccagtgacgagggcctggtagaaagacaggtctgctgagctccttccccaggagctctgagtgggcgcttctcccttccccactctgctgtcaccaagagagcaaatggttcctcacccacctgggccggggatggatccgcacagaggacagaggggtgttttgtgtagagtagtcagagaaggcctttcccataagtgtagaaatgattttctaagcagccataaaaaaagaacaaagtcatgtcctaggtaccagcatggatgcagctggaggccattgtcctcagggaattaatgcagaaacagagcgccaaacactgagcattctcatttataagagggagctacacattgggtacacacggacacaaagatgggaacagaagacgctggggagttcacagtgggggtagaagggagacgggttgaaaacctgcctttcaggtactatgctcagtacctgggtgacaggctcattagaaatctgtaccccagcattagtcacacagtatggccatgtaaccaacctgcacatgtgccccaaatctaaaaatatacattttctagatatttggggcagattattagcttgggatggccaagggccggagaggtggggcagaggacaatggttcctctcaccaggatcagccactcggaactgagccaacactgaattaatattgtacatcactgagaagctaaccttgacggaaatagctccgtgtttcttggagttacaacacttgctgtatcgaagacgctatctgtgcctgcgtgaatggaatttcagaggagatgcttttttgggctctgggtttccagatgtgttaaggatctccaaagacctcctctctgtcctgatacataggagggcccatccctcacagcccagacctcacaccctttaatcgtcccaacgcaaaattcactagcgatgtcttcttttttactttacggatctgtctgcttgctgtcaacaaccacatagaatcaccagggacaccaatatagacctgtgaaggggccgtactgatcaggttaaggaatagtaatggctcatttctacctcacgcgaggctgcacaggcccgggtctgggaagccagggctctggtttttgttctgttagagacagtctgggagggctctggggcgtgggttcgtcccaaggaaaagctggggtttgagatgcccccactggtgaggctgagttgcatctgaggcctcggctggccccagagacccagtttggactttctgggctccatcatttggctcctggtctctcctgccagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaaggtagggctgagtttgggggccacggaggaggaggatctgattgggagagattgtgggagcactgggagggggtaggattccagaagttggtcttgagccacctgcgaggagggggtccatgcaggctggggaggcagacttggccgcctggggttacacctgcatccgagagttcctggggttcccaccagtgctgggcatttgttctcgtgggcttgacgcctgtcctctgccctgctgtgtcagaatgaagaggtgttgaagagatgtgcgcaggagtacctgtcccgggtgaagaaggaggagcagaggtaccaggccctgaaggtgcacgcggaggagaaactggacaggtaacatttagccactgggggtggctcccaggggcctcccagcagcccttttacccaggcaggctgggacctctggcagcgcctgtgacattggcttggaaagggggcatcatccaagtgtgtgtttcaataagactcgagagaaggcacacagttagcatcatttaatcagtggaggatgcgtgttgcaatgtccagggtgccccggcaccttggtctcatggcaatggaattgggtttggtgttctcatgggcccctgtgctccagctccagttggtggcagctgtggccagaccaggccactctccctgcctggacctgggaagcaggaggtgtctctagtgatccacaaaagagtgataattctgagctccctgtctccgcagggccaatgctgagattgctcaggttcgaggcaaggcccagcaggagcaagccgcccaccaggccagcctgcggaaggagcagctgcgagtggacgccctggaaaggacgctggagcagaaggtaataggggaggggtgtggcctccaggtgggccgggctgctgctctctgtgctgctggccagtccagctagacaggctgggcttccctggccactgctgctcctgaagacgaattcatgcttcatgagcatacccttggttccttctagaagttccaatttcatgccagccctaagaccagcttcctttccaccgttcctggaactgcagcctgcatgtgtgtttactgccattttcattccttttcaacattcgtttatttgttggatatttattaagtgcctacaatgtgttaggcgtagcccttgaacctctgcatccggcatgcttactgggtgagtggatggggtgcccaccaggccctggcagtggtggccagctgatgcagaacatgagcagtgtcagggctggaagggcgcccaggtggcctctaattccagggacaggggtgatcttcccgaggacactgagcttgtgcgcaggtttcctccttttggatctggcacccctccatccactgtgagcactgtctccctgggtgtccagataagaagctccctcagcccaggagggccctctgagcgttgggctgttgagactgcgtgtgtgtgagtgagggccagcctccctccttggatgtgtttctcaaggagaggatttccagatgtgcagcctccttccagtcaatttcctgagccttggggttcccctgcgtagtcatccacgagcccagcagcctgggttggcagcacaatttttgcattttgggccttgataggcagtgatggggcatcctttgttggcatcagaaatccatgtgcctcccgagtggcctctactaccgcaggagcacccagccagccccaggggattggccgtcctcctttgcccactgtggttggtggtggtctctaggggcatttgggccaagcagtggtgatctctgccctgggcaggtgccagtcctcactccacctaagtaatgttggggaaggagccctggggagcaagaaatggggctcctgtccccactgcaccatctgtcatggccctgggcaagcctcgcaccccacctcagtgtctaggttccatctagccctgaaaattagaagcctgtatcgttgggcagatggatttccctgaggtccatatctgatactcacccagtctccactaggccctgtgccctattggatgttcctggttatccagaatttattcatattacagatcattattttcattctttttttttttttttttttttttttgaggcagggtcttattctgttgcccaggctggagtgcagtggtgcagtcatggctcactgcagcctcaaccacctgggctcaagtgatcctcctgcctcagcctcctgagtagctgagaccacaggcatgtgccccctaccaggctaatttttttaatttttgttttcgtagagatggggtctcactttgttgcccaggctggtcttaaacttctgggctcaagcagtcctcctgtctcagcctcccaaagtgctgggattataggtgtgacattaatttaattttttacctttcttcttaggatgaaaaagacagatggctactagacagttttaatatcaaaattgcattagaaaatagtttggaatatgcatatgttcaactacctgttttgtaggctctgatgattgttcttagcagtatcctcagaacgacatatgcggtcacaactgtcaagtgcaagtttttgctcactcacccagtatttattgagcatcattatggttttagtgttgagtgtgcattttctattccttgtctcttgataatctatgtatggcatatttggtgacttgaaaaatggaatgtttcattaaaataaagatcatactagaagccaggcatgttggcatgcgactgtggtcccagctattcgggaggctaaggtgggaggactgctggagcccagaagttcgaggctgtagtgcactgtgattgtgcctgtaagtagccagctgcattgcagcctgggcaacacagcaagaccccgtctctaaaataaagaaataaaaaccatacttcacagtcattttggctattgtagcagttgaacatacaatgtttcttggtgagaaatgtagcaatgtgtgtgtttgagatggttcccccatttccatcagggtttgatggtgtttaaattgcattatcttaaactgaacttccagaggaatgaacaaatcacacaggttcttccctgaaagacctgagtgatatctaggggatagtcccatcttaaagagattcagaaacatgattcacccagacaattcttgaatggaggcgctgggcatttcgcccaatcagcgctctgtaaaggcttttgctccatgagctgagctttatgatgaggcagtttgcttagtggtggctgatgacgccaagagagagcttggaaaacctccgggaatcactttctaacgggtctgctgatgcctcttagccatcagtcactgtacataacgttgtttaacagttataatggcaaagccatataggagctggggcaacctgaatttgtgttccaggcttgccacatctgactggctgtgtgaccttatacacaacccttaacttctctgagcctccatttcctcactgaaaaatgaggataatactggcttccttgaaggcactattgagggaaccaggggaggccagagtgcctgggatgtcttcagcatggtgagcagctcacggtgggcactccaataagatggaagatcaccgttagcagccccagcaggggccatagtggcaatgagagttttttttttctttcttttttttttttgagatgaagtctgtctctgttgcccaggctggagtgcagtggcgcaatctcggctcattgcaacctccgcctcccaggttcaagcgattctcctgcctcagcttccctagtagctgggattacaggtgtgtgccaccacgcccagctaatttttttgtatttttagtagtgacagggtttcaccgtgttggccaggctggtcttgaactcctgacctctggtgatccacccgcctcggcctcccaaagtgctgggattgcaggcgtgagccaccacgcccggccaataatagtaattttaagattagtggtcagtgctgtatcccattcagagccccatcgtccagctggcatttcagtgcctctctcgagttgttgacctcagatgcaaatttgagccaggaggtgggccagggttctgtttgaggcaggcttctcccacagtggggactgctgctgggaaggactggaacttcccctccactgaggagagccacttcctcccagcactgacacaatgatgaatgacaccaggagttctaacctagaaacagagggcacgtggctctgggctggaacatgtctcaggagttctgaggttttcagggaagggctctgcacagcctcagggacaggcttttggtgaagactgatcttccatgggaatctcaaggaaaagctggctgcaaaacatccccagtatgctggagggatccagcccccttggagaaggccattggagatcggtcgtgctgttgaacttgatcagcatcagagccagcatgtaacctatctgaaagcaaagccacacgtccatgatggagggatcgtcccgctggatcccctcactttctgagaagatggacagtgtaggatcatctgtgctagacaaacctgtggttggttccccttgattagacaggcaaggtgtggtgggagaatcaccttaaagccagctcgcatctgccccccaccccccatgaccctgtagccacagcatcacctatttggcatccctctgagcaatgccagtgatcccattcacgtagaactgcgtaaccctccttatgctacatctcaaaaaagccaccgaggggtttaccccagacgctcctcacctcagatcacatccttcccgggcaaataaagggaaaggaaccagactagttagtccttcactctgtgctggtcactgccaggaaactacatttatcacctcatttacttctcagaaagaaacatgttatcacctatgttctagagataaggacaccaaggctcagagaggttgtgtaacttgtggaagatcacacagctacagctgggatatatactcagattgtttggctccaagtcatttgtctcactgctttagtggggaccaaggggcctggtggtcccccatctccccaaaaagccccatgagcattctgactggccagatttcaaacatcagcaacttcttccttgtcttcacttgcagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaataagtgtgcctcgaatttattttctgggaagggttgagtcttttctcacctttgtcaaataccagatttggcttcgtgctcttctctgtctgggctcatttctttgtccatagacttaaataatatttcctttgttatcgtggctgcatttgtaggatgaagctaatgagaaatactgactttctacttaaataattaagtggaaattaattaatctcagcactggattagctgagatttggtttttacaaagcctcatgactttaggaagcaaatctatttcattttattgagtcaaggaagtaacagactgccactctttctgttcaatcctttagtgtttgaaggtcaacctgaaacccccattcccctctaaagaaagcactgggaaagggtgcacaattgccagtggccggcaggtaattagggcactttggagattaaactagcagtgtgcctggcctgagatcgcttcattgctgccgacttgctcagggttcccaggttgaagggtgggtggatgaggggagtcgggggtggaaaggtgtgatcatttcctagggctgccattaacaaatcactgcaaacatctgcagcttcaaacagcaaaatttattctcagttctggaaggccgaatccaaaatcaaagtatcagtggggttagttcccccaagaggctctgtgggagtctgtcccatgcctcttccagcaactggtagctgctggctctccttggcgtcccttggcgtgtagcctcagcaccccagtctctgcctctgtcttcacgtgaccttctcactgcgtttgagatttccctcctttcttataagaacaccagcattggatttaggccctcccccatcaaggatgatcttagctcgagatcctcagttacatctgcaaagaccctgtttccaaataaggtcgcattcacaggtaggaaggattaggatgtagtcatatctttttgggtacatgtgtgtcaatgggatgtgtggtatgggctgtaaacttggaaggcagatgagagcccctgatggcccagagcttgactgtccctctttctgcctcggcacggtggctacgggcaactcctctcacagtaggacaacccccacccataacaggacaggccttaggcagcctcagcttttcggggacagggtggggtgttttctgtgatttataaggtggatgaatttcggctgtgccagacagctccaaggagagaggactgcacatgtgctgttggcctggcagcctgctccgggttggggggcgggggggcaggatgcgcggcgtcttttatgctctgagatcctttgttttctttctgctacactttcgaaatccatccagcagagcctgcctctggtgccactgagaccctcacctgccaggcaccctaagccagggtagggaactgcctccttcccactgccagcatcctttgcttggtccagcctcctggtcacagcatgttccagggcccagccatgaccccttacccaggtgctcgcttctcaaggccaaatccctgctctgccctcgctctggattctgacctcgactgcattctcagaaatgcccagcttgcatctcttggaaacttctttctcattaagtaaaacatttccattgtgaaaaaattagaaaacaggtaagaaaaaaagcttataacccccaaactaagaaactgttaatgtttgtctgtatgtttaatggcctttttctccatctgtaaaatatgttatttgttatttgtatttttaaaagtgccacccgtaccaccctgtgcagccacctgtggtggtcctgcatacagttttggagacttttttcacctgatactataatgtgaccatcatgttatggtaaactttttatatcaataaatatagcccttcatcattttgaacgctgcataacattccatgcaccaaaatgtgtttaaccaaccctcaccccggtactgatgagcgtttatattgtgtccatgtttctc

SEQ ID NO: 16742 - DNA, 9634 bp, Human
accccttggcagcctccctaccctaaagaccgtgctgaggcttcctgggcccctggaaaagtcagattagtctggacttcctcctactccaggaagccttcccacctcttctgctgccaccccaggcaaacataggggccctctgtgctcaacactgaattctaaactatcctcaatttcactctctcttgcctgcagcctgacgtttccccccagggcttggcaaaggcaagagtgcctcggtgtccggcacaaggcctgaccgcatgggtgaagtaggttcctaaaagccagctgcggccagactgtgggggtgggcacagggtgtcaccctagaactcattaggccctggtcatcatggcacctggggcaggggaagtccagcctgaggggtcaaattctggctgcaaatcctgaggctgcctcctgtgaccacgggcaaggcacttattcttctaattgccagtggcctcattcataaagcaggcgtcctaatacccgcccaaggctgcggtgcctagcatgtgacctggcccacagaggcactcggtccacagatgttgttctctacctgcccccttcatttcgctggcaggactgcatgcagtgggtgtcaaggttgggcctcacacaggggataagtgagggctgatctgcagcccatactccacacacccagccatgtgccctggtgggggctcagcctctgcctggcagaaggggccctttcctctcacctgcacaacggtggcttcccagcacaaagggcttaaagtgtttgggaagtttacacccaggaaggctgtgggctggcctggcatagtgggctggcgagctggtgcactgtctctggtatgcaggaaagatagagaggagagggagggaggtgcgaagtcactgttgctgctgctagaagggccagagagagcccaggctggacaggcaaaacctggcctcgccagactcctggagcctgcacagagtgtgtgtctgagaagtccggattctggtgccagactgactgcctagtgagaagcctggcaccgccgggtcaggctagtgcactttttcttgtttgttttttgtttttgagacagagttttgctcttgttccccaggctggattgcaatggcacgatctcggctcactgcaacctccgcctcctgggttcaagcagttctcctgcctcagcctcccgagtagctgggattacaggtgccctccactaagcccggctaattttttgtatttttggtagagacggggtttcaccatgttggccagactggtttcaaacttctgacctcaggtgatccacctgcctgggcctcccaaagtgctgggattacaagcgtgagccaccgcaccaggccaggttagtgcacttctgtgagcctgagtgtcctccttgaaacggtgacaataatataccaggcctcttaagatcactcattcaacacatactggagagtctactgtgtcaggcattgttctaggatattgttaggattcagtggtacccagcaaggactcagtaaattccagctactgttcctattaggtcgccaatataaatgcttgatgagtgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggtgaggggcgtggcctggggctctccgggaggtcatggtcattgggtcactcggagcttgtgtttatatgaggcctggcagagggaggcccctggctacccacctttgtgcccgggttcaccaccactggtttctgcgttccctggactctgccgtgcacgggccgcacctcccccgccggccctcgcccatgctccagccccagccctagccccaacagcggcctctccctgcttcccttctgacatcctccctgtcgcccaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggtaacgcgggggaagggggcaggaggtcgtcgggggcgcggcctctacgccctgagcagtgccctggacttgacctttcttttatttttttaatttatcttgctttcatttcctttccttttttctttcctttccttccctttcccttccctcctttcccccttttccctacccttgccttcttttcacagggtctggctctaccgcccaggctggagtgcagtggcacaatcatggctcactgcagcctcaacctcctgggctcaggtgaccctccccgctcagcctgaccttgcctttaaaggccactgcatgaggtggggaaggagatttgacttccacttgcctcggtgactttgtctgttaagcagaaccataatactggcccttcccctcctgtgctttgggcagtgactctccctagctcattgggaaccctggttgcccaaacagctctcaatccaacactagaggtgtggggggtcactgtggaatgttggggggcaggccccagtatgagagaaaaacccagagggatggtcctgatcagggctacccatgcccctgaggatggtggaatgaaggcagagtcgggggctgcataaaggaaagtctcttccagggaccaaagcttggagaactgagggtggaagggggattaaacagaagtgggtagggcagagccttctgcctgtgggctggatttcctcaggcaagaagcctgtgggtaagctctgtataatgcgaggaggagtccccacaaagcaggctggtcagtggtcacgctagtgtgagtctttcaaacatcccgtgtaagtagatactgtcattgcacagaggaggaaatggagcctggcccaaggtctcaagaaacaacccagccgggattcagactcggcagcctgcgcacttaacagccgtgagcaaccaggaactccccagccctttctcttgtgccttcaagagtgcaagaaactgaccactgcccctagagagctctctgaagagcattcccatggctacagattgggtttggagccgcttgggctcaccatgggccagcattgttttggatggcctgagggcaaggactgtccctgctcttcatgcatcctgaagattagctcagtacctggcacagagtcgatgttccagagaggtttggtgaatacagaaggtccctgttgcatggaatcctgcaaagcaatgttggtgttaccggaaccataggaaacagctgatatccaaccatttttgaacctacacaggtgtcagtttcatgtggttcagcctaatgagagcaccaccttaatcctgttgggttctccatctcagccccaggggaatgagcaacacaggggagctagctggtggtgccagactggggttcagatccctgccacatttacatgggctttgtgacacacgacgggtcatctaatgtctctgaactgcagcttctgcctatgtagaatgggagcagtaacacagagcataaagacatgataggggcaaggagagcaagtgtgtaaagcactcagctccgggttttcatgcacaagtgtgctgcacacttgtgcctgacacttattcagtcgcactagctcatctatagaatgggaggtgatacacgcctagcaggcttgttgtcaaaacaaactaagctcactgcagctggatcagtgatgaatgtcactgtcgtcatcattcccactccacagcctgaggcctggccaagtgctcctgtgatgtgccacaccagtccagcaggcaggggaaacatgctttgcttggtgggattcaaggtgtagggatggccctccctttacagtcaccaccctgggttgagagtttgttcctcctccttgctctgggctggtctctatgtgatatctgaccaagcccggtaactgtgtctgttaggtgggatgcatgacccattccagcctctccacagactcgggagtgctgtctctatgccagggtctgagaatagataccgatacatgggtcagcagctcctgtgggggtgtcactccactgcggagggaaaccaaggcagaagctggacaagagtctgaatggctcagatttgaatcattcgtttttggggggttttttgtttgtgtttgtttctgttgttgttgttgttattgttttgagacggagttttgctcttgtttcccagctggagtacagtggcgcaatctcggctcaccacaacctccgcctcccgggttcaagtgattctcctgccttagcctcccgagtagctgggattacaggcatgtgccaccacgcccggctaatgtttgtattattagtagagacggggtttctccatgttggtcaggctggtctcgaactcccaacctcaggtaatctgcccccctcggcctcccaaagtgctgggattacaggcgtgagccaccgtgcccagcccaagcgttagttgtgaaggtttattttgttgcaaatcccagtcctgcatgaaaatgggaatgttagtaacccctgcctcaaggtggggcagtgaaaacaaaaaacaccctgggagtctgcagaggtgtgggcctttcccatcccattctttctgctacaatcaaaatgatcgtttaaaaatggaaatctaggttgggcaaggtaactcctacctataatcctcacactttggaaggctgaggtgggaggatcccttgagcccaggagttcaagaccatcctggacatgatggcaagccccttctcaataaaaaaaattaaaagtaacagtaaaaaagtaaacgcagaagcctgagttccccctgcagtcaggtcaaagcccccaagtcttactccaggcctgctaaggcgttcccatccccttcagcttcccctttgggcctctggcttctcactgtctgggctttcgtgacaatgacctttaacccctccgggcaacaggtggttccctcgcctttcagattccctctgcctgggatgctctaggcctccatccacccagacccctttatgtgactgaatcctactcatccttcggggcattctcagagaaacttcctccacccactgagcccccagccagtgtggcgtgaaggtgggaagcatagacttgcctgggtttactcctccctgccctctgctagcttgcacaagctagtctttgtacttcattctcttcatctttacaaaagagaggataataatttctttcccagagaattttggggtggattcaaggagaaagtatagctgaccgtctccaaacagtgcctggcagaaagtaagcattcaataacatcagctattggccaggcaaggtggcttactcctatattcccagcactttgggaagctgaggcagaaggattacttgaggccaggaattcaagaccatcctgagccacatactgagaccccatgtctataaaaaccaaattaggccaggcgtggtggttcacacctgtaatcccagcactttgggaggccaaggcaggtggatcatctgaggtcaggagttcgagaccaccctggccaatatggtgaaaccccgtctctactaaaaatacaaaaattagccaggtgtgatgggtgcctgtaatcccagctactcaggaggctgaggcaggagaatcacttgaacccaggaggtggaggttgcagtaagccaagatcatgccactgcactccagcctgggcaacaagagcaaaactccatctcaaaaaaaaaaaaaagaacaaaaaaaggaaattagctgagcatggtggcatgtgcctgtagtagtcccagcccctcggggggaagctgaggcaggaggattgcttgagcccaggaggttgaggctgcagtgagccttgatcatgccactgcacttcagcctgggcaacagaatgagaccctgtctcagtaataataatatcagctattgctgttactggcgttattttttttttacatgccccaggccacccagtagggcacttttggaacacccattatgcttgtaattattcagttgcctgtctgccctgccagattaaagctccttgcctgcaggtactgcacgttctagctaggcaggggtcttgtttattgctttgctgtccctagggtgcatagtcaggaaaccttggggcccagttcttaggttcaaagttcagtcagcaatttgctagatgtgttagcctcaggtggtacttaacctcagcatcaccgtgtataaaatgggggctcctctaaacagtgctcaggttttatggttgtgagaattaaatgagatggtggatataaaggatttagcaccatgcttgcatgggatgctctcaatatctcgagcaccacaaatacgaggtaccattcatagcatccttctatttgtcccctcctccctgctcccctgctgtaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatcttgtagctctggggctgcctcggttttcctaaggagccaggggttctgtcatgcccagcaaaggtcactctggggagcctgagggtcttggagatcctgtctctgccttccaagcagtgctggggccccagagctccccacttctgtgactgagctagcccctagcaagctgtccctcaccccataatcctgggcgttctcccttctggcatctgggctatttaaggtgaattttgctgtgacatgtctgtggtcccacccaaagctactctcccaccacctgcccttctagcaggtaaatagtacatctcatttccagaagaagatggggccagagcttaacagaagcctgtgccatgccaaggaggaatgtcccagcccagctgggatgttctagggaagggctaagctgagctgaattggaggagaacctggctctaaactctggaagctcacacttgggggctggtctgtggaattcccggagtgggtggacccagggagtttgattctttctgctcaaagagaacatctctccccatttcccaagggtaggggttccatcctccttgcccgggatttatcctttgtgcagaggtggacgtaggtgtctgagaaggccccaaactcccccctgcccatcacgacctggattgcccctccccgtctttccagccctcaggcaccatctcagcagcgcaggggcagtgtcctgccaggcggtactggggagagctcgaagttatcttattggcccttcctttggaaacgagaccagagaggggcagtgacttaccaaggccacactgaatttatgaagagccagggccagatccagattccctgactcagtttattcctcttttcacctgactgtatcccctcaacttccccctgatgctgagtcatttcccaagtccgcagggacgggagaaatcgacacagcctagaatcttggttttccaagtaagagctctaaagtaactcccaacctctcggagcctcagtttcctcccctaaaacatgggaatcgtgtacttccgaagaagaaactcagatgagagcccttccaagagtccactgcagagtccccgttttccacaccgggggttctcagcctcagtgctgctgacatttacactgaatgattccttgtcatgggggccgtcctgtgtgctgggggatgcttggccgcgtttctggcctctgcccactagatgccagtaacactgcccagttatgacaactgaaagtctccagatgtggccggatgtcccctggggggcaaaaatcacccccagtcaagaaccactgccctaggggcaaataacacaattgaccactgcagtcaggaacagtgtagacagggaaccccaacatggaggggctccccgactccccatcataagcaccttctcccagaagtggaagtgaggcagtttagacactcccccctttctggccggtctcagacaagctttagttttccttcctggaatggctctgccactttgaggagacaagtttgtctgcaaacatgtgaggttctgatccagcttccagtcccaaccactccacacaaggcagcctgacctcgaacatgctgcccagcctctgcaggcttccgtttcttttttcccccccaccccgagataagagtcttgctctgttgcgcgggctggagtgcaatggcacgatctcggctccctgaaacctctgcctcgtgggttcaagcgattctcctacctcagcctcctgagtagctgggattacaggcactcaccatcacgcccggctaatttttgtatttttagtagagacagggtttcaccatgttggccaggctggtctcaaactcctgccctcgtgatccaccttcctcggcctcccaaagtgttgggattacaggcgtgagccacagcgcccagacccgtttcttcacctgtaaaacgggcaaaatagtaccttcctggccagcacggtggctcacgcctgtaacctcaac

SEQ ID NO: 16743 - DNA, 70563 bp, Human
ctgttcctgggacttgtgtccctcctggcgaaagggagccagcaaaaaggttttttcctggaaaaccgccccttctggagtgagtccaggggagccccttggccttgactgaaaaccactaatgagcccagatgaaaagttctggtcagcctagatttttccctttgttctttccctcccatgcccccagcctccttgggatccaagtccctcttggaatctggaagcacaaaagcccatggtgttccgtgtttggatctggggacttcctggattgcaggggcctgaggggagggggcttgatctcatagagggaaaaaaaaccttcctgatcttccttgatttcccagcgggagctgggcagtgagcttctgggctgcctcctctggtggccacaagctgagtcagttttacactagggtagtcacctcaggtgatcccagcctgcgcctctgagcaggaataacgatggtgttagtcgtggaaaggccacaggactggatgactatggagaagccccttacatccagggagcttgtttcctcatctgtaaattggtggtaataatatataccttacctggtttacagagttgttactacaaagacctttcgagatagcgaaatatgtgtgaaagcatttcataaactataaaaccatacagatatataaggcattgttattttatgtcttttttttgagacggagttttgctcttgttgcccaggctggagtgccatggcacaatctcggctcaccacaacccccgcctcctgggttcaagtgattctcctgcctcagcctcctgagcagctaggattacaggcatgcgccaccacgccctgctaattttgtatttttagtagagacggggtttctccatgttggtcaggctggtctcaaactcccaacctcaggtgatctgcctgcctcggcctcccaaagtgctaggattacaggcctgagccagtgtccccagcctattttatatcttcattttgcaaatgagttttgaaaaaagcaaacacacatgaacttaagttctcttggctcatgaattgtgagggtcacttttgaccttagtgtccccaaagggaagcactcttagcattctccatgtttcttggaacctggcatcttttctctgtgctttttttgggctgtattatcaagatggaattaaaatctggtggcaacatgtactgatgttttattttcttctcttgtcttagttgacttcatgaactaataacaagttttttaaactggaaacttccactatgtggggttgtagtcagttgtgttttttggctgattagaaacctgtttttgttggaaatcctcccaaactgtgtggctactttgctacctttgtatctgtagcatagcgacttgaattgcatctgtctttgagactcttgttatgttcatttggcacaatagttttcttgattgtggattgaccctagggcgatacaccttaccattagttgctaacaaaatccctgctatcagcttgtttttctgttgcccaggctggagtgcagtggtgtgagctggcttactgcaacctccgcctcctgggttcaagcgattctcctgcctcagcctcccgagtagctaggatgacaggtgtgcaccaccacgcctggttaatttttgtatttttagtagagatgggttttcaccaggttggccaggctggtcttgaactcctgacctcaggtgatatgcctaccttggcctcccaaagtgctgggattacaggcatgagccactgtcctgggcccaacttgttttttcagtgatgcacatctttatcccaaaagtgtggagcaagaaagttgtgcagcctggttatatagagttttactgtgtcttaatcctatacagtttgcaaagagaagaggtgtgagcatgagtgatcttgtgtggctgacgtagttgtatgtaatgtgttgtccttctcctccccgcttaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacgtaagtggctgccgtggcaccccgcaggctgggtctgagggctccgaggtgggggggggggcgggtcttcccatcaccctcacgtgcctgggccctggctctctggttgagaagggggcttgaaggagtgctggggtgacatccttgaactttgacatctgaacatcctagtgggatgttcttatagcattattcttttccctttgcagccaaaagcaaaacaggaagcctgttttagaacatacgtagggagaagaatatggccctgtctgagggatggccacccactggccttcgttctcaagttttggtggaaatatgaaggttcaggtcaatgttgtagattccttcttttttaatttaatttaatttaatttaattttttttttttttgagacggagtcttgctctgttgcccccgctggagtgcaatggtgtgatcttggctcactgtaacctctgtctcctgggttcaagcgattttccttcctgagcctcctgagtagctgggattataggcacctgccataatgcctggctgatttttgtatttttagtagagacggggtttcaccatgttggcgaggctggtcttgaatgcctgacctcaggtgatccacccgcctcggcctcccaaagtgctggcattacaggcgcgagccaccgcacctggcctgtttttttgaattttaattatttttaataatatctttaaaaaatcttcttttttaacattttattttttaaatatctttaaaaatttttttaaataaaatatcttaatttaaaatattttaaaaaatatcttaaaataaaatattttaaatattttatttatttattatttattatattattaaaataatgaaatattttaaaagatatttttaaaaatatctttatctcttttgatttctttccaataagctttttgcactttaaaaatgtagtagattccttctaaagtagggagtgccagttcctggtttcctgctttgttcctcttgcatcactggatctcctctcccttcaccatttgccccaagcccatttttggtatctctgccatcttactattgttttttttttttttttttgagacagggtcttttttaattggccagtctggtctcgaactcctgacctcgtgatccacccacctcagcctcccaaagtagctctgttgcccagactggagtgcagtggcatgatcacagctcactgcagcctcaaactcttaggctcaagcgatcctcccaccttagcctctctggtggctgggactacaggcctgtgccaccacgcctggctaatttttaatatttttattagagacagggtctcattatgttgcctagggctggtctcgaactcctgagcacaagtgattcttctgcttgggcctcccaaagtgctgggattacaggcgtgagccactgtgcccagcccatcttgttctttacggatgcttgttggtgtgggttacttccctagggagtgtgctttgagcagaggtgagccaccaagagtaagacttgctctgggactctgtccagcactttagtgctggtcccttgccaggcttgaccaaggggaagtgtattgagagtccagagagcagcatgtgcaaagggccagcacatgcagcagatcaggggcgtcattttctttcttctggcaagaaagaaaatgcagaaacgcagtccatcaccaagttaggagacagggagatgagcatttatgcatcccagaggcaacgggctctggggtcacaaagtcctgtccaatatcaaccccaaattcctctgttcaactcaaagatatttccttctggttttgtccccagtgggaaagaaatatctgcttgttattattcctaaaatagctctttatttctttatgttgccctagccaccttgaactttgggctgaataaaacagtcctcaaaatgtttttgacctagtggaaaaaagccatgaagaggttactataggctgggcatggtggtgcatgcctgcaatcccaggaccttgggaggccaagacgagaggatggcttgagctcaggagtttgataccaatctgggcaacatggtgaaaccccatctctacaaaaaaataaaaaaattagatgggcatagtgtggcgtgcctatagtcccagctatttcttagaggctgaggtgggaggatcacttgagcccagggggtcaagggtgcagtcagccgagattgcaccactgcactccagcctggacgacagagtgagaccctgtctcaaacaaaaaaaagaaaaaagattattatggccttcccactttacagatgggaagaccaactttcagactgagggattttgctcatggtcacatatgtaataaaagcaggtggtggcaggctcattctgttacagagacagcagctctgaaagggtcagccgtttaattttctgtgtgacttcagacagacttaagcacatttctacgaggtagactcatgcttctgagtgccctgcaatgtgctaaagccttcaatgggagccatgggccattgtatttgcccggaactcctgactaggactgcatttccttgttgattgctaaatcagtctgtgacaacgaggtctttgttttctgccatcgatgcccaccctttgggggatgaacctggctcatcaaagacctatcaacaagtagatatgtggaacagtctcctttacaacccagccttctttttttttttttttttgagacggagtctcactttgtcacccaggctggcgtgcagtggtgtggtgccatcttggctcattgcaacctctgcctcccgggttcaagcgattctcctgcctcagcctcctgagtagctgcaactacaggtgcccaccagcatgcccggctaatttttgtatttttagtaaagacggggtttccccatattggccaggctggtctggaactcctgacctcatgatccgcccacctcgtcctcccaaagtgctgggattacaggcgtgagccaccacgcccggccccagcccagccttctaacatggcaggtgggaagaattgaggcccagagatagcaaggaacttaagcagggtcacacagccaggtgttggccaggctgaggctggaacttgggttcctgattttcagacctattgtgtctcatctgttgcttgataagattatcatgtggaccaaattaaaggcccctgtccctaaggagtattaaccactgaaattcagaattagtgacttgcaaataaatgaatggcagactgtgctttaaggaagcacagtgtgtctgtgggggtgacatgggagctgcagcctcactgtctgggattgggaggcgctcctcttggcaggctttatagcttatgtcacacccactctgctgtgccactaagctgagatggcctctgctcagtaaagcagagcccttaagtgctatagttggagcctcgaggacctggttcaaatcccagctctgccccttactggccatgagacatggctatgtggagtctcacttcctcatctgcgaggattccatgggaactttttttttttttttttttgagacggagtcttgccctgtcgcccaggctggagtgcagtggcatgatctcggctcactgcaacctctgcctcccgggttcacgccattctcctgcctcagcctcccgagtagctgggactacaggcacccactaccacacccggctaattttttgtatttttagtggagacggggtttcaccgtgttagccaggatggcctcgatctcctgaccttgtgatcctcccgcctcggcctcccaaagtgctgggattacaggcgtgagccaccacacccggcatccatgggaactttctaaagtacccagccagcacctggctcggggcaaggcctgggggcctggactcaggctgctgatgtgtgttacaagtgaaaataactcctgtttctctccttggctctttattggtgcctttttaacttgagtctcttttgggatctgctggatatgaattaaaacaagtggagcacctgagcctgcctgagcttgcacagggcctctccctcccacgaaagggaacagtcattattcagatacattcagtgttagtggctgcgtctttccattgcaagccacacgcagaggttttactgtgggtgggcgtggtgggtagtgcccacaccttttctctagaactctttggctggaggcattaactctcatttttgcttccttgctgtcacctctggtgtgcagttcctcctgcctctcaccagccttcttctaagcatcatcactaagaggcccattgatggcctctgtagtcattctagtggagaccccagcaggtgcagagttattagcatgtcagcgcccctgggcggggccgcctggatggggaggtgctgcctggatggggaggtgctgcctcattcatggtctatctctccatcaagcttccaaatcatgacctcaggagccttcgtgcagcctgtttgcccagcattgtgggtggcgtggctaattctgagccacagctgctctgtctttttcttcagggggtgaggccctgggatgggggcggatgggcacaaagagcctctgtggcctgtgaatggagcagcgccgtgtcgtggccgcgccgcgtgggcgcgaagccgcttgctcgatgtcttgcctccacgagcatccagtgaatctccttcctcccacctgagcctcagtgctctttccgcagggcttagctccatcatcactgctttgacgggattagcccagagaactttgagctcccgtagaccactccataggaccatgtgcccacccagctgtcagaaagacttgtcctaatgacccgtggtccccttctgctgtcagcaccagctgtttccaaacatctggctccatggcactcccttagtgtgcgaccacgtgtccttggttttcctgggctggatttcctagagtgtgggttttctcaaagtccaggaacaaagcttgattgtttctgagctcctggggtgaccttgctgctccctggccttctctcttgtccccactcaacattcacgcagaggaaaaaccagaacaggctcccgtgtctcttcctcctgaaatgcctgggcccgcaggttgccaataccgtgtttacacttcttcagagctttcctggtctcttgtgaaaagagcagttggagggaaaacaagtgactaattatcccaggaagaaaggaaatcaagggccctgcatctccttttccaagcagccaaacacgcttgtccatttctaagctcagctgctctttttttttttttttttttaagagcagggtctccctctgtcacccaggctggagcacagtgttgccatcatggcttactgcaacctcgaactcctggcctcaagtgatcctcctatctcagtctcttgagtagctgggactacaggtgcatgccaccacacgcagctaatttttattttaattttttaattttttgtagtgatggaaacttgcttttttgcccaggctggtctcgaactcctggcctcaagcgatcctctcaccctggcctccccaagtgctggaattccagtgtgagcccctgtgtgtggcctcagctgttttgaatgcataccattgtgtggttgttggggccctctgggttctgcctttagtcaattgctgcttggaaattccctgtgccatagcctttggccagtgcctgagaagagccttctcttcatgactggttcctatgtggaccctgtctttgggttcagccacaagatccatccccagttttggagtgactggagagggcacaggtggagggggctgggttgactctgtagtgcatgcagtccctcagatggtggctgcttcatgaacaatgaaggtgcaggccacttgtgatggagaaaacaaaaggttggaaggagctcggagaactggcctccgtgaccaaggaggttggcattggagacccgagtctgctcccagctctgcccaatgccttgtgaccttccatcatcacttcacagaggcagggccgtaggtgatgtggtgcgtggagccccggcttcacttcgccaggcccctcaggcccattttcttaggaagagggtacttgggtcactccagttgcttgaagagggttgcgttccccaactgaacatctgccaccctgggtggtcttgggagtcttgcgcagcttttaggaatcttttttttttttttggtgggggaaagggatcttgggagaaaaagtaacaggaaacttattagaaaaagaattagtagtcacaaggtaaagtatatttccctgaagacacggaggtagtcacaaggtaaggtgtatttacctgaagatgaggaaggacagatgtgtgtaaactgttgctgttggaaatggttctcctcgcctacccagagctcctctccaaggctatgctgcgtgctgtgctatgtgcttcatttaatcctcataaccacccaatgaggtctagagctctgcctgtccccgtttttcacatcgagaaatggagggggagagaggttaagaaccttacccttgctgagatttgaactcaggatatctgactctgggggtcttatttgaatttgatcaagtcacacttggagtattgggtatattttaggtacctcacattaaggatgttgattaattgggttcccctccagagaggaagtcttggagaaggctcacgggggacgtgaaatagtcttaaagtgtttgagggatttgcatgtgaatgtctctagaagattccagagaaagaggtgtctgtcagggacccactatcccacaaaggatctaattggtttaggacacagtgcgtttttccagtgctagaaaggtgtaagcttcactatctctcagcgtccttcagtgtggaatgatttgtgtttctacagtttgctgcgctgcagctgagcccttttctgtttgtgcctctctcacgatgacaaagacatctctcattgtcctcggatctgagttttgtaactggactttgctgttgtctgcttggccgcggaccttgcctggtggatacgcacactcactgacctatgaggctggagcactcctgcagtggagagggaggatcttcacttacagggcagaaggaggatgccggtgcttcacacctgcagcagggctgcgggagctgggccactgggagcaagggccatcagggagtgccttcacatcaggctgactcaggggtcctttgaagccgcagatattttgctacaaagtttgtacactactgagaatcaaacttcctaacctgttcctatctgccgctcttttctttagacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaaggtgggtgacgtagtgtgtgcccacctggggctgaatcttcacctggggcctcattgacacctttgcaggtgctaagtcacatttggtgccacattgatctagtggctggtgatgggcagtgcatcatggaggtctgtagacctctgtatgaaagccagggccagtggctatccagaggacatgtttatatgttgatagaatgttctagaagctttaaaatatacatttcctaatctttctctcaatttctcatacttttcaagagctcttgtgcctgtcccctctgctttcttttaggccccttcttcttcctgttcttcccttccctttgtgtttttccctcttcctttcttgcttcttccccacagtctagaaacacgttcgagttcttcccatctctacacaaacagatgcagagcctcgggtggcttctgcccccctgtcactctggcttctgtgccccttctgttccatcgcagtgaagctttgtggaggaagtgtctgtgctcactgcctctatccccacctcctggtcactcccctcgccctggctgtctgtccccaccccttctccagactggccaacagaggtcacctatgtatgacctgtgtgttgctaagtccacggctctcaggagttcctacctcacctctccccagcatcggacagtctctaccacttcctttctttctttttttttttttttgagacggaatctcgttctgtcacccaggctggagtgtgcagtggcatgatcttggctcactgcaacctccgcttcccaggctcaagcgattctcttgcctcagcccccctagtagctgggattacaggcttgtgccaccatgcacggctaatttttgtatttttagtagagacggggttttgccatgttggccaggctggactcgaactcctgacctcaggtgatccacccacctcggcctcccaaagtgctgggattacaggcgtgagccaccgtgcctggccaactttactcttaatagagccccctaccctgtgcttccaccagctggtcatctttctgggatgtaaatgtgatcaaatcacttgatttgaaatcttgacaaatcatagaaaggctcctcattcccccagagctattaggttgctgcaaaagtaatcgcggtctttgccattaaaagtaatggcaaagaccgcgattacttttgcactagcctaataacactgtgactctgtgttagtgtacagtgcccttcaaaattggccccttgcctaccttcccaccttcctagctatgtggaactccttacatttccctaatagctctttctgcttcagaacaccctacctgctccatctgcctgcaatgcctggcaaatccctattctttttttaaaaacatgactgaagcattagggcctccaaggagaatatctgggctagatttgcatcagagccctggtagtgctttatttgactgcagtgtttacacgtttctttttctctcctagatacagacagggcccatgttgcctttatattctcagagcttagccaagtacctggcatatgtaatcctgactcaaacccaattttcaggcagggccgtgttctcctatcttgtatggatagtggtttgttatgtcccattacatatggatccttttttctttaaactttgcagtctatctagacagtggtggtaatgcatcttgttgggttaaccactttgtccctggtttagtggtttacagtggcagcttgcagcctgtcctccaccacccacgctgtgctgtgaaggaggcattttactgttgagcttgatgcattatgtaggatgctcaagtttggccgagtctttggcttatgttcacgtctatcaaaatatcttgaggaagtcaggccttcagttctaaagtagaatgtctgtttcaaaatgctaactagaacagcctggtggaaaaacattctgtgggattccagaaaggtctgattctttgtctctagaggttatgagtcagtttgctcccagctctcttaattggcctagtgcaaaaagtgtactccggagtcatcttgagatctgagctactgagtaagggcctgttctcacacttggatcctggattgggatggttatctagcaactgggcatttttgcttttaggcaagacattaagactgagtaatgtgtactgatgaggcaggagacagtcttcagatctggacttcagactgtcttcagttaacctgtgggactccttctccaagagattcattcaatttttatttgttcaacaacaacaaaaatttggtggtggcctgaaagctccatacattgaaagtaattgggggacaaaaaaaaggatgcagagaaccagagctttcctttttcttggccataccgaatggccttcataggaacttaggggccaccctcgtacatctgtgcaattcagggtctcttcatgatttgtcaagattctgaatcaagtggtttgatcagatttgcaaattatgagggcaggtaggtgggcgatttctttttctttttttttttttttgagatggagtctcactctgtcatccaggctggagtgcagtggcacgatctcggctcattgcgggctccgcctcctgggttcaagcaattctcctgcctcagcctcctgagtagctgggattacaggtgcatgctaccacgcctggctaatttttttgtatttttagtagagacggggtttcaccatgttggtcaggctggtcttgaactcctaacctcatgatccacccgcctcggcctcccaaagtgctgggattataggtgtgagccaccgcacccagccaggtgggcgatttcatcttttggagaccagggataggaaatacatttgtgagcacgggaaacttgtattgttgatgcctcctttaaagcagtccgtgcaggaattgggtccatgtgttttctaaccctcagtctgagaggttttcactttgccttctgctagcattggacttgctgcagctcttgagctcccacattgactgacgaaggacgtctctaggctattttccttcttcttcggctgggtgtggtggcttacacctgtaatcccagcactttgggaggccgaggcaggtggatcacctgaggtcaggagtttgagaccagtctggtcaacatggcgaaaccctgtctctactaaaaaaacaaaaaaattagccaggcattgtggcgcacgcctgtagtcccaactactcaggaggctgaggcatgagaattgcttgaacctgggcggcggaggttgcagtgagctgagatcgtgtcattggactccagcctgggcaacagagcgagacttggtctcaattaaaaaaaaaaaaaagaaaagaaagttccttctttttgtatatagctgacctgcaaagcaaatactaataggtttcttgctcttggagcagggaggaagttagtaacagaagttgtccatgttatgacaagctggttcactagtaaaagaaaaatatccagaggaacctttggttcttgccctgggtcatgtgtcacccgtggagcctcggggtctgcaggctgttaaaatctgctcctgtcttttggagtgaagtcttagtgcatgctgcccccctggctttgagggaaacagatttgttctctgccacttacatcttaaaaggcacagccggaaagttccttttgtgctttttctttaaacaagaactagacaaagatttccttcctgagctggctgtgccttatgacatactagcatttattctgccaaacggggcagttggtggctctgtctggggacttgtaggagaggagctctttgacccttcctggggacctccatctgcctttatctgttcagtgtactggtttgcctgtacagtcctgatttatgcctgttgttccacagttattattaatagcactctctttcactttcagaagcatcccagtttggaggataaattatatgtcactcacctattgtcagactaagccagggattctcactcttggcactagtgatatttgaggctggatgattctctgttgggggtgggggatcttcctgagcactgtaggatttttagcagcatcgtggcctctattcacttggtgccagctacaccttccctctccagttgtgacaaccaaaaatattctcagacattgccatcaagtttccgtggggggcaagattattcccagttaagaactactggactaagcattgcagattagttttactttgagtgtcatctccgatcgatcagtagtggctgcctggagccctgtgctggcaaggatttgagactcgatgcaggaattctgagatggattagtgctgtctgccgtgggcacgggtggggcatcacagcatgtagtgccttggattaggccgtggaggtaggtgacagaaggtgccagaatgccaggaggttttgacattatcctgttactggatgccctggcggtccaggtggagagacgaggcatgtttatagacagagatttgtggccctagctacaaaacaagacatttggtgcctacacctgcgccagcacgactgagccaatgtcaggtgtcctgggagttttgtcaggtgtggcgaggtcggatcttgcagaaaggcggtggtgtgtgtcagtcagtaagtagttacagggcatcccagacgtgcccagcgtggccttgggtgacatggtcggttcaccctcctgcccctggctttcccatgttgttaattcgttgtcatggccgttcctgggtcttcctgccttggggattggactgttcctcggaactctgtgatggcaccaaaggctttgaactggccaaggccaggagagtgagagagcgtaaacgttgtgttgctggcccttgccaggcagcgggggatgggtgggactgtgtcccggggcaggcacaatggtctgctgtaaagttcaggtggaagcagctgtggtctgcaaaaggtctgcctcgcctaggaaatggtgcttctggatcccgggccagaccctctggggtctcccctatggggaaaggtgtgtatgtctctacaggagaactcactggttgaggaatttgacatgagcccagttatctccccagtgagtagaaaaagccccttctatgtgaattaggtagaatgccaggtttggttcactttcagtgactttatggtattaatattttaatgagttcccagcattttgggggaagcagatctgctttcattctaggcctaaacttgtctgagagcaatttaaccctttgctctgtgccagtctcccttcccacccgatccctggttcccaagggaagctgcaccagaggtggttggtcacccagcagccgctcagagtgccagtgagtgtgcacatgcccctcggtgtctgacctttttctgtaaacaatgaggggtagaatttttgtgtatcttcacgtctgagcatggctcttcgaattcatacgtaaagaggcaggcacagataatgttaactggcttgtcgaaaagcccgcagagagccagccccagaaagcagtctcctgatttcctgtcctggtgcctgttaccctggcacaggcccgtggggcattggtgcccctcattttctctggctggtcttgaaggaattcttatctccagctcagtggttggggggcactaggggaggagaggccctctctttccttctctccacattctccctgccccgctagttgtgtctcctgtggaactgtctgctttccaatgtctttctgaggaaaagtgccatgtttggcagaggctcaggaaaaagcttcaaggggcagaaaagctctgtttgaatcgactcaccgggacaggcagctgaggaaggagcgccatggaagccacagatgggatgactctgctgaagcaggaatgcacccagccgggaggccgccagccctgccagccgtcagcacacaaaggcaccgctgtctgctggggaggtcgggagcaggccctgtgtgcctaaatgtgcctgtggaggcagcgtgggctctccaagatggggcgtgttctgtgtctgcacctgctggtctctctgtgctggctgagctgagcacctactgtgtgtgtgccgggcactctgcagagagtgtacagacagcaggctggggcctgcctggaggaggtgactgtttcgtgctcagagacaggcaaatcagcttcaagatgagagccagagactagcacagaggaggggcgccccaccgagcctcgagagcttctggggtgggtacgggcctttgatagatgacacagcacttctatagggcaccaaaaaggggctgctgggcctgtctcagccttagacttgggaatagtgccacgtattgcctttgagcaagaggaagtgtgtcgtggaggagagactgtgggttttggactagacagagcaggaatctgcctctttagcttcctaactgcaacctggctggagcaagtcaactcactctaattgagcctttgtcctcttgtcctcctcttgggcttcatgacactcctgggcagggccatggtaagaagtaagacgccgtgtgtgtgatgcctgcgataagtacctgttagagctggcagtaggagtccaaacacttcttgactgaactgccccgccttccacggaggcttcaaatcgctcattccttccgtccacactcctgctcgcttaatgaaggtgatggccaaatgcatcttccaggcagccatttgaatctccccaaaaacactctcccgagagtccaggtgcaggaagtgagttgtcacagccgcccctgcagcgaccgcgccacacactggaacgcgatagcagacgcggtcctggcttatctggtctggtccacgcagagctgaggcctggggctgatgtggcctcagtggagctttaggagatgtgcttgatccagagttggttcttctgcagccctgagacacttttctgttccctgggatgctggtggaccagacaggtgctgtgggaagcaggccctgggccaccacccaacaccatggctgcagccgggaggcgctgtcctcgagctgatgcgagctggctgctttgtgctgctcctccaggaaggaaagcccggccccagcatgaggctgctgaactacccatggtcctgcctgtcagtctcatttctagaacttcttctttctagaagaggaatctgcagttaacgggcccttttcaaggattcagcgttaggcttacttttttttttttttgtaaatccaacccaacaggcccaccatgctttgctctgggcccactgagcgggagataaaaaggaagtggcctcttagaacctgaaattttgggtgggggtgtttggaagctttgcccagtgttttttgtttctgctccccatcccctgaaataaaccaacaacaaaaactcacatcaaatccctaatcactaagccacttcgtgcttttggcctcccgtgacgagttctcttgctgcctggtgagtgtcacctaccagcccgtttttcctgttctctccagctctggcttagagacttcagttgaactgtgtcccagtttgtcagggctgaacaacagtgtgttcagagaaaggagttgctttcttttacatacctgatttctggaatgaagttatcagttgagaaccaaagtaattccctacaactaaagaaagataaatgaactgaaaagctgcaggtataaaagttgggattctgcacgtggcttctgtcaaatttgtttagtcttgaccaaggctgtcagccccgtgtggaccttgatcataaactccataaactcttgagaccccaggttttcttttggcaaacagacagtactgatgggggctcaggatgtcattcccacctggctttgggattcttcctgaagatcttgtctcttccacatgagctggtccacagatacaacagggcacaggtctaagctgaaaggagaggaagcgtgagccgtgctccaggagtgaatcctagcctaacagtcaccgacatgcctttccttctaccgaccgctcctccgaggcaacgtgttcatgcgctgttaactgttcacctcctaccattgatgtccctggtgctctcaagcacgtttgactcatcaaaaggagtttcacaaagctggttgctgtctttgcaggcctgtttgtgctccaacagggagctgagtttgtcatgagcagtgcctggctgtgtctgccatgctccctgtgtgtgtcccagctccttccctcttattccctgttgatccagccctctgcagaagtcaacaggggcccctcctgctttgtctttccttttcgcaagggaaatgttaggtaggagcaaggcggaaccggactgggagtgtcccggtggcatgtgctgtgggtggtcagcactcgtatgtggttttgaatttccctccagtctgacaaacctgttggagctgccttggcaacaaccccagaaggagaagtttccccctcctggccccacccacagaaacagcagtgctgtttctggcagatttgcctgtgtgctgggaacttacctgtgttttcctaatgcattttggccaagagaaggcttgtttggggcctcgcttagtctgacataatgaaagttaagagcaataccttgaggttttttttttttttttttttttttttttaattatccagagtgtctggagggggagggctacccattctctgcctcctataagtggggacttgggtctcagcaggttcaaaccaggttccacctgggagatcacaggggctatggggcagaggcactgggccgagtcgaactggcttctggtgtggatgctgctgagcaggcatgtcccttggtctgggcctaccgtggtggcctggagggcacactcgcccatgaccacattgtgtgcctgggagcgacggaaggggcttcctcctttgctggcagattgctaggcaggcaggctgccaggaagctccaccccactcggcacagatctgcagcctctgctaatatgaagcatcattttgcacttgcttttcttcacctctctgtttgcctcccaaagacttgtaacccaagcttgtgaattgagctggctgtggagaagcagagcttctcgtcatgagagtgtcgcggccctttctttgcagcactgaggcaggcctgcgggaggtgccgagtgctgtgctcataggggtgttcgatggaggggagtcctggggtgcgtgaggtttccagagacctgagttctcagccccatttgtgcaactctgatcaagccatcctggcaacgcagggcagggctcacagtgccaacacatatagcaagccaccccccaggggccactctggagtttccctgaaagcagaagactccctggtggtggaaagttttggtcccatttgtctcagattatcccatcagtctcacccaacgtgggcatgttgtccaacctgaaactgccctttttcctgtttttctttcttggcccatacccatttctcaagaagcccagtggagccgaagatggggtcctgcagggacctctcccaggtggagcccgagagagctgctccatgctggaacctcgggaggtgtgatcttgggagctgggtgatgagtcagtcccagcagtggctgctggtgaagcaggccccttcctctgtacttcctgttgggctgatgtcaccgctctgcgagcctcgtggccttttatggacaagagtgagctgcagctcctctcacagaggaagtgaggcttaagcccccagcagaagtctgcacctgggatgaaatacctgcggtcaggttccccttcctccctcctgggcccagcctgctgagctggctggaaacacctgtccacaggtagatggccacatcagctcagatgccctcactgcatgggcttggcctcaggacattttcggttgaaaatgaaatccagggagaaaatggcctggttcctgaatttgtaacttttatgaaagactttctcgtggcggtgccagggaattgctcagttgggagctccgagacagcaggcgggtgaggacggcatgtctgggcatctgcctcacaccgtgtacgacaggaacaccatttccttccatcctcagagcagtcccttcattcccagagaggtcaaggggccaggcattgcgtggggaagagcggaacccagggccacagcgctctcggctgtggcttcctcctttgcagaactgctccagacacatggactagtggttgtcaaactgtgctctgaggaaccctgtctccaccacccactgtcccttgctcaggaatttgggaagattttatctgaggaaggactgccgctgctttttgaaaagtctgaaaactactgcagagtgactcataaccccatctctaccccaccctcaccaagagaggggctggggcagtgggttcaggcgcctaccacggctagactttcatctggcagggggctcgtgtcccagaagaggcttgtccctggcggcctcctcccgtttagaggaaggaagggcgttttcaaataagccttcagtccttacaggccaaataaggactcgagccaaaacaagcagattgggccggactctgaatgtgctcatcctgtgagatgacagtgcggggaagggttgatggggtgggcgccaatggcagtctccactagaatgcatagggtggggaggtgggctgcagagtaaactgagtaggccaaagagcccactggttgctaagaattctaaccaccccactgcccagaagagatgcctctgagatcaggaacaaatccagaagaaccgctgtgtggaaagatggcaaaacaatgatgataatacctgctttgtacattacaatacaataccttgtaaggttattggaggccacacaagataacagaccaaaacccttcctgagcattggaaagaccttttcggttgcatggggccatggtacgattcgtggtgcatccggccggtggatttaggatactaagcagtgcggtaagagatgcaatgaggaggcctcccagcagtttgcctttcagaaagcatttgtccagatgaatgttcctggcagaacaaatccagatttctttaaggtatggttaggctgtgttgacagtggtaaattggcttcaggaattggacggggaaggctggagaagtgggagagctagggacgctcgggtggatggagaggagacactgaatttggctctggggtttcggaatttgaagtgtgtgtgcctgtgcatacatccgtgtgtgtgcatggctatgtacatacatgtatgttcacattcacctgtgaatacatgtgccttgcgtgcctgtgtttgcacttgtgcttgtggatatgcatctgtgaatgcgtgtgcagctgtgtgccttgtgtggatctatgtatatggctttgcacacgtgtgtgcgcatgtatttctgtgcacacgtacctctgtacacctacctccatatgtgactgtgtatgcacagatgcttgcgtgtctatgtgtgtgtccatgcccttgtgcgtgcgtgcgcctctgtgtgcatgccctcgagtgtgtttgggggctctgcttcctgttgttcagcagcagagcctctgactcctcctcacacaattagaggaattccagccatcctagggacagccctgggaaaacggttcctctggaagggttggggaatgtttccttttatggtagcattgggccgttggctgctcacgacttgccagcactcgcaggtacattcttgcctgctagtagagccggtgactaaacatgcccacagctggggcagaccacagggagacgcagtgggggagggcagggggctgggatgacaaaaatgtttgttccaaacccttatcggttgccacactgtcgttaggggccagcaatgaaattgctctgtcttccccaggctgtggttcctgccgcctccctcccttctgtcttcccgtctgtctagtcgaggatgcaggtctctaatctctgtcctcgctgtgcaggcttgaaggactcgtgttttttgagaaaggcaagggggagtaaggcttgcctcccctagagcttgcctcctgagtagtttccacatcagagagcagggtgtggggtgtgtttgtgaatgagagtgacccagcccctctgcgcccccaccccgttgatgcttagggggctgggaggaagctgcggcccagggcaggggcagctgccattggtgttgggtgtgaggtttgttttttcttctttctgtctgggcttccttttccctcctgaatgaccagtgggcagaagaagagattggaggcagtgcccagccccacacgctgctgaggtcaggcatgctagaaagctcacctcggaagaggcaggcagcctagctggtcggtggctactggtgttgaacggttaaatgtgtctcctgaggccatgcacgtggaaagccgtgagtcattctcccagtgcctagtcacgcagggccctgaccaggtggtgcgagccactcagtgtgtccttcacacgtcgctgaatccgtgtttccacccagggctgatactgtaccaacagccacggatgctcccactgccctgacaacgccactgccacccatcgtggcgacgtcgcgttggggaagtcggtatagacagcaaccgtttgtggagcttactgtctttacagggactgcggcaggtccattttatgtgttatttctatttttcaaactaatcctgcaagggagttagtagcagatcttactttgtggatgtagaaactgagactcagaattaaatacctcactgcagctcaaatatttgtaagtagcctgatcctggattcaggccaatttgacttcaaggacggtgaggctattagatggggcgggataaaacggaaaaaaatgagtttatattttcagctgttgcttgaatacccagtactgaacagccaggatgccttagtgtttctggcaaacttagctttcagagtgtgggcattactgcccctcctgtactgggggagggtgggtatttataaccttccttgccgagcagttcatagagctgttgatagttgctgaaagttcctgacacccggctagagaacaggttgtcacagaaacccatcagaagctgtcattctttacaagctgcctctaaagtgacatcattgcacgccttccacttgccagacaccgtgctggtgtgttcacatgtgttgtggacacaagtactgttatcccacgctgcggaggagggagctggggctcagagaagcctgcgcacctgtcccgggtctcaggctgtgaggcagcatcttatcccagggctgtcccgttgcaaagccaggcctcgtcacccctccttccccagcctcttaaatggtgctccttccttcagtggggatggtatttagagcacctgcagcaggcttctttctaacagcttcagccccccaccccgttataaacacacagggcaggtcccactcagctcccagggaagtcgactcctggagagttttccacacactagttcctctaaggtgggagacacagaactatttctggttttctggtgggggctgaacagcgtgggtggacaatctgagctcctgggcggcaggagcagctgcccaatggcactctcccccgaagatgctcctcctagccaggtgtgagggtagactgcgagatccccacaaagacagcatctgtgacactgtgctccctgtctgggaaacgggcagctctttgggagcaaggtggggaggcttttgcatctggcgggagttaatctgatgtcttctttgtttcagaccgagaagatcaatccatcttgtgcacgtaagtatttctccgtctgggtagtggttcgtttcaccccagtctgttctcattcttgaggtctcctactgaaaccacaactggggcttgcagagtcccccattcccaattcaaggcccctcctccacttctccaagggataggacttcagtttgtgtgtttgctactcagtggtcccactgcatggatgagctcaatttcaatcatccttcctcaaggagccagtgggaaggagggtggagcttatggcagaaaggaaaagcaagatctctccacaatccagctgggaaccagctcctccgtaacttctgggtggaaggcattccttcttgctctggatggtggcttttctttacctgaattgaagtagacactggggcctctcagcctctgaacttaacaaggagatccataaaccccattgccaagagagttaatggcacagaacattcctttaagtgacgtttcaaaggaacatgtacaagtgcctttgacccctaagtccacagctgcctaaaactgatttttaaaacacttggatgtgaagtcacttgccctgacaagtgaccaggacaggcagtggatttcagtttacttctgtctggcccctggagagccatgggaagtgaactgcctgaggattccagagcgtttatgtggcagtcccgttttctgccacacgttgggtccttcacgggcacccaacagaatgcgaggcagtggagcgtgcagtgggaagggacagaggtcaaggacttggccatgcctaagcccgggacttccttgcctctcttggtagtggtgaatctggagctggcaagacggagaacaccaagaaggtcatccagtatctggcgtacgtggcgtcctcgcacaagagcaagaaggaccaggtgagtgctgcagcccttgtccctgtggccgcctgcttggccttggtgggatgatggaggaagagcacttagtggtcctggcttcagctttacaagaggatgctttggggaatgaagcagagtctgggcccatttccattgaggcagtggcgtggcctgtcctgggagtggtccagcggtagcaagcccattccatccttggcctcctagccttctgagttgctatggaaactggcgaggtcctggagtttgcatggcagccctcttggcttttgcagctcgttgctgtgtgtcctccccttctgaggctggaaggcagattccaagacttggtcctcaagttgatggaggcttgaaaggtctcaggcagacctgtatttgattccatttcttttccctgctgttgaaatgcctctgggtggacagccacccacccccaccaccccagcgaagacagaaagggcaattggaaagtcatctcacctccatttttttcctctcccttttgatggattatggttgaacccagcagtgtcctcgctaggtgagctgcacgtttactgcacgttctgcactgggaatgcgtgttctgcccatcgtgtgcccttgaattctgtattttgttctaagcagcttttcaccccacacttgtcactttctgcagctagaactcttcttttaggctcagctcactgactgtcttgggaggaggggctgggtgtggcacacagtgacctcctgtgcactctgaaatgacagctcctgcagaatggggacgggcctcacacctagttgttctcagaaactccagtcatgcccagatttccccacagcgcaccatagctgtcatgtcccatgcggaacctgaccccggcacggtggatggggactccgctctcacggagccctccacgctctgtggtccagaccagatgcagatggccggctgccctcacctgccaccgccgtgccagtcagaagcagtgccggggagttctcacgttggagtttttcagaggttggggtgatcagacttaagcatggctgtgggatgctctctctcaagcacacactcttaacctcccctgtgaaagctaagtgccagtggtgttccttgaagccatcaggggagcttggccgctcccggtggctccaccttactggcgtgccgtgtgcggccttcgtaagtaaggaggggtgtgagtctgcatgcaggtctggggtgtggcctgcagaatggcctaatgagtacagtcttctggaaccgaaccaaaagtaacttttcatgtgccaagcttctcaagacgtttggaatctttttccatggggcgtcaggagttatatttagaaactaatacagtttcttttcttctgtctccctctctgtctctctctctctccatccctctctccctccctacccccgattttccattctttttaggaggcctattttaaaaacagagctgtgaggttaggagttctctagctgtgcttttccatctctgaatttgcagtaaaatccatttcccaagtatttattgactgcctagtatgtgactggttcttgggagggtgacattggagttcctgtcctgaaagacaggagacaggacacggagagcagtgaaatagatcatatgccttacatctggggttcctgttgtagaggggaaggcagcactcagcaaagacagcatgctggggttgggggtgacagtgggagccacgttgtcaaaacgcagactttggtaggcaccccgtccctgccctgagcccactagagtgagggagtaggttgccccaggcttccagtcatagctcaggctgtcagcgtgaaagaccattggccggtttggttgatttccttgcctgaagctgtgctgtgattttccacaggctgccggagcacagaacacccttgaattggtttgggagccagcgctctctcacttgcagtgaccgagttgaccctcccaacaccagcagaggggttgttccagacctcaccttgctgcggggaggccaggtttggcctgggccgcaggttggcaaagcagagcttggtccaaggggctttccaggcagatgcccggatcctgaacggtgacctttgactctccctgctctgttatttgtgtacgagctggggcccactggcagaaacaccacccagtgaagcccttcagaaaccgatgggtaaccccaaacctcatacagtaccgcatcatttcatgttacgcagatttcattgaaaaattaaaatctcttctgtgcccaattagatgtcagtagagaaaaagccataggttagtcatcactgttgtcagcagggaacacagctctggaatctgaagtggctgctcccgacttggccccgcggccccactttccacggcaacagcgtgtggtcccaaacagaggcctcagttcgcctcccagccagggcgagcacaggcaatggaggggccgcgctcccttctgtctgcgggaatgggagcggttcagccagcctggcagcctggcctgtgctctgagaggaacggcgtagtgggtgggggagccattctcatccaagtctggctccgtgggctgcctcagccgacttcccaggcccgcccgaggcctgtgggtggaagcccggtgtccagttaccactggtgcccagcgcacacgtagagcctgctctgtgggcttgacccctgccctctgacctggccctgctgaccctccttcaggggcgggcactagagcaatgccctcacttgtctggatggttcacaagcggaaggcttcctagccctgggttggggggtcctggcctaggagggctgccagaggaagagtctctgctgtgtcccttgtggtctcaggtgggcttccaatctggctcggctagactccagagtgtccccggtgccctgcagatgggtctcgtctgtggcaggtgtgcttgtaaggccagggtccatggctctcctgggagctcctactcctcctagttctccttgtcatcactcacaggcggctgctgttcccggaaaaccctggcttgcctccagtctttaataaatacaaaggcttgcctggcccttgtgtgacgttctttcccccagagggcactcaggcattaaggggaaccaactccctagtttccttagccagcgttagttagtccctggtggcatgggcctgttgcacaggtgcgaagacagggcagtggctgacaggttagggaggggactggaattccgccaccccgctctgcggattgatagctggatgaccttgagcacccctcccttggcctcagcttcctcttctgtgaaatggggctgctctgtcctgccccgtgagtatggtggggatccagggataagaaggcacaagggtgcattttgtctaccacaaagcaccctggagttcacagtaggatttattgacattctcagtaaacagcctggagcccaaagtgggcctcatggatcccgtgctcactgcctgtcatggtggttttggacgcggcagtggaggggctggtacagaaagtgaagcatttatcaggacacagatgagatgagcgtgtatattttccagatccgatcccctcatttgcttttcctatgaaaaggaataaaaatgtgaggattagaggcaaggaggtagagggaagctggtgtatacagggtggagacactgtcccagggtgtctgtgccgccggctccctagtttaagtgctgctttcacatgggttgtccagggccaggttcctagagctgagggagcttcctgcctgccgtttccagggccatggaagtaagttcaaactgaccaaggtttccaaagcctggcgggaaggccgcacttggatgataccggggcctggccttggttggagtcgcacactggagcccacccggaaacctctgttcctggcacgttggacatgctgacacggctctgccatcgtcccccttccaggcagggcaggctcggcagcccaggtcgctgcccggccttcactgcgtccctgggttccttgcagggcgagctggagcggcagctgctgcaggccaaccccatcctggaggccttcgggaacgccaagaccgtgaagaatgacaactcctcccgcttcgtgagtagcgcggcggcgccccggctctggggacagagggccttgcccggagctttggctcatgctgccttttcctgggtgccctcccctcaaaaccgaggacggttcagactcggtgctatctggcctgtcgtgtggactaggccagaccgaatgccagttggtgtggacctgccctgcccctcttaaggacgaaggccacgagtagcttcttcagcctccctcatgagaggtggaaaggccagtgagggcgctgcctgctgtgccccagagtgctcagctgtcaccagtagccagttagttcccgggtcaggcagagaggaacacttccacataactggtctctttccccctctgcggaggaacctgggtgtgggatcagcttgtctcaggctcatggccttaggcagtgtggcgcctgagtcccgaggtcctgtgtggtgtgggcgtagggggcccctggcctggtacatgggtcccgtctctgggttttctccctccaagctgtgcccaccggaggtggggcggggggctgtggtctcccccgtgctctctagctccccatgtcaggggcacctctgatctcttgctatcctttcttacttagggcaaattcattcgcatcaactttgatgtcaatggctacattgttggagccaacattgagacttgtatccttgtggttcgttgggataagagtcctggatccggaggggaggcatgacctctgtagagaagaagctgcctcctgattccagcactttcccctttatgggcccatcctgacaccttctctgtggagctaggggactgtcaggatcggctagtgcaaacccaacacagagcttagggctttccttatttacaggcaggataacctgtgctttgaatggcatggagctgttgaaagccgtctagtgtggctcccagaggtaggcgtttgggggatgccactctcctgcgtgccaccgtttagcctttgcttgtgggaatgttcttgttcccattacctgtaagaatgagacaaggctctcgaaggtgtgagctcctcttggacatgccatgccccttgaaggtgagaacccaggtagtttgcttttgctgtgttttgccattttgtgccattcttccttcctggtgaagttcagttcctttggacgagaataagaggacaatggaaggctggccaggcacagtggctcacgcctgtaatcccaacactttgggaagctaaggtgggtggatcacctgaggtcaggagttcaagaccagcctggccaacatggcaaaactctgtctctactaaaaattagctgggtgtggtggtgggcgcctgtaatcccagctacttgggaggctgaggcaggagaatcgcttgaatccaggaggtggaggctgcagtgagccgagatcatgccactgcactccaacctgggtgacagagcgagactctgtctccaaaaaaaaaaaaatgaggaaagtggagggcttgccttctccccagcttgtgttgctccttaatatttgcaaagatcttttggagaaatctcgtgctatccgccaagccaaggaagaacggaccttccacatcttctattatctcctgtctggggctggagagcacctgaagagtgagtagttggcctgcagcctgacaccggggctgccgggctctgggcctcttgccagaattggaccgtagacatcatttgggaaatgaaaacttttggccttgggtttaacggggagaagtgagagtgactcctgttctctgcgccatcctaaggacttggtcttctgtttctgaccatgccagagaaaagctagggtgggttgcacatgtagctgcaaatcacaggacctggcgctctcctgggccaggagacgggagtgtcagagtctcagacactgaggaaagctgaacgtcactggctactctgcggtttccagggtgcgtcagggctcagggtctgtcccagtctctccaacctttgaggtcacagcgctgatggagcctccactttcagcacctcgctgaggcgcccttgccctccaccccttacagccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggtacagggctggccctcctatggtcgagtgtggggcagaggaaggctggtacccacggcctcggggcatcagggtagccgatgggcctggggagcctgctagaggccaggggaaggggaaggccttcagtgtatgggaaaatgattcctcagatttgaggttcaaggttatttgttcctggtggtaccacaggcattcagaaagggtgcaaaggacatgttcttaactgcccaggactcgggtccactgcacagcccttgccatttgctgaaagtagaatattcacgtcctgtctcggggagtgtggaagaagctggggatagatgggtgctttgtgctggtgaagcccagcatgaatggcagtgcggacaggccatgtcggccaggagggggtgagccctctagggtggctgggcccaccgcacaccgttagacgcagacctggcgcccctgtggccccagggagttggggggtgtccctgcttggcttgtctggcttgaggatccctagatgagtggcccccacccccgggaatcaccatgacccatgtctgcttctgagctgcctctgattgcacccaaaggcctgctgcgggtcatctcaggggttcttcagctcggcaacatcgtcttcaagaaggagcggaacactgaccaggcgtccatgcccgacaacacaggtaacacccggggcctctcgctggaaataatggggcaggtgcttggccatggatttgctcaggagggaaggtcttgcggaaattccggacactattctttttaatgttagtatctgtcggtattttctatacagatgtaaaacacacgtaaacatgaccctgcttttttttctcaccaagtaagcatttcagaataacttaaacttgtgatcatgtggaccagggcttcccttattcattcctgagaccaaaccattcgtcaggacaccaatgatttctgccgtagctcctccttaatgggagccttgcctgtgactatgtcgagatcttgaaattatgtccttgccacacccgattcagcccctttgttagggttgctgcaaatgaccccatgcaagttattcagtcttaatgtgccctccttagggtctctctaaagatgtaacgcatgggtgtgtggattgtaaaagacactcctgaccgggcgtggtggctcacatctgtaatcccagcagtttgggaggctgaggcgggcagatcacgaggtcaggagttcgagaccagcctggccaacattgtgaaaccccatctctattaaaaatacaaaaattagccgggcatggtggcgtgcgcctgtaatcccagctacttgggaggttgaggcaggagaattgcttgaagccaggaggtaggggttgcagtgagccgaaatcgcgccactgcactccagcctgggcaacaagagcaagacgccgtctcaaaaaaaaaaaaagacattcctgtgggatcctgtgctgttccgtgccccagcaccaggttggcctgctcctctcagccccattggtgggtagggacctgcttttacactctgaggagtgcggctgagagtggacagaggaaccactgctgccgctgtggcctccagtcaggacgccttcctctctgccccgtggggctcaggggaggtacagctgccctgcccactgacctgtatgtggctgctgagtctggggggtgctaggtgtctgtggccctgctaaagaagggcccagatgcggttgtcctggtaatgattgctcattcaccccgtggctttcttcctctctgctcccaagtcaagcagagggacttattctcttgggtctaattagaactttctctcttgggtctaattaggactttttgtccctctcttattctctgaaaaatcttagctgcccaaaaggtgtcccatctcttgggtatcaatgtgaccgatttcaccagaggaatcctcaccccgcgcatcaaggtgggacgggattacgtccagaaggcgcagactaaagagcaggtatgtcctctggggccagggcagctggctgcctcctgggtgaatgtccctgcagcagcacagttgaggctgttgtgggccatcctggggtgtccgtgtcaggcactttcacatgattccatgatgcagtcctcacagcaacccggagagaggtggcataaccccatctagagcactggagaagcttcatggcacactcaaggcttcacgcccaggaagtgccatcctgagactgcattgtgcctctttacattgagatggtattttggctgattggtcatcaaggatataggcatgtcctgtctggtataaaagcaggaacttgatgccactgtagctgaactccttctggtgccagggtggcggctcccgccatcctcgagcctgtgccaagcggctgtttctctaccacctgctgccttgggcttgccacgtgtgctgagagacgagcagcagcgcttgctccttcctgccagactgatgtgcctgcctgcccccggagtggaggtcccgcccagtgcggaccgctttctgcctctctccggggtttctagtttcttttatggtgctggccatgggggtttttagggtgccaaacccatctctcaaaaatacttggaagctcattttgttagtctttctcccattcactgtacactgacagctcacggctgtttctgtgcagaagcattgcatgaaagacaagactgttgttttcaaaagacatcgcgtattattcctgccacctgttcgtttccctgaccattaaggagaaacctccattttctattacaaaaatactacatgactcttaatacagaaaaatcgagagaaggaaaacaattcccagtgatgaatatcattgggcagctctttcctacaagacttaaaaaaaaaaaagaattaaacttagttctccttctggcttttaattacagagctttgcaaatgtgcaaaacaaagaagaggggagagtgtaaagagccccacgtgcccatcacgtaggcggcttcagcagttactaactcacggcgagtcttggctcatcgtttgtcttatctccccctgcccctctgcccactgccttattttgatgagatcgggcgcgtttagggtggtatggccgtagactgctgccttattttgatgagattgggcgcgtttagggtggtatggccgtagactgctgccttattttgatgagatcgggtgcatttagggtggtacggccgtagaccactgccttattttgaagcatcactttttctgtaaatcctttagtgtgtcctcattttatttcaaaagatctaagtttattgtccccatattgttagatattaggttgtttctacttttcatcattttaaataacaccacagtgaacatatttgtgtacgaagatttttttttttcccccacatacttagggctgttcctctagggggaggactctaaaagtgaaattactggggcatagggtatgagggttttcagatcctttgtatctgacaccacgctccccgggtgtgccccgcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatgtgagccttgcccttcattacccaccctgctgcctccttggcctgttggttgccttatccttggttaagaaccctgcttctcatggtcccgcatcgatctgagttggccatctcctttgcatgaagactttggttgggtgtggggttcttttttttttttcttttttaaaagacagggtctcggctgggcacggtagctcatgcctgtaatcccagcactttgggaggccaaggccggcagattgcttgaggtcgggagtttgagaccagcctgaccaacatggagaaaccccatctctactaaaaatacattagccgggcgtggtggcgcatgcctgtaatcccagctactcaggaggctgaggcaggagaattgcttgaacccgggaggcagaggttgcagtgagccgagatcacgccattgcactccagcctgggcaacaagtgtgaaactctgtctcaaaaaaaaaaaaaaaaaaagtcagggtctcgctttgtcactcaggctggagtacagaggtgcagtcatagctcactgcagcctttgcctcctgggcttaactgatcctcgcacctcagcccccttagtagctggaactataggcacgcaccaccactcccagctaatttttaaattttttgtagagatggggcctcaggtgtggcccaggctcagttagatgtgttttaagctaaacagaagggctcattttcaaccagaaatgctggagaaaatgagaccttttgtttgtttgttatttttttttgaggcagggtcttgctctgtcacccaggctggagtgcagtggtgtgaacatggctcactgcagcttcgacctcccgggcataagccattctcccacctcagcttcccgagtagctggtactacaggcatgtggcatgacacctggctaatttttgtattttttgtacggatggggttttgccatgttgtccaggctgggaggatgggaccttttaggtcacattcttggaggcttcctgggcaggtgcttcctgtttattcttccagcaaatattccctgagcatcgggataagacatctcccttgcccatgacaactttgaggtctagtagggaaaccgatacttacagtagattagaggttcttaacctggagtccacgggaggtttgagaggagccatgagctgggatgagaaaattacatctttattttttactaacctctcattgaaatcatgtattttttccagttgcgaactgaacaaactatacaaaccacagttgtattagcagtacttgtgatctgtcaccaatagaaatcagatgttttcgtgttacattccggttgttgcagagatctggtagtgtcatttatgcatcgctacctcaaaattttggaagttattaagcccatggctagttcttgttaataaggaagcacagaggccgggtgcggtggctcactcctgtaatcccagcactttggaaggctgaggcaagagaatcatttgaagtcaggagtttgagaccagcctgggcaacaaagcaaggccccatctcttcaataaaaaaatagaagggcctggtgcagtggctcacacctgtagtcccagcacttcgagaggttgaggcagaagaattgcttgagctcaggggttcaagaccagcctgagcagcatggtgaaaccccatttctacaaaaaataccaatattagccatgtaccatagtgtgtgcctggggtcccagctactagggaggctaagctgggaggatcacttgagcccaggaagcggaggctgcagtgagctgagattgcgccattgtactccagcctgggtgacagaatgagactgtgtctcaaaaaataaaaaataaaaaaaaaaaacaatgtattactcgatcacaatattttgatgattatatttcaaaataactactttctttgtaatctattggatgcaatttaaagcactattctgaaaaggctttaccagactgcccgcggtcactggctccaaagagtaaatgttgcccactgctgggtggataaagggaaggccaggagcatccgggctctaaaggcagcggcatggaggtgcccaaggaggcccttcctgtatccctgccccaccctccttctcaaggggtgtctgggcctctttagtgcagggttggcgtctctctgacattgttttctctccttgcagctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagtgagtaccaggcttgctttgacctcacacctgcctctggcttttcccttccggggcacccgctcctcacctcagctctgtgttggttgtggaggtgtcttaactccccttccttttggtgccacccggaggatgaagccccaaggctgagatccagtgcctgggaggcctgggtgggtgcctccattagaggagatgctctgggctgcagctgtgggctgggcttttcccagctgccggaccaggtgcatatgtggcgggggccctagcatcctgttttcagtcccagaagaccacccagcatcctcctgaaggctgggctcgataagcatttctttgtcttaaagaaacagccatgcatggatgtagtaaggccctatcgcgggctgctttcactgtagcatggaacagtgcagaccctgggcattgagtgctctgcccaggtgtacacgtaccaaagctcagctcatcccccccataaaaccagcaagcagcagtgcttttatcgccagcattagctgtgtgaagatggaaaagaggaaccctttccaatgagttcatacttaaacctcttgccaggtagaggttgggtcgcctgtttgtgttttaggcttgttgagggtatgatctgtaatgaagcctgagctgttcctgtgtctgggttttcttctttttttttttttttttttttttgagacggagtctcgctctgtcgcccaggctggagtgcagtggcctgatcttggctcactgcaagctccgccttccgggttcatgccattctcctgcctcagcctcctgagtagctgggactacaggcgcccgccaccacgcccagctaatttttttgtatttttagtggaggcggagtttcaccgtggtctcaatctcctgacctcatgatttgccctcctcggcctcccaaagtactgggattacaggtgtgagccaccgcgcctggcctgtctctgggttttcttttgattatggttaattgatcagaaggcctaggacaaagttttttcagtttgaaaaaaatttccttttttttttttgagacagagttttgctcttgtcgcccaggctggagtgcaatggcgtgctctcggctcactgcaacctttgcctccctgtttgaagcgattctcctgcctcagcctcctgagtggctgggattacaggcttatttttgtattattagtagagacggagtttcaccacgttggccaggctggtctcgagctcctgaccttaggtgatccgcccgcctcggcctcccaaagtgctgggattacaggcgtgagccaccgcgcctggccaaaaatttacttttgtaatgagcttttttctttaatcagttgaattttccaactaataggaacccactgggcttcaagttttgtcagcctctctgcagtgtccaaacctgctttcttgtcttgtaaactcagtgtgcagaaggctgctgggtccctgggactatcttcctcaaggggctcctcctacatatcccatctcatcatagacatgcagacgcaaagcatgtgggttggcatctcccgtggcaggatcacagggtacttgttgagggcagcctcctgggcagaccccagtgcactgtgaagtcagactctggccccgcgggtcagcggatgtgcacttttcatcagacccactgagggtttcactaatgctggagaaccaccgtgatggatccttgggtaaaggtgtcagccgcagcctgggccccagaggtttctttagaagctagaaatcttcaacagtgcttttgcttctcctggggagtgtgtcgcccaccgtctgtgggattcaggggattctgatgtccgggccttggcttcttgaagggtggggtgcccctcccagggtgcactcacctgtgctgatgctgcgcttcctccaggcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtgaggagcactcacggggaggtgctggccagatcttcacaggagaggtggagtcgaggctctctaggaccaggagccgggcagctgctggggacgcaggggtgtgacctgagtacggttcttgcacaatgactcacccagtgatgtggccggtgacagcatcatcatttacacagcttacagagccccttcacctgctccatgctgttagaagcctgcggcactccaccgtggtgcccaggctggttgtcatcatgcattatcgttgggcctgtctgccaggtgcagagctttggctaaaggcatgggctcagagtttgaatagagctctgccactcataagctgtttgacttcgggtcagttacttaacctctctgatccttggtttcctcatctggaaaatgagaatgaccacccaccatacaggattatgtggattaaacaagctcttgaggcccaacatgtggcatgaatcagtgctccggggcagggctcctcaacctcggcattcctggtattgcgggctgggtcattctttgttgtgggaccctcctgtgcatgctaggatgtttaccagcatccctggctgctacccactagagttaggagcaccgtccttagttgtgacaacccaaaatgtctccagacatcgccaaacatgtcctagtttcggggggggaggtgcggggaattgccactgctgtgggtgacagctgctgttgccaagtctgccacagtcagtcagtggtggacctgccctcaacacttacctagcagacatcttcccagtctgcatgtgactggggcttagacccaacttagtccatagaggtgcatgcttagacaaaagctggtttttctcagcatatcgtgtgcttcctgcacaaagaccctaacagttaattgctgtgattaggcaggggctgcgccatctccttgttggtggtgactagttggtgatgactggcgaggagatgtgggagctttcacaggtctgttcccaagccacaaggagtccaggcccggttctagcacacctgtgccggcctcttctatttagcttggctggttcctggggctgcggaagcaactgtcttaaactacccatgaaaaaaataataaagccaaaaaagcgatttacaccattaaccaaggaatgtttcccgagcctcctttctccactctcacctttgggaaacgcacacgctcatcagtgcagaagcttccaggaaggcttttgctgtgggattatttgtaatgctgaataattaggaataccctaaagcccaccaaggggcctgcacgatggcatcaactgtggtgcgtctttccgtgggctgtgctgtggccgctaaaaggacaaggatgttggcctgggtgggagggtctgagcctggggaaaggaaactggcatcacctacctcatgataaacagcaacatgcattcgcctgcatgctgaggggagcacccctgggatgcagcagcgtgcattcgcttgcatactgaggggagcacctctgggctgcagtttgtgttgggaagagggaggcctaggtccctgatgctctctgggtattgttctgggaccttttgcaatgaagatgtcatgctgtattacttgttctgttaagtatatattttagcagagcacaggggctcatgcctgtaatcccaacacttggggaggccaaggcaagaagacagtttgagcccagacgtttgagaccagcttgggcaacatagtgagaccctatctctatcttttttttttttttttgagacggagtcttgttctgttgcccaggctagagtacagtggcacgatctcggctcactgcaacctccgtctcccaggttcaagcgatcctcctgcctcagcccccctaggggctgagattacagccctgtagctgggattacaggcacgtgccaccacgcccggctaatttttgtatttttaatagagatggggttttgccatgttggccaggctggtctcgaactcctgacctcaggtgatccacccgccttggcctcccaaagtgctgggattacaggcatgagccaccgcacccagcccctatctctatttaaaatgagaaaaaaggaatctatttctgggagtctctctgaaccctctagtttaggaggctgcccaattaaaaaaatatatttaaaaacagaatatatttccaaaaagatgaaactgacacatactcagagaaaatgtgaacattctaaaaagacaaagaaaaaacaaaaattacttgtcttatgactaaaaagaaatagtaacattttgttgtccttccaggattgtttttctttgttcatattacctaaaaattttaaaaaagctgaaacccagcacggtactgtgtggccaccatgccatgtctagagccaggctcccgttgttggccatgccttgctttgaggctttggctctgcacgagacgccgcagagaacgtcttgatgcctcgctccccttatcctcaccacttccttcttaggggtggaaatgctggatcaaagggtcttcacgttttctgacttttccacgcatggggttagcctgtgctccggagaccctgtgagcacacatgtccccagcgcagcttgtgactcctgcctctctgaccccgccaggtggattacaaagctgacgagtggctgatgaagaacatggatcccctgaatgacaacatcgccacactgctccaccagtcctctgacaagtttgtctcggagctgtggaaggatggtacgccctttgcccttcgccccctgcctcctcttggctgcggctggtcatcttcccacctccacagtgggccgagctgccaaacaaggggtacacatgtgccccctgacataggccaggtggtctctgccctctgtagctcccatgagagagggctcctcggaccgaaacaggaggccactgcccttgcgcacacaccgtggccgggtcctcctgggcggagcgctttccgtgtgtgggaaagtcaagggcagccccgagcctcgaagcccaggctcccagccccgcgccatgttgcattcccgcctctactccttggtaggctggttgctttgagtggttctttttaattctttctgttggtttctccttttcctttgcctgggttttgctttaacctctctgttgcagagatgcagagcactcagagagcctatttctatcatcgctttcctattctccacctagaaccaggtgactggccgcccgagtggtgtctcttgtgtgtgtggtgcgtccaaagctgtgcaagaaatgcttctgcctaggttttctcgcgccccccccttgccttggcttttcctgcctgcttacacccccgttccctgatctgcccctgggcttctgggcaggttccccgcactgtgcctatcgccggcctgtagtagcaaactgggcaaatgaggggctgtgtctggaatttggagacgtcacattcaaatcttaaaacactgtaatcccagcaatctgggaggctgaggcgggaggattgcttgagtccaggagtttgagaccattctgggcaacatagggagaccctcatctctacaaaaaaattaaaaaaaaaaaaatcagctgggtgtgatggtgcatgcctgtagtcccagctgctcaggaggctgaggcgggaggatcacttgagcacaggtcaaggctgcagtgagctgtgattgcaccactgtactccagcctgggtgacagggtgagaccctgcctcaaaaaaaaaaaaaaatcttaaaacagcaaaaattgtttaaaaatttgtatcctccttagagcttcatgcctaaagacagcgtcttaaactgcttgaatggctgcgagtgtcttagcatgaggttcaggtatgcacactgctgtgtctgtgcacctgaaagctgaagtggcatctgtgtgttcattcaacagttgctcggcaaggtctgctccatgggggtggggccaggacacactcagctaaaagggccagttatgatgaggccacattaacctttctctggacaacctgagtggcttttgcaagttaccacgcccaggaaacctgtggtagccaggaatattgaccctgtggtgggtacataaggtcaaagatgactccctttttttttttttttgagacagagttttgttcttgtcacccaggctggagtgccatggtgcaatctcggctcactgcaacctccgcctcctgggttcaagtgattctcctgcctcagcctcccaagtagctaggattacaggcacccgccaccacgcccagctaacttttgtatttttagtagagatggggtttcaccatgttagcctggctggtctcgaactcctgacttcaggtgatccacccgcctcagcctcccaaagtgctgggattacaggcgcgagccaccatgcccagccacctcccattttaattgactggtttgtaggctccatccacactcctggcttctgtcttaagcaagcatcctttttgctgtcttcaagtaaataatagtaatctggccgtgaaggaatacgaaacgggcttcgtcagtattcttcacttttatatccagtaatagaaggcttcacatttaacattagctcttgcttaaactgatctcaaatcgctggccactttggtttggcttgtttgtttgttttttaccttggaggatgcaattggtttaattgctgctgggtgtgagttccagtgctaggggctgcttcccttgagggtcggtttacatgagaaagacccgtgcaccaggagacaaaatgaaatacaagtacgtgaagagatccctaaactttggagtatttataatcaagagcagttctttggagctctcccttcctgagatgtctgcgtagatatagaggggaccctgcaaggttctgcagacagtgacagggtggccccaagctctgcctcctgactcccagccgagtgctcttatgacagggtcagtgagaattcaagatactgattttttttttttctaactgtgaccataggacagcaggattccgtaagccaggttttcacacccctcgttagagccaggctagtagaattctcactattccaaaatacatgactagcttcattgagtctttttggaaataagagcttcgagagtggctgaagataggtgacaggaaggtgaggtggccgtggcagatgcatggctccccaagagacaagcccagtgcctttgcatcccccttggcttcccgctgtgtttggggatgaccttagcacccagtgtaggctccaattggaaagggtcctgttgtttcattctgtctcctcttttcctgtccgacgtgtgcctgtctctctctcctacgtgctcccccaccacccagctgcaactgtgtgggcactcacgtgttctctgtggtctccacagtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggtgcggctgcctggtggggtggcccgggcagggcactgtggtgtggggtgctcagcccttgtctgtctccccagcaaaagcacccctccagccccccagcatgcacagagccttcagtcgtttctctgcagggtgggccttggctcgcttaggagatacgctacattcacagcctgcacttcctcttggtggcattggcccctcccagacctggatcctttgacttcattgtccaaacctgtgggctgtagcgaccccctcccttaggctcttgccctgtcaggttcataggggttccctgactattctccgactgttctaggcacggaagtgagaccgcatgcatgtgttttcttctccaggccggcaagctggacccgcatctcgtgctggaccagctgcgctgcaacggtgttctcgagggcatccgtatctgccgccagggcttccccaacagggtggtcttccaggagtttcggcagaggtgagccagggcccggagcccgcttctcctgggccctgctgtgcgtgcagtgagtcccagaggtgggctgctgctccctggcaggatcctgtcgtgagggagcgacgtcctccatccatgtagaactgagtctggccagctcttccccacctccttctcttttccaccctttgcaggaaaggagacttccccattttaataccgaaatgcaggtcatcatcatcctgttgacttttgctcctagtaactgccggccctggtgctatttgctacagttagaggagctatgaaaagaaatgtaaaagaatcagccagagacctaggatattacaggaactttgtggaaatgaaacacggccgtgcgttgctgtgtgcgaagacggcgacaccttcctgtttctctaatgactgtgctgagtgtcagttgctgtcgggacgcagccctttatttcttgggccatctctgtttattagcagctccctgcagcgtcccagggaagctgtgtgaacatggctgtccctgggtgacagatgaggatctcaggcaattagcacttagtccaacctgaagcacgcccttgagtgattgaaacggtcctacacgagtttccattcactttccggaaaacaccaaggcttccttgtctcattcagccgaagaaaagagtggggtgggatttgcctgtgtcttctttccttaggagagtttgtgtaaagaattctgtgtctgttgcattgtagaaatgatgttaatctctcgcctatattccaggcatgtggaatcgaggcaatgggtaaaatgaccaggcttctctttccttcctcagatatgagatcctgactccaaactccattcccaagggtttcatggacgggaagcaggcgtgcgtgctcatggtgagttgagctgctgtccctgcctctctggatgggcagccccttgtctggggagtgcccacgtggccagggcccaccttgctatatcagtggtcggtggatgcccaggctgtgtcccttctgatgctccgcgtctgactctgccgggcgccctttgcagtagcccctaggcctcagatagccagggatggtgtttggcaccagggttgtgtggaggagacaagaactgtagccatggccgggctctgatgtaagatgatggcctctttggtttgggggacattctcctgctttcttgctcacgggcctgactccacatccagtgtggtgagcagggcagctcacagccagggcagcaggcctggtgctccgtgacctgggcttctcctccctccctccccactcccagccctagcgcagtgctggacgggctgtgcgcatgctctgagttccggttgattgaaagccctgcggtgactcagtgccaagccagggctgaatcccaccctgctccttttttccccttcccagcatcctgttgtttctggcgtgtccaggttagcagctgctacctttggccttgttttacttcacgttctttctaaagaatcagaaagctttggctgcagagtagggagttggtgggaggaaaagagaaggaaaaattcaacacctactgtgtgcacagcctgcgttcggtgacggggagatagggaacaggaagaaggagggagaggagatggctttctgctctccagatgctcgtcagccagtgagaagaagggtgaagggcacacctccagctgtgcctgggccaccctttcatggagctgtggccagttgctggccaggtaaacggcctgctcctcccacctagataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaagtgagtcccgggagatactcctgccccgcatgccaggccttgccacgcccttctgttgccaaagggcacttagcaggccaccccgctgcagccagtcacatgcctgtcagggaggcccaggtggctcttcctacccctgttcctggatttctacctttgaggagtagaatcgggcagttcttttttttttctttttttttttttttttttgagacggagtctcactctgtcgcccaggctggagtgctgtggcgcgttctcggctcactgcaacctccacctcccacgttcaagtgattctcctgcctcagcctcacttagtagctgaggttacaggtgcacgccaccacgcccagctaatttttgtatttttagtagagacggggtttcgtcattgttgcccaggctggtctcgaactcctgacctcaagtgatccgcccacctcagcctcccaaagtgctgggattacaggcatgagccactgctcctggctgaatctggcatttctgattggggtttagagtgatgggtgggaagaggccgactctgcttggatttgcctgcctgaaggatcctgcttaccaggactccttaccgtgtgacccttgtggggacagcacccagagcctgcctgtccctaaagaaccctgtgattccaggggagcaggccatcctcgagtccagactcatctttgactccctggggaatgacggctcccctgctgcaggacagcggctgtgggcactgcacactcgtccccttgtgctcggggatggggtcctagcaggagcgccgagctctgggagacgaagcttgagcatttgcacagatggaggcttgtttatccaaaagccctccagctgacacctgcagcccaccttcacagtacatcagcttctgacgttctcccaccaaacaaaagctcagatagggaacagcacgaagggtgggaagctgaagtccagagtcacccagggccagtcggcttaatcaccaagggtcacgctcagtccccacactgagtaggatctgtggttacttcacacgtgccttcacccccatgggcacctcagtggaggggtagtctggtgacctaggtccttcaccgactgtaagattagtgcctcatggagtcacacagcctgtaagtgggagaaacttatctcaaccccaaggccagaccccttccctgaatttctttcttgaggtgccccaggcaagggtagacccccagaaaagcttgaggacaagaccaggactgttaggtcgggtctgctgtccactgctccgcgctgaccatgttcctcaccacacagagcatttgccaagcggcagcagcagcttaccgccatgaaggtcctccagcggaactgcgctgcctacctgaagctgcggaactggcagtggtggcggctcttcaccaaggtgcgtgctagaagggcctcctgagtagctgggactacgggtgcacaccaccatacatacctggctaattgtttgtattttttgtagaggtgtggtctcaccatgtcgcccaggttggtcacaaactcttgggctccagcaatcctcctacctcagcctcccaaagtgctggaattacaggcatgagccactgtgcccggccctttttgatttttagtagagacaaggtctcactatcttgcccaggctgaccttcctggcctttaaaaaaaaaatctctttatttttaaacttgtccgggctgcttttgtgtataatacataatttatggtaatggcgaaaaaccaactcacaaaaagcctaaagaattaaataaaaattcacacataaacccttagcctaaaccaacagcagcagctattttagtgtttaatttctcgctctttttctcactgcctataaaacctcagctatgtaaacagtatacattcttccatagctgagtttgactcatataaacagttgtagttcgtacgttccatttatgattccttcataagcatcgtttttttagaggtagtgtgctgttccctagggaacacatcattatctgggtactttttcagagatgggtccttcctcattttcttgctgtgataaacaatgccgaggtgaacatcttcacgcacacgcagggatagtttccctggaatgtagttagcgggtcagaagcccgtggtacagagcgccaggaaggatgtgcctgcttgcagcccccaccacagcgtgtcttcttgcccctcactttcatgtttccagaggtgagggagaggcctcacacctgttggcagaggcgggcatcttccagccgagcatgtctctacctctatctcctctcccaggtcaagccgctgctgcaggtgagccggcaggaggaggagatgatggccaaggaggaggagctggtgaaggtcagagagaagcagctggctgcggagaacaggctcacggagatggagacgctgcagtctcaggtgggtgtcagtgcaggctcagtccaggtcgcacgacctgcctggtgctgccacctgctggccatcggtaggcacggcatgctggaagtttctattactataggagttttctacaactgagtttcctattactgtaaacagtgaccagtctctctgcagaccccattgggtgttaagtgatgtagggaggccacttaatagagtggaacgttcacaagtgttgggttcaaacctcagctctaccacatgacttgagcccatttcctgggaccttgctctggagctcatggggtagtgaaaaatcaaggacacgatgtctggaaggtacctggaagcttcagagctctccagatgaaagctacttttgtctgcatgttcctttccctctgggatcccgagccatggcgtccgtccttgaggatggagtggcttgagggtgttgcgaggagcttgtgttttccacttgttgtttgcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggttcctgcccgctgcacccggggaggggtggcgccggaggggcagggcggggcggaggagcaggaaccaggagctgggagaacatggaattagggtccaaggaggctgctcctcacgcaatctgcttggggctctcagtgagaggtgttccctttgggctggtagtttgtgacatgtgcatctgagatctccatgagcactgcctgggccagcatcaaggccaatttgatttccctgccattagccctggccctggctagccgaaggggcacagggccagcacctctgcgtcctgcctgtttcatgggtgggagcttgctgcaggaaacccttcagaacattgcaccgatgttctggccctgtgtcccagtttgaaatctggaatcctacaaatggggcttgggccctgcctcggctgtggccctgggctggcggaccttgccgtccccacctcagccatggccctgggctcacagaccttgctattttctccttggcgtttggatctggccttcggaccttgctgccttcaccttggccatgcctctgggcctgctgtccttaccgtgtctctggcccccggcaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggtgaggcccgtggctgtcgcctgccgctgctccaggggcgccgtggatgggagagtgtggtcacccttgcagggcctggctccccgctgctgctgcttcctgtctcttctgcctgcagcatgagggcttctgcttaactgcaagtgctccctggaggtcccatgggccttagttgagggatttcctcataagcaaaggggccctggggaagggtttgtcctttcccctctagaaagctcttctttgccagccgtgagacccgagcctgtgtaaaggtggccatctgtgcagcattgcaagtgttggtcactgtggggttggggacaccttggtggctctgtgttgagatacggggtactcttcctccactgtccctgggcggcagctattcctcttgagaatgagttgggtccctgtcggtgtctgcccagggagcagatagcagccggggaaccagttagaggagaaggcaggagaaggcagcctccccacctttcgggcctcctcagaacatgggagccccaaaggctggggaggctgaggtggcaggacgcccacccgggactgggatgaggggactcaggtgcttgtgccgagctgtggccgctgggcaggggtgttgcaggggccacacagaacagaaagcaaggagagcagcccggggcaccgcggggctgaagagggggaggggccgtggcccacctggcaggtgagagaggggcacggagaaggtggcctggtggcacaggtgagcgccgtgtggcagcctcttgaaggagtggagccatctgtccctgctgacactagctgtcacctggaatcctttctcacccaagcccacaggggaaggggaagggcttgggcacccacattttttggttctaaggaagcgtacctcgctgtttcaggggagctcgtgacctttaaaaattatcctttgatctaggaaaatcctaatgaacttgatcaagcgtctaaagccctctccattcagccccaaatttccgggcgagtcatgctttgaggctagcaagtgttctgtgctcaaccaacactaaatgccagcctactcccctctccccaggaaaagaaactgctggaagacagaatagctgagttcaccaccaacctcacagaagaggaggagaaatctaagagcctcgccaagctcaagaacaagcatgaggcaatgatcactgacttggaaggtgagggggtgacgagcaggaggtgatgggcaggggctggcgggcaagggctggcggtcaggggccggcctgtctgaccggaacaccgaggccttctcagctcacgggtgagcctgggtcacactacagcactggctgctgccctttagacctgaggtcaccaggtcgaggggagccgtgtctggtgcctgcgggaacctgagcctccaggcccctgttgctctgtggctagatgcccccactgcatgaagcgtgtttagagagctttggcattgctctgttgtgtgccgtgggttttggaagcttctgagacttcctaggaggctccgggtttgacccacaggactcactagctctgtcactgactagctggctcatcttgcagctatgacttaagctccatgagctttagttttacctaaaaaggggacacagtgctagggtgtctgtgagaatttcattaaatacatgtgaacacatatgtaccgtaaagtcctagacgaatactgcggaagttcattgcttgacttggggcagggtgacaaatcctgccttgtctctgtgtgccctcgggatctgtggcagggagggggtgctggggtagaagcacaggtccgtggctgtctgaggatccccagccctgccccttgagaggagtggacagctgggggaacaggggaaccccgactactctgggaactctgagctcatacccaggggagggagaccaaaacctgaccaccgggaggattatccccagcttagtttcacagtcttgtccggccccctcacatctgcaggggatgaggtgagtcaggtccagcagaagagaggtccggacacagagagatctcttccctcacagacaccctccctcacctgggaggagcccggaagacttggtcatctaggaggtctaggggttgccttgcacccaccagatggacagacatgaaaggttgacactaataagggctaacatagacacggagctgtcagagcacacatatgctgctgctgggactgcaaactggtagacggcgttagagaacgatccggcagtcctagtgaggttgaaacttagcatgccggtgacctggccgttccatccgtcactcagccgtgtgcactgagagtgagcaggatgcttgcagcagcgttgatcagagcgtgcgatgaacacagccgcatgcccgccagctgcaggacgggtacataagtaagttgtggtgtattctcataatggaatcctagacaaatgtccttacacatctattccagcgaaacttcacgggctacatctcaagatcatgtgatggggtggcaaaggcacggcagggaataaccatcacgaggcaggcactgttctaggtgctttttaagatagtaactcattggcgcctcacagcatcctaatgaagtaggctgtctccttttgcttattattcagatgaggtatagaaagtagctttcccaagtgacatcacagagttataaagctagacatagagccctgaccgtgcgattccaactgtggaattcacacaaggcagttccattatataagttcagattcacacacaattgaacatgttttttagagatacagacatggtacagccttcaagggaaccaagggaattacaaacaccagctttaggagagtacttaattcctggcagggaaggacaaggggtgagttggagagagacatgccaggggctagcagtttgcagtgatgtcctcttcctgcatccaggagttgggtgcgagtgtctgtgtgtttgtgatgctttaagcctgacacacgtttcataacgagtgctcagtattttgtataagtaattgacacggagacagaacccatggcactgagggctatgtgggctccccctgcattgcagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccaggtgaggaccccgcctgcccgcctgaggccaggtggcctgggccagcccttcctgcttgctgctggccctagttctcggcactagtgagctgtgagcattctttccactgttgtcttaaaagagccatttatttcatagcaaaacagttcttgtgcactcagggcatggtgaggggcctcatttgtcttttgtttgtttataatttgaaaaaaagtcatccacagctctatcacccacctacaatagtcctttcctaatttcttgctataggcacacttaaaaaaaaaaaaaaaaaaaaaaagacttgaccaggcacgttggctcacgtctgtgatcccagcactttgggaggccaagccgggtggatcacttgaggtcaggagttcgagaccagcctggccaacatggtgaaacccccatccctaccaaaaatataaaaaattcgccagtgtggtggcacacgactgtaatctcacctactcaggaggctgaggcaggagaatcacttgaacccaggaggcagaggttgcagtcagccaagatcgtgccattgcactccagcctaggtgacagagcgagactctgtttaaaaaaaaaagaaagagactttattttttagagtagttttagattcacagaagagtcagcagaagattctccatctatccgctgccccactcacgcaccgcctcccctgcagtcaacatcccctaccacagtgctgtgtctgttctaattggtgaacctacgttgacctgtcataaccatctaaagtccgtagcacattcgtatttttactgagttgcagttgtcctgtggtgtagcgttttatttccttttcttcccatttaacacatcatttgacttttaaaaatatttgaagcagtgaatcttactttggaaattgaaacgattcctctatgaggttttctgcttctcagaggggtgttgcccttcaatctggttgtctcagatgttgtttctgctgagagccatcctaagtgccatgattgtgaccacaggaggcagctttggctgctgcagctctctcaggcctgtcctgcaaactctgctccttggaggtgaaactctccttatactgatgttgctggtcgctttggcagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtgtgccctgggaccaagtccctcgggatggggagggcagccaggggggccttggcttggagacatggaccccgggcctctgcacacacacacacacacacaccgtggccctcttaggcaccagcaggcatggaagctgctggttcctcagcggtttctctctacagagtagaaagtctgttgaaggacctggctcaaagttgggggtgaggcaaggctgggctttaaagctgaaaggctacagaagctctcacagggcgtatttgagcctgggctatgggatagatggctaggaggggccggtgggtagaaaagctgcctggagtgcctgtgccctggccaggcctctctttggtcagggaagagccccagggacagcctcgctccagcatccccggcctccactctgaggggatttctctgtccaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgcggagcctccctgagaccgcagggggagggcagggttccccgtgctgggcccacagaatccaaaccagtcctgcagagcagttgcagggttctacccaactgcctggttctgaggccaggctccccttctaaggggctttgtgactcgtgcctcagtttccctgttcataagggaggattatggtatgtctgtctcgtgattatttgagggtgaaaacattacatcgttactttgaacatcagacttcagacaggctttattggaagtctaactgcaaacaattatagttccccttattgcgttacaaatattgctaacatctgcaacaccaatgccatgccctagaacctggcctctacccagggcagaaggctgggcaggtattattttagagatggggaagctgtgagatgtcctaagcagtgaagacaggaaccaagtgtcacccaccagctaagagagaagaggacaggacagatgaggcccgagccgtctgagtccaggacgcaggcacaccgtcgtcagggctgcagaagcagcgatgtctggatctagggtccagtgatgatagaccagccagccttgtgtcaggaggcccccactcacgtctttgctttcttccctgctaggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtgaggcctccgccaggaccctggcgcgggcagtgggccctagcagcagttgtggcccaggtccccaggtgcatgtgtgctctctgtctctctctcttctcaaactggctcgtcagaccctcatggttcagcttgtgactcaggtccagctttacctaaaggagatgaggtggggcaggagcagtgggggtgggtccatggtcctttgtgtctccccgcccggtgcaggtggagctggacaacgtgaccgggcttctcagccagtccgacagcaagtccagcaagctcaccaaggacttctccgcgctggagtcccagctgcaggacactcaggtaggggtggcgccaggttcccagaaggtggacccctccagaaaggcctctgtgtccacgcaacattagcttcagagcccatcggattgcccatcctctccttcatctgcttcatcctgtgggtgggtctctgcgtcctcccagctccctccaggtctttacgtggccatcccctaaatcagcaggaccagctcctccctctcctcaagggtgtggggttcctgggttttggacaccaccctcctaagcacccgcacccctctcaacccgcgagtaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtttggaggcctgggggaccggccggactctgcaggctggggagctgctggccgggcactggcctgggcactgcaggacagccctgcccgctgggccggcccattgctgctctccccctgggaagccaaccgtgctctcccacatcagtgctctcaaggaaaggaatccagggatctgtggacttagatgggggacaccactattttcactattttacacctttattttcaccagtctttagctgaaattcagcattgcttccattatggatgtaggcagcaagccatggtggtggcagtccctgtgccgtcatcatctgtagaaatggccagttaccctgtcagggttgtggccgagctccttggcctcatgggtcccaggcctgcgctgtttgttatctgatgtgctatctagcagcacgtggcttcctgagccatggttttttagaatgtgtgacaactgcatttttctgtactggttgccctgctgatcccatgtttatttcatgcctgttacaacattgtcatgagaaggagtcccttggcctctctagactgcgaaggggtccgtagcctaatatggtttcagagcccctgctctagatcctatcttgggcctccatgtgccaggccagaaggcctgaaccacctcgggatgggctgggagtccattccacagtcagggtaggagtagcccgcgagcgtgcctgattgtgggtttatctccaagtgcaaggatggggctgggtgatggggaccccgtggacaccctacagggcactggccctgctctctgggagcagtctccgtagagcaagaggcttggtgtggatgtgggctgggagcccccacagcgggcctgggggtcagcctcccccgggcttcacacagtagacagatgcccctttgcagaagctccatttgtctcgcccctgtggagagggaagtgactgggggaggcggtttcataactgggcagatccctggtgccccttccacggtgtggcaggcaggctcccagctgccccagggacgggtgtgccacctgagcaggtgccatctcgggcatctgcttactccttgctcctgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccaggtgtgtggccgttggccccatcctttgcatttcctctccttcaagcactgagtccaaagcaaagggcccatcagagaaagcctgggctccctcagggtctcgccggggaggggccgtgcggggccagtgcttagaggaccctcaggctctggcttgttgagggtcccagggagaaggccagcggaagagggcgtcttcatgcgatgggttgaggagtgacttttcctttctgattttttacatttttcagattttctctaatgaactggtttgactgtctttttttttttttttttttttttaatttttttattgatcattcttgggtgtttctcgcagagggggatttggcagggtcataggacaatagtggagggaaggtcagcagataaacaagtgaacaaaggtctccggttttcctaggcagaggaccctttggccttccgcagtgtttgtgtccctgggtacttgagattagggagtggtgatgactcttaagagcatgctgccttcaagcatctgtttaacaaagcacatcttgcaccgcccttaatccatttaaccctgagtggacacagcacatgtttcagagagcacagggttgggggtaaggtcacagatcaacaagatcccaaggcagaagaatttttcttgtacacaacaaaatgaaaagtctcccatgtatacttctttctacacagacacggcaaccatccgatttctcaatcttttccccacctttcccccctttctattccacaaaaccgccattgtcatcatggcccgctatcaatgagctgttgggtacacctcccagacggggtggtggcctggcagaggggctcctcactaaccagtaggggcggccgggcagaggcgcccctcacctcccggacggggcggctggcctggcggggggctgacccccccacctccctcccggatggggtggctgccgggcggagacgctcctcacttcccagacggggtggccgccgggcggaggggctcctcacctctcagacggagcggctgcagggcggaggggctcctcacctctcagacggggcggttgccaggcagagggtctcctcacttctcagacggggcggccgggcagagacgctcctcacctcccagacggggtcgccgctgggcagaggcgctcctcacatcccagacggggcggcggggcagaggcgctccccacatctcagacgatgggcggccgggcagagacgctcctcacttcctagatgtgatggcggccgggaagaggcgctcctcacctcctagatgggatggcggccgggcagagacacccctcaccttccagactgggcagccaggcagaggggctcctcacatcccagacgatgggcggccaggcagagacgctcctcacttcccagatggggtggcggccgggaagaggctgcaatcttggcattttgggaggccaaggcaggcggctgggaggtggaggctgtagcaagccgagatcacgccactgcactccagcctgggctccattgagcactgagttaaaatcactttaattatcattatatcattacattattataattatttaattatagtttgggtttttttaaaatagtttgggttttttttttttttttttttggagactgtctctgtctgttgcccaggctggggtgccgtggtgcaaccacagctcaagtgatcctcccacatcagcttcctgagtggctgggaccacaggcgtgcaccaccaccacacccagctaatttttagatgtttttcatagtgacagggatctcaccatatcgcccaggctggtctcaaactcctgcggtttgactgtcttttaaacgatttatttatgcattcatatcacttccttattccaaaagatctgagagcagctgagggggatgtggactcgggggcaggatagaacagtagaagacatcgggcagccaactgtggcagccggatccggcccctgcattttgtagggaacgatagactgaacacagccacgctccatggttctcatgttgtctctggttgctttgtgctgtggtagtggggttgagccattgctgcagagactgtagggcctgcatactctaaagaatgcactatctggccctttaggaaatggtcagcaacccatgggataattaaggtttgggccaaaaggaagggaaggtggggaaataggatagagccaggtgggtgcacacagagaacagatgccaggggacagcagctgtcattagagaagaccacaaatggggttcaggcttcttggcagccagcttggcattcacttcgtgaaaagtgccaaccaaatgccagctgtggttcaggagaaccaaagctcttacaggtttggagggctctcatggaaggggcagcgtgccataaagggttgcgattagtaagtgatgaaaattaaacagacgttacaacatggtgttcgcagtagtgcctgctccagtcggcagtcatcccatcatgaggatgcacgggactgtgtgtattgtcctgggcacagccctgggcctgtgcttcctaggcctgctcctctccaccgtggcctctgggctcctccttccccagggagcttaggcccagctgccctgccctgctgggggccgtagctctgagcctcatggtgcccacctctttcccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtgagtcctgggcctggcagccaggtcttgggaagggcccgagtggggtcatcacagagggtcggtgtgtgcacagactccgggtcgcgcagacccaggtacctgccagtccctttgctcctgacttgggctctctggggctcaggtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgtgcatggcctcctgctaccccatgggtgcccaaggctgccttggcttcacgcaggcttctgttctctccttccacctggattgtgttagggccccttgaccacgcctcccctcccatattccttctttctagcctcctgtctcggggttcagtgactcactttcttagagttcttatggtcagtaatccccactggtttcccgaggccccatggatcctgcagaactggcctgaggctcctgagttcagagctagggcagggtctcccagtgggtccagcttcccaagttgttgatgttccttcccccaggtgcgggagatggaggcagagctggaggacgagaggaagcagcgctcgatggcagtggccgcccggaagaagctggagatggacctgaaggacctggaggctcacgtcgactcggccaacaagaaccgggacgaagccatcaaacagctgcggaagctgcaggtaagggtgggcggggcccaggtgagggtgggcggcacccgactgagccaactacatatgaaggtgccagggctcggcccagggcgggaacctggcagggtggcacctcctgggaaggtcctgggtgcttccagccccatctcactgacagagactcagaggctcagaggtgagtggaaacatgatagtccaacagcaaacttgcgaaacggtgtatgactgggtacataaaacacagaagcaaacaagtacaagcctagacatgggtggagttcaagaaggtctcacttaatgcagacttccagaatcacccgggtcctgacacccttcagccttctgggctctggggcgatggttccaagaagcagcccggagtgtgggacacatacttggaaatcttcacctcactaataattaaagaataattaacacgtaaaaacagctctgatacgccatatcatgtaacaagaataaccttagtttaacaaatttttttttgtttgtttgtttgagacggagtctcgctctgtcgctcaggctggagtgcagtggcatgatctcggcttgctgcaagctccgcctcccgggttcacgccattctcctgcctcagcctccccagcagctgggactacaggcgcacgccgccacgcccggctaatttttgtatttttagtagagacggggtttcaccatgttagccaggatggtctcaatctcctgaccttgtgatccacccgcctcggcctcccaaagtgctgggattacaagcatgagccactgcgcccggccaaaaaaaaaatgttaagtgtaaaaaaaaaacccacaaaaactttaaaacttcattgtggtcaaggttgtgggcatagatgctctgattgctggtggcatttttttactggtgtggtcgggctgcacacagccagtcactctctttgatttggggaatctcaatttcggatttatctgcaaaaggaaaaaaaggctatttgacaaaggtctttagtgttaaaagaagtaacaggagaataacaaaaggaaaggtgtttcctgcctgtggtggggatggaccggcaggctgggcactggttttgagtggcaggtgcgcattaggggtggcaccatgggcactggcttccggcccacaggaggggacagaaagtagaaaatgaagctcagcttgggctcacgtccacggtgacgaacactgtcaaagtgtgcattacggggtgggatacacagatgattgtctttagttgcctttttgccctgtcaccacggttagttggttaaatacagcattgagtggagcaccagccatgagccctgttggcgaggtgacccatgagggttggggtggagggccaaggagctgggtggggtgccaagcctctgtccccaccccaggcccagatgaaggactgcatgcgcgagctggatgacacccgcgcctctcgtgaggagatcctggcccaggccaaagagaacgagaagaagctgaagagcatggaggccgagatgatccagttgcaggaggtgggtggggctgcaatggagagcggcaccgctgccctgcggccagcaggtggcagcgtggggctttcagctgaggacagggctggagtcctactgggctccaggaattggctggggatggctctcaggttacataaggattccctccagggttccgtttcatagcggggctccctcgtatgatcagagtgtgtgtgtgtgtgaaactggcatccctcacatgagatgaggctttgtggccaccaccacctcctgctgtgaatgctgcctggtgagaaggggtctgagcgtcccctcggccgccctgcccgtcgcacctgagcccgtcctgaagtgtttcccaggtctggagggtgccctgcagcgtgatgtgccggctgcgagtgcgtccagggtgtagccatctgcctgtggcctccagagctgactccaagctctggcttacccagaacagggaggggccgccctgagtgactctgtccacgtggtctccctggttaggccaggacacttcttacttatcgccataccctggcacctggcttgattcctagcacttaaatgtaagagttttataaacatatggtgtttaagctatatcttcaggggggcaccagccctgtgagctagagggtttctggaggaagggcttcgtggggaggtgggcctggggaagggcttgaggggagggtgcctggggctgggaaggatggtcttgtggggctgtggctgcctttaggtcacactctgggtctttgtggcaggaactggcagccgcggagcgtgccaagcgccaggcccagcaggagcgggatgagctggctgacgagatcgccaacagcagcggcaaagggtgagctgagtgagggggcagagttgggggggaccaggtgtgtccccagggtaggcccctcacttctcccgcccaccccgcagagccctggcgttagaggagaagcggcgtctggaggcccgcatcgcccagctggaggaggagctggaggaggagcagggcaacacggagctgatcaacgaccggctgaagaaggccaacctgcaggtgggtgccaggacttctcccactctgggctctggctggagccaccacggcagagctggccttggacccagccggcagaagcacaggccaagtgccagctgctccccaggcgcttaggggaaaatgtccaggcacctggacctgaaaggtccccctctggcttctgtgttgggtgttcagaagtttctaatcttcccttttctgggagacccaagactctggaccccaagggtttggtgggatcctgctgccaccttcctctggccctgctcatgccctccagccagggccccagccctccccaaggtcactggcccttcttctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaagtacgtgcccctggccccgcccaaccccagctgtcctggaaaaaactctggcccccctgcagtcctgcccaaatctgggccacaaccagctctctgtctcctgagcctggggctgtttccctccctcctgatggggccctcatcccttccacaggttgggtggttgggggagcttgtggggtttgaacaggattctctgttccacctctaaagccaggagttttggtggctgtgtctgagagtgaatcagagcaggaggtacaggggggtcctgcccactaggacagttgtcctatgggctcagcaggactgagacttccttggagggaatggggtttacactaggcccccagacctcttttccagttacatagatgctctttgaggtgtgtcgcttcccttacctgagcccatttcctcatctgtaaatggggctatttgcagtgcccgtcgtaagaagccgggtacacataggtgtctagcaaaggcctccctacgtgatccctagatgccagtgagccccggggaatgggtggtcctggttagggcttgttggccggaccctctgaaggagggtgttccctctgagccaccttgtctgtcatgcagggagcgccaggcagcctgcaaacaggtgcgtcggaccgagaagaagctgaaggatgtgctgctgcaggtggatgacgagcggaggaacgccgagcagtacaaggaccaggtgtgggcgctggtggggcagtgagaagggcagcggggctgggcagcagatggggtgacaggcagggcagtggggctgactggctgcacgcccagagcccctaaccggggccacgggccacacgtccatctccgcaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggtgagccgccctgcccacccgcccctttgcctcggcacttctctcaaaaggtagcttgttcctcaaccagagcccacaagcaaggcacgaatgtcaccaagaaaggactgcacaaagcaatccctgccccttctggctccttgcctttgaggctttagcttagtgttttgaacacacagtaaactctaggtagtttattcccagctgtcctaaaagtctattgtcttttgaattggaagttgcttgaggccacctggcccagtcctggcacatgttaggtgcctcagttaaatatctgcaaaacgaatgtgagcctcatgagcaatgcctacagaggttaaaaacgctcctttgcgtttctcagggagtgttaacactcaagaagtagtgaatgtttgaagcagaggatcttattctctgagattctcatttcttacgtgtttttttgtgggttttttgagactctcattttgtgttttttgagattctcatttcttacatgtttttttcttatgtgtttacgtgttttttttattttttttgttttttttttttgagacggagtttcgctcttgttgcccagactggagtgcaatggtgtaatctcagcttgctgcaacctctgcctcccgggttcaagcgattctcctccctcagcccctggagtagctgggattacaggcatgcaccactatgcccggctaatttttgtatttttagtggagacggggttttaccatgttggtcaggctggtctcaaactcctgacctcaggtgctccacccgcctcggcctcccagagagctgagattacaaggatgagccaccgtgccaggccttcatggggctctttttgtaagcataagtagtcagtattgtatatgaattttctgccatgtggtagaaagagggtgcctgtctttgtactctgtgtgaacaggcacacctgtttacctgtcttggtttcaccggttttataggagttgcaacagaggatggcattttacacttacttttgtgcctttcctgttgtaattggtcctgtttgcctgagctgtttttgtgctactgttgtgtgtgaagatgtccgacacctaaacattttgcgggaagctttgcctgctttcctgagagtggtcctgtctagctcagctgtggctcccaagactccactttgcttctttctggtgggagcagccaggcacctggtttccctctcgaattcactttgagatgtgtgggctgtgctgtggccgcccctggcctggccgggcccgctgaccctctgcttctacctctgcccccaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacatggcccgggcccaggcagagagccaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatacttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacgagccgtgtctgtagcatttgtctgcggccagggggccctggacaggactaggcctggcttctgcagccaatgccggctctgcatcgtcgggaaccagattggctgaggcgtaggctgagctagctgtgggcggttgtgcagaaaagctaagatggaaaggtgggctaggccagatccaaggaggctaagagcatcttagaaaccttggttcaaggccgagcacggtggctcacgcctgtaatcccagcactttgggaggctgaggcagggggatcacctgaggtcaggagttcaagaccagcctggccaacatctctactaaaaatacaaaaaaaattagccgggcgtggtggtgtgtgcctgtaatcccagctactcaggaggctgaggcaggagaatcgcttgaacccgggaggcagaggttgcagtgagctaagattgtgccactgcactctagcctgggcgagagtgagactctgtctcaaaataaataaataaaaaaatttaaaaaagtggacactatctgggtcagcttaagaaggtgaccgatttttggcaaaacagctgcatgcacattccctggcccttagcttcctatgtgccaccctgcc

SEQ ID NO: 16744 - DNA, 12951 bp, Human
ccatctgggcttcttctaggaaccaaagtcacttcccggaattgaccaaccggcagactcgcccagggaggacccgctgtatcctagttgaggctaacggtcaatatccggcctcaatattcagcagaggctccaggtcagggtctgagccaggccaacaatgaccaaggaggatgggatccagggtgcagctcctcacaagtgtcgggggaatccgaggcaccagctctctctaccctcctgctcctctgctctctcctggtcctcctgtgtcctcatggctcatgagatggtgttgagatggctcccctggcctaggggatcacacagtgaacaaagcaggaagaaggcgaagggatgcccctctcctgtcacccttgtcccttacagcaagaagggcccagacgcccctctgcatactcccctggtgaactgctgcccaggactgggtcccccttttacccttgctgcatggagtccccagaagacaaacatctgtgtgtctgaaccctgagacaaaggcaggaaagggaaagagggaggcgagtggcttttgaggagggggctttagtatgagagctggaggatggaaccccatcagggggcccgggaaccactgagctgttaaaataaagtctgcaaacaaagaccagctgctggaagtgggtgtgccagggagtgcgcagagacacacggtgagaaaagaacaatggtaatgcttggagccgcccctaactgggatgggcctgaaatggtattgttattatttatagtatcattattagtcattttcatcttatttgtaccctccctctatctctcctctccaccttttcctaacattctatcaccagttttatgtcttccattagcaactttgtagctgtaaataatttacttacaactttcatataccctcagttgtacccagtatttcttaacttccctctttaaaaaaatgataatattaatcctccttctccttcgttcagtgcttcacatcccaactgctacctttgtgctttaaattttgtactaattggtgttgataacaagtatatttagttctcatatttatatgttgtgtatatgttttggtttttttttgtcttaaacaagagactactgagagccagtaagactgaaagaaagggcatcttcatatactgctagtttgagtgtgaattggtacaatttgcctgcagtgtggctctaggtataaagccttttgagttgttgatagcctctgacctgctcattctactcctacaaatatcttaaggaaataatctcaaatgtgggcaaagttttatgcgaagaaggatgttctttgtagcataatttatatgaggaattagaaacaccctgaggtccatcagctagggaaagacagcagaggggacagggcagcaccaggagggcttggcagccacagcaggggctgggctggcatctggcaagatccaggtctttgtgggacaaagaatcttagagaagcaacggggacacaggctgtccagtgcagcaccagtgaattcaccaaggatgaagagttgagcacagagtgtgagacaaggatttgcaatgaggagtcatttaccatgagcgtgtatacatgactcaatattgtatatttaagggagtagagcacagtcattgaaaacatggggttgaagcagaagtcctggctctagcactattgtaaaaacactggcaagttccctaacttttgtggattcctctgtgtttgaatgggaaattggtacccatctcctggcctgtgtgtgatcatcgaatgagatacatgtaagaggctctgcacatcgcagacatgcaatacacactggctatcaccagctagttatcacacatgctcccaggccctggtcattgtcagaaccttcctccccatctctatttctgtgtatagactctgtagtttctgtaatgatcagatggctgcccgtcctctgattatcttctcctcataccccaacaggatgagtgcacttttccttggtgtgggagtgagggcagaggaagctggagcgaggtgagtgtctgcaaatagcagatgatgggggctcagtgatagacaaacaatctggtttaggttggtcttggtgtttgcttccaccccagagagatttgcagagccccggctgctcaagcaagcctccctctgtccactggtggctcacatttgatcccacaatttgttttctcctcctcaagggtgcaacaaaacgttccaagtgggacagatactggagatcctcaaagtaagcccctcggtgactgggctgctggcaccatggacccaggtaggctcacctcctcttccctgctggttcctactcgcacttagaatggagggtggcacctccacagctgagtgagccccagaagaacccggatggactaggaggccaatgagtctgcccaaagcagcagaagaggtcacgtggagtcccccgacccaggggtctgggggtcatctgcatcctgacctctccttagggtgacacggcccaggtgcccacttcctccctaccctggcacctagcaaatgactcaagtggggcaggacatccttggggaagtggaatcagcggggggggggcgggagtgtggggagagcagggtccaggaggagaggagggctgggagaggaggttgaccagcagccccgacctgtcacctcccgctctgctccaagctgaccctggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtaccatgagaataatatttccccatgttgtcttgaggatcaaatataacacggctacctggcctggccagtgcctgccacacaatagggcctccctaagggctggttcccatcccctctactggtcccctgttgattccaggtggaagccaccccgtccccccccagctgtgttagggcacccgccctgccctgcccatcacaagcacctgcttaccagggatgactgcctcaggcaggggctgagttcagtcatctaaaatacccccggtcaaagaaaaatctgaggcccaatagaattttaaagagttaattgagtaagaaaggattgctgaattgggaaacagcaaactggaggaggcttcgtgctatggtgaaaaagtgtcggagacaaggtttatcgggtgaatatgaaactgcagtaaggacattatttgattggttgcacttacaaaactgcctgtttgggtttaccttgttggaaaatccctggtcacgttggtgccagtgtgagtttagggaggtctccgaatacaggtgagaccggaacttagccttgcccaggtttttgatgctgaagagagaaaaaagtcaaagcaaaagcaaatcagcttttagtgcaaaacagaagtgcaggctcaggggtgggagtgcaggcggactcagaagagccagtcgggcccagtggagtttggggttcttgtctttgctggtttattaaattaaggtgtggagtaagcataaggatttctgggaagaggtggggatttcttggaattgggagggcaatgcagttttgtaccaaacatgggcatacatggaacggctgtggtgcgggtgggtgtggggtttagtgagacaaggagggtatgattgagtgtgaggcaaaacgtgggtcagacccagcgccgagttggatctcactggtcttagctgaattggccacttcctgtttgtcaggatcctgtgggcccatcccctccccctgtccctacaggtggtttcagcaactccttctgtgtctgtcatgtgaacctgctgcctggagttcttgtttcttctgtgacctcccagtatccacatctcagcatggccctctgtcagctggctttaagttttgtttgtatctaacagaagtacccatctgatatgaccccagttgagtttcccatagcttgcagtttcagggggttacagctgttctaaaggcctcgtaggtattgtctgtccaggaatgtttcagggctggtttttgttttaattttgcttttatatccaccagccccaccacatcaagaaatacacagatttagtgccagaggttccttccatccaaacctgggtttccttcctccttttggtgaagaaggaaaaagaaaaaacaagacaatcgctcgcccagccaagtcagcattgcgttcatttccctaagccccatttcctcaggagggcttcctccccttacagagttgccacggcaaccaagtcagctctgctcaggagccgccctggacagcaaactgggctgtgctgagtcctgtccaagacgaggggagggcagggaagattagaagccgagagcactcagccgaccccggaatccttacgaagggctgggctgggggactgaggaaaaactctccccccaaaacaagatgatctgtggtttaataacaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatagccccacaggtaagctataagggagaatgcagagaccacaggcattttcaaaacataaggagttttaatgttaaggagtttaaggagaatgtcaaagaaacattggccttggagtcaaatcctgagcttcctgcttgatggttttgggcggtgactctcgctgtctggattttactttcttcatctgtgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatccccccaaaaaaaagaatgaggtctcttgtgtgtgcacggcaagaaacaattttacatcatgcctcagtgcacacacaaatacatactggtccccagttccttatctgcaattccataattcccagatccctgcaaaccacacgttttggtggcagctgacttcaggagtaatcctgctctgtactgacttgagttctttgtagacctaccattattttttacatttaatgtgaatatttgcttgtttcactgttgaaacatgtgtgggtgtgattacagggagcagtccagcctctgctgggaatggtcaggaatataccatatgcaccccgtgtcctttctaaaatagtggaaattctgaatgcctaaacacatctggattccaggaatttacattaagggatatatatttgaaataacccacaaaaacaatactcacccctgctacgcttggtacactctgatattttcaaattgattttctttttaaaatgctgcttttgaaccaataatttcataacccaatgatgtgttgatattcacattttgaagacactggtataaagtgtttgacccaacaggcatgtggcagatggaagtgatcactgggatgtttccacttccttggcctggaaggctcacttcatgttggtgctgagctgaaaaggattcattcctctccaaagcaccatggcactcccctggtgtttcaatgttctcaggctgccatagtaaaatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctcacacagtcttcttgtgtccctttctgttcttacaataggacactagccctctaatagaattagagccctacccttgtgatctcattcagtcttaattgcttccttaaaggccagatctccaaatgtagtcacctgagtttaaagcttcagcgtatgaattttgggggcacacaattccctctatagcactaatgactccataaaacaagtcccacatcacagctgtccaggaaaattaacatgtagtcatctcttatgcaatggctgttatgcgctcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggtaagctccatggggttacctccattgggcactccggcgatgccacccagctctcccctgggctagttttccctgacaggcacacctcctccaggcagccccctctgctgggcttgaggatgaccttcttggcactccaggaagaatatttcctccatgtccttcgctggcagtgagtagcctcaggctgaggggataggaagcccacaggaacagggtcatttctgccatctgctggtgatgggaactttgccagttactttctcactttcagcctttcttcatcaatggagttttattgtgagaaaaatgagatcgtgcatgtaaagtgcttagcataatgactgacacacagtaggtgcacagttaacgttaacatcttacaagcttggtggaaacagaaccagggttaaggatcttcttcttgaagatgggagcccagcaggacttgacctttgggacaagtcagaaaaatcctgacctaaccaatgtgtgttcctggggatgctggctggagccctttttctcatctgaggaattccataaacacggcaggacccttctgctggtccaggatgccgagaggctggagtggagttgcacagcgctgggtctctttccagctctgtctgtgtccagtccctgggctctgggcttatgtcagagactggaaactgtcatcagtctaataggaatagcaactcaatgtgataggagtgtggtgaaggccttagaggcaactccaggtcaaaggtggggaaccaacaccaagatcctgcccaaaggcccagagagaccgggatcagcgtcagagcctggagtcaggatggagcaagagtcagccttggttgtaggacaagcaggaaggctggggcaccagggctgggactagggtgtggaaagagaggcaccaagggcttgaaacttaaggaggtcatgaacttgcagaggacatgtgagtgggagagggatatttcttccctgtctggatgatcccaacactcatgggcatatagggtcatggttgcctgtgtctctcacaccacgccttggaactggcaagttctgggctaccctttgagaccttcttctcttctacacagagaaacccctgacattgacaagcagtatgtcttagtgaccattttcatagtagaattagttgctgccaatttgtgtaatttcagggatactgagcagactcacaacttcccaaccaaggaggaaaacacttcctctaccatcttgtccaaattcaggtcttttcagcattagcaatttatataggtggttctgaaagtgttttgaatcttctagaggttccataaaattgcaaatggccttggtgtgcacacaggtgaagctgtcactactaaggcatcagttaggctggtgacacctgcgagtgagacctggaaggttgggggtgcaggtggtaggtcaggaggcagtaaggtggctggagcgtccatgtggagccagaatgaatagccagatctcccactccagtcagctggggcagtggccagaaccagtagccttcagccaggtgaaagggcatgaggcattggaagggagcagatgccaggcaaagtgaactcctgtctctccggggttttgtttttgtttgaattcaaagtactcagagatagccagactgcaatgtctgagggcacccttacctttgacaccacctgcaaatttaaggggatttctaaatccatcctttgattttgtaattcactggaaggactcacataactcactgaaaactgctatttcacaattgtggttgatcacacagaaagaacacagattaaaatcagcctaagaaagagacacacggggcagagtttgggagggttttaagtgtgaagcttcattgtcctcaggacgctgtgttctcctgtgtgaatgtgggacaaaacacatgcggtgttgccaaccagggaagctcacccagttaaggaaaaattcctgtgaatcacattaaaccagaaatgaagccttttttcaggattgttgttacaggggagggagactgagcccagctccaaatatagtaaagacagagggggagtcacagccaacaccagggtgggggcgggagatggaacaggactgataggagacaccagagtggggggttcctgctaaattggcctaacaggattctcactaaaggcaggtcagacactcacccatcaatggtgggggtgaagagcataatcagatagcaaagcgtaatcagacagcaaggggggaagaccctccctaaactgacttggggagattcttgctgagctgggtggtgcaggtccagcaagcagtgggtggctgtggaaggccaaggtcggcgcctagtggagaagaggctcagaagagcccagctggagttggtcaaggagaaagtccttctttctcaacccatgccttagtgtccagagtatctgctggggctggatcacaagctgccctcatggctgacctggagtctccagcccctccctgaggtctaacccctttagtccccgggtcctctgggatcaggaaagacaccaaatagccccaaaccccatcatccatcagattcctatacggtcccgtggccaaatcaccaggcaaagacagatgttcctaccaggcaggacattccaggggcctggagatcacttcccaggagctgaggacaaagggaaggcctctctttgggtaaagttcatgcttcactttcctgccatcctgggaataaggtctctttgtctcactctcactgctctttgttcatctgcagagttttccctctccaaacactttggcagtcacggtgttgacctgcccttgaatgaggaggcatctttatcaaacacctaccatgaaagagcatctgagatgcctttaagatatttatttccatatggaataaatattgaggagtatctatgatgaacaaaatgtgtttgagtttgaaagataattaattccatttgtaaaatttgtttctatttgatcgatagtgaaagctctgcaatttacacaggatagagatcacatggagctcatttcacagacagggaaactgcatttcttttttttttttttttttttgagttggagtcttgctctgtcgcccaagctggagtgcagtggcgcgatctcggctcactgcaagctctgcctcccggttcaagcaattctcctgcctcagcctcctgagtagctgggactacaggcgcccaccaccacgcccggctaattttttgaatttttggtagagacagggtttcaccgtgttagtcaggatggtctcaatctcctgaccttgtgatccacccgccttggcctcccaaagtgctgggattacaggtgtgagccaccacaccaagccaaaactgcatttcttaatcctttaacctttccttgtgcaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaatggtggtgatggtggttgtgatggcagcagagtggtgggggccttggcaagtggtcggtgctcttccagaccaggggacaccgatggaccgatgaagttccaggggaacttgaagtgctgtgttggaaagaggttaatttgggaagaaaggaaaaatgaaaggagatgccaggaacaggtcaaggaaccttgaggtgtgtccaggagttcaaccccgcttgtggtcacgagacctcgcctctctgagcctcagtttcctcatcagctgtagaagggtacctggacaaggtgatgtctcaggtccacccagctctccccatcttgtgtcctggagacttgggtccaatcagcactgactgatggctgtgcctttgtggtgccgatggaggctcccctgggctctgggtgcctgacttcccttcctcat

SEQ ID NO: 16745 - DNA, 22615 bp, Human
acatgaagaagacctatggggacaaagaggaaggccatctgggctcctgagaattcacccacagtaggtgctgctcccgtcttccggtcttattctggaagcaggatagtgtggtagaaaggagcaagtgctttggagtcagagaaccggggctgaaatcctacctccattctgtgatcttaggcaagttgcccaatctctctgagccttgttcttccatcattagtaaaaaagagagggttttgcctacctcttaaggggatacaagaatcaaagtgcgatgctgtgcacacagaacccagcacactgttcaacaaacaagtgtaattattttcccaggccccagccagcgatcttcctcaagggttcatcctcaaggttctcctgcatcccggctccctgagctcagccatgcccacgacttgacgagatcaactccttgacttctctgatgacaaagcccccagggtccagccctgacctcactccagagttcagacacatctccgccagggtgtccttcaggtcccctaaacccagcatcagctcttggctcttccactactctctgggggatttgggtaagtcaccctggccttggtttcttcatctataacatgatgtcatttgtagaagtttgtagccgatcaccacggaggctgtcccagccctaacatcctaggattcaacaccacttactctatcatcccttcgactgagcactacctcctccctacactccctgccttcaaagtcaacaccttccttcttcagcaaaccccaccttgaatatttagggtcagcttggatttgtccctcttgttcatgccacagccccaattctggaagcttctctccaagaggtgctcccctatctgcacactccttcctgttgccaccaccagcaacctagctcaggccccagcaccacacctcaaggaggccccagtcccagcttcccccatgcagcctgccctcggccctttctatccatggagcttccaaacagcctttgcatggagcctgggattcctcgtgtcactgtgaagaactagaccccaccattgacaatcttcgtgccctggagattcttttcaggttagggatgaggagaggaacatttcatggtggtcagattagatattcactacgtatttattgaattcatttggtcattcatgcttctcaaaacacatccctcagctggtcctctccaatccaaaacagacaatgtcagagatctctttgcaaatcatgaagggcttgggcctttgtgcctcaatgtcacacgcatacaatttcagggggtccatcttcccctcgccctagaccatctatagggcacagtttacctctgattgagctcatgttacaggtggaaagactgagaaagagagaggaagggacttgtctgagaatatgcggaacatttccttctaccaggcactagatcctcgcacaaaagtgctgagtccgctcccaaccccaggcccgtggctttgagcagcaggtcacttaacatctaacgtctttatgctgtttcctcatctgtgcgagagcagctatgtctacctggcaaggctgtagtgagagatcatatcagcataggaatggggctcagccccatgcacagaggacagttcttgtttcattcttttccttgctgtttctcttcctttcctggcagaatatggaggaaggaagcatcgctgccatctacagtggtcacggaaggcttcatggaagaggcgagccctgcctgggcctcaattttgggtgctggagggaagcaggggccaagagttattaatagtcttggcctgatgggcccagggaggctgaatgtgatacagacacccagcaccacggttggggagtacctgacaccggaaggggagggggccggggctacggggagtgccacctcccaaaatagccagagcagaagcctatataggtggccatcccacctccaggctcacttcccgacaggacttcccaccagcccagcctttcagtgcaggctccagccctccacccccacccgaggtgagtggcagctaccgaggttggaggatagagggatgcagcaggatgagccagctggaagggagagctacatctcccctgtccgtagtgacccggggaggggggtgcggtgggggtgctggaggcagggcagctgtggaatgtagggctgagagcatgcattcctgcttctccacccagactcctggtgtggcctggggcaaactccccccacccaccgccccccgtggctgggcctcagattccccagccttagaacgagagggctggagtcagacatctgtggactctggtgatgccatcagagaggacccagagggcagaggaggactacccagggctgatgggctgacctaatgacattgatgctctggctgggagggctcagtcccggagggggtgtcaagttgataggagaactcagcagcagggagagatggaggaaggagatggaagaagagtgggcccctgttgaggctgcagcctttgccacagggtagctgcttaggggctcaccaggagccagtgtgtggctgagatgtatgggacctgatagagctgggtcccaggcaccagggaggatcacccagagagtcactgaactccacacgagtgagtccaggggtgtaccctgctctgctattgctttaccatgtgtccttagaccattcacggactctgtgcctccgtttctccactggtatagctgaagcgtccttcagctggggaaatccattctccaactaggctcctggagtgagctgagcctgggagttgaaatgatagcataggagcctggcatatctgagtcagcagcccagctggggacaaggtgcagaggtgacggcagtagcagcagggtccagggcagctgaggggtcctgggaagtcctggagctgagaggcatcaggtcaggagctgcatccttggtgccttggaagccatctggcgggctgtggcttgaaggagctgactcacagggagggggcagctggagccagcagaggtatcctaaggtttccaggaagggcagccatccagggctgagctgcaggagacaatgttgacagcgatgtcagggaacttgagttactgggcagctggacagctgctctccctggtccccaccacccagggccaccacagcccaaggccctgcctacctgccaataccttaagttgcagtccccaggtcccactacatgggaccactgacgtcatcaacacatcagaaggagacagaagcccagagaaggtcacaacccaaggtcacactgggacttagtgcagcccaggatctagaacccaggcctcctgactccctgtccagcgctcacacactctagaagcagctggttgcagcttgaaaccttgggaaccatggggaagaacacaacgggtctctggctgcatacagataggcaccgtgacatttttccagaggtgaagttcagacccctacacctgcttaggttgtctagaaagtgtggtctgaaggtgctacccttcttccaaacacatatggggctttctgggagggagcatagcaattccaagcggactctcccaccctactctgcccaaaaaaggtttataggagtagggggagtctggacccatgatgccaggacccaggagaccaggaaagcaagtagttagtagagatctgagaagtgttcttcgaaaaatcaagccagcaaaaaaataaaaaataaaagtaaaacatcaaatcaggttttagaatatgcatccctggccagatgtgggatggggcacccgaagtgggccccagcagctcctgcctgtccctgtccctgtccctgccacctcctccctgcgtcgggtgggtcaggtttcaggacctcagcgctcagattttgcagcataaatttgcatccaggacagaccagagcagaggctgaggtaggagtggagagagaaagggagcagggcctaggaggtcctgaggtgcaggctggccgctgaaggttcaggatcttcccccacgcggcaggacatccgccaaggttcccagatctgagacggcgcacctcctgcgtgtccttgacggcaggtggactttccagacccagctggtgacgccagtgccccctaaatcccagaggtggccccttccctcgtgccctggccgcagcccctgggatcccgcggacccctggcctggcggtgcaggagtggtagcaggtccgcgcgccttcttgccggcggccggcgctgctcagcggcgcggctggactgagccgctcccgctgcgctcagagtccgggcccctggcgccatgccaggcccggcgggcgtgcgcccggcgcgcagcactgcagcgctggtcatatgagcagaaatgatgagaaaagcactttttaatcttttcgcacttgctctgcccgctcaaacagttgcaggatgtcgatgacagacttgctgaacgctgaggacatcaagaaggcggtgggagcctttagcggtgagcaagcgcgctcccctccccatccctctcccctcgtccaccgcccgcgcccctgcactccgccggccccgcagccggcggatcctccccagcgcgcttctgcccacacttcccgctgggcgccggcgaggtcggggcgggggcgtccttggcagttcccaaactctgtccgggcgaggcttggcgcggggagcgggcggggaagagggcgccccgcctaagttacagaaacttgagggtgctgaaggcccggtggctgggaggactcagggtccgggaccaagggcgaagaccagggtcggaggagagacctccagggtccttgtacgagctctctggacgtcctctttaaggcacttagaggggactgcagggggcatcctcctctccaagagacccctttcctggaccctcattctggacaggacttttcccgccaggcggtagcctttgttggccccctgactgtcctagttcctttactgagattcagcaacggacctgcgggcgaggtgaccttctggagccggcgcacagctctgcctaagcccgcacggggcatcctcagtgcctcaaacctccagcctccttaggcgggcaggggaggggaactggcagtctcacctctcccagctgcccgggacttcagcgctaagctgcccgccttcctcctcccctgtcctccagatggggaaatcagggaactgtcttggagaggacaagacatttgcccaaggtcacctagctgggcagaaggggtattagaactgggttgcccagcctagtgtcggaggtggacagggcaactttccttgtctctagccctgtgctgaggggaagagaacatgacttcaacagccattccctacacacacacacacacacacacacacacaaaatacatgatctaacattgtacccttccccaggtgttctaaaacaggaccccaagatacagaaaattgcaggtagaaaaggacccccatttcctttctgctttgcaccccctcccctgggcacaagaacctctctgggaagccaccctcccagggtcctgggataaccctctcccttcacctcaagcccatgtgggaagaaacttaactgggtgtttctcgggagcctcctaacacccccttcccactgcctccgaagtggatttctgcgcagagccaggacttccgggtttgcccctcctcctcccactgtatgaccttgagggaaacctgtcctttctatgtcaattttctggcaacaaagtctgtggccaagaaagaaggtcaaccctcctccccctaaccccaggaccatgttcatgcccccttcaattccccagcccactcccaaccagctggcactcaaaagtcttcctgggcacaaggttctcagaagaacaaaagcctttggttcttaggtgctgctcccatcatcagcaatgggtgcagtggaggtggggtgtgggggcgggcttgagagccagggaggtctgggtttgagcacacctcttccactcccagccttgtgaccttggacaggttatcctcccttgcccgggctccctcagccctccaatggaggtgggtacctctcattccccatgactggcatgtgggaatccatcaacaaatgccttgatgccccccattctcccaggcttccctaccagcctttctggtccttgtttgaccctgctcttccccccacagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctggggtaagcggaggcctgcaggggctgcccagcccacggctgcacgagagggagtgggggctgggactctagcttccaagtgtccatcagacctgcctttcactctgcctgcttcacagaaagtaaccgtgcgtgaaggcagggctccgacccagggcaccaggggagaaggcttcctggtgctattgcttcggaagagtaaaaccctcagctgaaagtgcaactaactaggttaaatgatagccacttaatattgctaatggaatgttgctacttaataatttaatgcaaatgaagaggcagttttcttgctgcctaacaccataggcagggcagaaagcattcacttgagtatttcattgattttcatttgtctaaaagacactttccaccttcctgcagcccccagccctctggtactagtgtggctggtgcaatttctaggcaagccagggatgcagaaccacctctgagagtccaggggtccttggagaaaagcagagaaggagaaggctgtggctaggaaaatgcatgcctccatctgcaaaagcatctcccaccataattccctcagccacccggccatgtctactgactcaggttgccttatgtcactttctggccaagaaagccttgagttttgtcaaaaagagaagcggggggtgggtgtagggagaggcctttcaagtagggacttccccacccatcctgtctctcccctaaaccatctcacaagggtaccttctgtctagaatcttcacgttctacccacttacatccaacatgcatgcacacttatgcacacacacacacacacacacacacacacacacacactcacagaggctgacttccccctgtcctccaggtatcaccttcaccaggaagcctcccctctcctcccctcaccgcaggtgggcagatacagcttctgagtgccctcctccacggcccatcacactgtgtggtctctctcggagcccgtgacctccttattttttccagtgccttccgaagatcaccactgtgaccccactttccagcatacgccagacacagaaatgacacttagtgaatacttgttggataaattaacgaatgtaggtgccctccctgaagtgaggacaacccttcactgaggacagcctgtcctttcctaaatactcacccacgaaagcacagccaccgagcaggctacctggcccagagcatccgtgtgcgtgactgctgctcgctgcctgtcccagccatccctttccccatacagaaaccagaccaccctccatccagcgtcctgcaaggcgacctcggcctgactccctcaccggctttctcccttttctcctccagattcatcctaaaaggcttctccccagatgccagagacctgtctgctaaagaaaccaagatgctgatggctgctggagacaaagatggggacggcaaaattggggttgacggtgggtagccgtgacctggggtctgggcatattgtggatcttggggtgttggatgcgaaaagtttgaagctatgtctgtcacaaggaagggatgatatgggggtccctcactcccccagattagaagacaaaaagcagtccattaggtctgagagctctgccacatactccagacaaaggaaaactggtgtattttcctaatttgaaaacctaaaaggaatagattctgtttttcctgctgggtaggggatccaggaggatttgggatttttttttcctgaactctgcctgcatttttgcatggatactggcccaacctctgcccaaactggctgtgtgaccttgggcagtgtctctcgatcgctgggcctctgtctcccatctctaatccaaggaaatgaggccgactaatccccaaggatcctctgcctctcacatcctcagattccagggatggaaattcctatctcctgtcctcctcagcatcttgtcctggtgtcctgtaaccccaagtctcaaaacctgtttgggttttactcaaatatactattctagccttgcagcagagccaggaaaaacagtaaaccagaaatcagtggggaattcagacagggaatacctggccctgccttgctttgcaggcttcaatgtcagcacaggtgagagaccagtggcccaccgtccactcctttctccatttggctctgtgtggcattcatggagcacacccacattgccatctctcttagcttatgattttctccggaattatctccattttgcaggtgggcaaatggactttgaaggtgcttagcctagttgaaagagctaggacatagcggtggagtggggatttagaaccaggcctgaatgagtgtttgcagcatactaagctgccatttgctcccataataggcttttctgctggtctcagagaaaactgtgtgtaggtgtttggcctctgggccccaggctatctgggttcaaatcccagccctaccactttcgagctgtgtgaccttgcgtaatttgataactactctgagcctctgttttctcatctctgaactgaatagaatgataattcttacagggtgattacaagggttagatgtgttaatatgtaaagtgcctagaacagtgtctggcacagagtaaatgttatatatgtatttgttagctaatttttttaaaactaggtcccttcgcaagggtaccttctgtctagaatcttcacgttctacccacttacatccaacatataagtggatgtaaaacttaaaactagggattgggttgcattcatccttctagccccagtatctagccaataccccacacagagcaggtgcttcataaacatccgctgcctgagtgtaaagcccagacccccatgctctgctccttctctgccccttgccagctgtgaccttgaacacgtcacctctgcacacctacgttcccttgcccggcaaatggggtgcatcagcttctcctaagacctatttgggcttgttgtgaaaattaagattctgtgaacacaaaattgctttgggaaaggtacaaggattatgaaagtaggtgtatgcctatgagttagagggttttttttgttgttgttgttgttgatttcttttctgtttgtttgtttcctgccagtaacgagaatggagaatccctatccaggtcaaatgcagggggtcccctggccatctgatgccagctgcccttcttgtggctgggaaggagggaggtggttttaaaggagtggagcagagggtattggaaaggcatcattggcttggccgctcctggggcttctggtgcttggcagatcctccctcacacccccatccccaccaatctgcttatcagacagctccaccccaaggcctggctcccatctgaaccctgaccctggcctccagacctgccttccatttttatttgcagccaatatgccatacctcagaagccctgggctgggtcttcatggctgactgctcacagaaaacctacctgatgaagagaaaccagccaaacctggcccagttccctgcctccctccctccctccctgccacactcagatcttaaggcatcaactaaactcttctaacagatccagcagatgttgactgagtagcaactctgtgcccggcaatggaagaggtaaaaataattcaggcccatttcctgactgggtgcccctgagcagctactccttagccctgagccccagcttcctcatctgtaaactaggcattataacatggaaatgtggcctgtagtgcccagcacataacaaatgctcaataaatggccactgcaatgccttatttatttatttatttatttatttatttatttagagacagtctctctctgtcacccaggctggagtgcagtggtgtaatctcagctctctgcaacctctgcctcctgggtttaagcaattcccccctcccccagcctcctgagtagctgggattacaggcacgcaccaccatccccagctaatttttgtatttttagtagagacgaggtttcaccatgttggccaggctggtctcgaactcctgacctcaagtcatccgcccacctcagcctcccaaagtgctggggttacaggcatgagccactgcacccggccatgcaatgtcatttttattgtctgcaaattgcttgcagctctacacatatacacaaacaagcgatagtgccagccagaggcagaggcgcaggcatcaggcattttgtacggacttggaggctaagccacaggctgtaggggacagagggagtggggtccaggcaaggtattggcatcagccaaggctggaaacttttgggtatgttcagaaaggggcaagaagattgttttgccaagaatgggaggaaagaattattagctgggcatgtcatgtgtgtccagcctagtgctgggtttggttacctcatttgaccttgggacaacagaggacataagtgcagatgtagaaagggcagcccagggagtgagtgcaaggtcacaatgccagcaagtgtcagggccaggattcaaacccaacagcatggtccaggcccacctgtgcagcctccattgagctcataggcaagacataaaatagacaatgagcacagaccaccctgaggcactggggccccacacttcatgcttttgaggtgggaagatgcagatgcccccttcctcactcccaaccccctaacgcaggaagggtgggtgcaatgatgcccaataggcagcgagatgggaagcagagcctttttggggcccaggacgttctgtttcagatactctgctttgctgtcactctctctaaaggccagaaggcccgagccccacctatagctggaagatgccttcaactcctggcgggatctggggcatgtcccagagcccctctgaccataaagtgccttgtctttaaaaccatggggcatgccgggcgcagtggctcatgcctgtaatcccagcactttgggagtccaaggcgggcagatcacaaggtcaggagttcgagaccagcctggccaacatggtgaaaccccacctctactaaaaatacaaaaattagccaggcgtggtggcacacacctgtaatcccagctactcaagaggctgaggcaggagaatcacttgaacccaggaggcggaggttgcagtgagccaagatcacaccactgcactccagcctggacagcagagctagactccatctcaaaaacaaaacaaaacaaaacgaaaaaccaaaaaaaaaaaaaaaaaacatgggacatggggcagatcactagccaattactggggtgcgttccagccccgggatttcacagatgtctcagtggataaacctctacacagaagaccacttcactattttggctcagctgcgtgaccttgagtgatgatggcaatagcatctaagttcatagagcgctcaatatgtgccaggcaccgtgcttagcatttcactcatttaatcttcctagctatctctgaagtgtatactattatgattcccattttatagatgagcacactgaggctcagagaggctaagggcttgcataaaccctttaggctaggaagagaaaagatcaaagtctgaaagtcgggtcttttgagctccgaagcacgtgacctgtgctgcctgcttcattcattcattcattcattcatagtttaatttactataagatgattatatttattgacttattgcctatttctttctcctccactaagatgtcaggtccactgagcaggaactttgtttttttcagttctaatcccagcacctagaatagggcctggcccatagtgggagaaaaagaaaagtgtatttggttgaatgaatgaatgaatgaatgaacaagtacccagctctgggcagcactgtgcagtgatgaggatcataactgctgtatgtagtgggagatgatctgcaagccaaggttggggatctgtggagacttgtctgtagcaggtgccagggagcccaaaccagggactgcctctcttccctgctctgtttgtccttctgaaggtgagtgatacttatcagtttcttgaagatcctgtattgaagggagggggtaggaagacaaagttctaataataaccctttgcattcccgtctctggggcaactacttccaggaagctcaaaggcttttatagatgtggttgattcattctcaaaggccaccctaaaaggctggtgcagagctgacatggggagggcttaaggctgaaaaggaaagagaagctagaaaaagaggtgaagggtgccaaaaaaaaatctttgttaaagcacctgcagttgcaaagcccaggcataaaaagcagacaaagcagactatgtggcaggtggcttttcaaacacttcaccttcacaacaggtctccagctgggagcgggtgtcagcatcacctggagggcctatggcaacacagatggctgtgccagaccccaggagtttctgattccttaggtggagcccacacttttgcatttcttacaagttagcagatggtgctaatgatctggcgaaccacacttagaagaccactgccttacaataatcctaggaagtagatgccgtcactatccccattttgcaagtggagaaactgaggcatcgtgagaagtgacatgcccagggtctctctgtagcagagctagaactgaggctcggtggtccagccaggaccctctgccatcctgcctcacacgagcatgtgtccccagcctgggccttccaaactcaatgcctgcccccgcagagtgtgttgaccaacaggaatcgaggttagcattcatccccacttcctgtgtgccaagtacagcacacaggccttacatcttttaactcattcaaacctcccaacagctctacaagatatttttgttactgatacatacaaggaatctgaggcccagggaagcagagcgacttgctgtgaagcctcagggccctcttcaaaccttgactcctaatatcttgctgcagagaagatccgcatgccccgtgtgcacacgtgcctgcacgcagtcctagttacattcttcctgaaacccattcccggcgatggatccactgccctctgctttaagtgtgtctcaactcaagagtttggggtttgcattttgcttctgttgctgaaacatgtagtcatcattattgcctaaccttgcaacccccccaccccttgccactcactcgcatgcctgaaggaatttgccttttctgcttccctctggcaaaatctgttcccttttatccttaagtagcctatttaccgtgagaggcgtgagaggcggagtggtagcgtaaggccttgggctgtggtggagcacctgagtcaggcagaaattagaaagccaaatgctggggatcagccgtgggaatggctgtatcttttcctctctcaggacatccattcccacacctggaaagtggggagaaaaatacacaccttacagggctgttgctcgaatgaagagaatgttctagaaatgattcctttcctcttattttatgggaatgttttgctcgtaagccacccaaaaccttttaaaagtggtggaatctcaatcctcaacagaaaggaaattgagtctaaagcaggagaaaagtgagagagatagaaggagaatttgccgttctccctgtaattctagccctccggcctctatggggatttgatttctaagtaggacaggatgctcagatcaaggctagcccagggttttgagggcagagccctaaggtgcacgatgctttgtcccatctcattgcaccctggtaccagctcaatgaggtttaggggacactgtgatgcccactgagagacttgaaaactgaggccccgtagacagtaagtgccaaagtcacatagaagtccttggcccaacgggacccgggtctcctgactccaccactccctcccctaagctgagctgagacgttttagttataaatggcttctgtgcttagcaatctgctctttttattcccgtgtggactttccctagctctggccttatgctgcactagaaaagatttagcaaggggagaggaagcagccttccttacataactggcctcttgtgaaagggagcagctgcttggtggaaaaagacattcccctccatgcatccctctccttctgcctctgggggttgcagcttgagtcagaaccaggaccatttaactccaacctttgaggaagagacgcaccctggccccagccacgcctgttagaatcttcctagctgagtgacacagtgacactcagcctcagtttctctgtaaacaaaatgaagataagagagccgacgaggatgaaatggaataacacaccgtgcggtgcctggtacagagtgagccccagaactgttgacgcggcctccttgtggctgtctggcttgacccggagtgactctgcctcccagttctccgggatgggaaggtgatccctgtttgagataccaatttataagaaaccgagcccgggagctatttagaggtgaggtgataaaccaggaggccggctccttcatcccggtcatcacgacagagggagggaaagagccttccagccgctgactcaatggccggctcagtttcgctttgggccatcagcgtgtgttgctctcacctgtcaatagcttctaaatttgtccaatccccgcggccttggactgggacagacctaattaggctaatttcagtttcctaagggaaagaaaagaacagaatcctctagtcctctgatcctccctctgctgcctccttcccacccccatccctaccatctacctcctttgtcgctttctggttggacaatgatgacatctgcaagctggccccagagggtcttgggcgaggatttagactgcaaaagtactgctgtcctttcatgtcttagaagagaatgaccattctggatacctccaaaggaagactgtctcttctacctgtcaacattaagagttgatttagtcgcattcccactgtgtgccaggcactgtgctgggcactccttctccattatcttatggagcccttaccataaccctataaggagatagtcccagtatccccattttatagatgaggaaactgaggatcaggaactaagttgccacggatggatgtgccggaggtgggatgctagctctgatgggatagatgggtcggaaacttgtaccaggtcagctggctgctctttaggctttccgtgccctctgtttatatcttccttgtcttgcttagtttcaggactttcgtagttaatgttatgtcaaagctccaacctgtgtctgttgtgctggggagatccacacgggaggcggaactaacacttataaaccagttactgtgtgccaggcgtactaccccatctggtctttctaatagccatccaaacaggcattattatacccactttacaaatgagaaagctgagcctcagagagctaaagtagtgactgatggccacctagccagatagtgatggaacaagattcagatgtaggtccagggttgctggatgattgtaggtaggtgccagggcggaggcaggaaatgctgggatcatggagacaaacaatggcaacaagaacaacgatgatgctaacaaataccagttacaataccatttagagcctcctgcttctgccgggcagcaactaggcgtttataggcttggttttaaagtggcttgaagtacagaaacaccttggttgcaacaccaccagataccgagagcttgctatgcatcaggcctgtgaccgagagctttagtgctggctcctctgaacaacttaaggaagtgggcactatcatgagctccatttgacaggtgaggtgaagcatctagtcgaaggtcacaggaacaagaaatgggagctgggagttacccccagcttgcttgctccaaacaccgtgtgacagctggaaaggcgtcttctagacccaacactcactcataagaaaagcaagaccagggaggatgaggcatcttgtccagggacagcagcagatggcaaagccaagactagaacccgaccattcaaagctacattccccatcctgggatcctacctaccaccaattcagctgacctagagtttacaggatctttgtgtagtctttgtttgtttgtttgtttgttcgtttgtttttgagacagagtcttgctctgtcacccaggctggagtgcagtggtgtgatcttagctcactgcaatctccacctcccgggttcaagctagtctcctgcctcagcctactgagtacctgggattacaggcgcgcgccaccactcccggctgacttttgtatttttagtagagacgaggtttcaccatgttgatcaggctggtctcgaactcctgaccttgtgatctgcccacctcagcctcccaaagtgctgtgattacaggcatgagccactgcacccagccagtcatttgtttttctttaaggagagacctgggcattttagaggaagggtttggctaggagacctgttcgttaattggctggctcctaagagctcagccctgaggcagataggaaaggcacggaaggggtggctcctgccctcaatttatctacaaagtcccctattgaaggttctgaggggataaaattagaattccgtgttctctgccgaaggccagcgcatgtggctactgtgatgtcctggctgcttgagaacagattgcagggtgggcagaggggctgatttaagaggctttcaaaaaccccacagctccaaagtacctcccaaagtctggctccaaaatgtctgactttccgtcaccggagagtccctcattggtgtccctgggtccccgtcacaccagctgcaccaaatcccgtctagtgtgaaggtgaccaacgggctatttaccgatgagcagcctgagagcccataatttccagagtgaggatgaaggggtcagggcaggctggaaaacagagaggaccagcttcccctcttgacaatctctccatgagcaggcggtgatggacaggctcatgcatcctttatcccaggacagagaaactcagtgcccccaaacagggaatgccagtgctggatgaaatgacaggttgaagctgtagagggttcatgcttctgcctgagctgggacactagccctctcaggagtagcctctccacattcatgtagcaggttcctgaggccagaggccaagtcctggctctgcctcttgttttccacatgaccctgacacctcaccttcccagcctccatttccccatctataaaattagaatcctcccagactgtcatgtgaattatataaagtaagtcagaacttgttgacccctaagaaggactcgtgagctatcccatccacccacccaaccacccacccatccatccatccatccatccatccacccacccacccatccatccattcatctttctctccctttatccatccctctatccatccattcctcatccctccatccacccattcctcatccatccatccatccatctaccccccatccatccgtccctctatccctccctccatctgtccatccatccctccatccatccacccagagcttatttatgagcacctactgtgtgccaggaacactgtggctgccaggagaacagtgaacaagagagaggctcccctgccctctagagtttgcattctagtagggggagactgacaaaaataagtgcataaataagatcatttcagagagtgccaaggactatgaagtaaataaaaaaggactaatgcgatgggatggtgatatttgagctgggacatgtgtcactctataccaaggtcaaagtaggtcggaaactacagggatgaagaaggaagcctaagagcatttctagcttgaatcatgtcatggtcaagctacttaatttttgagcctcagtttccccatctgtaaaatgcagacaaaggtgtctctcccatggagtagtcatgaggattcaatgagataatatatgcaaaatgcttcccacattggcattcgataaatgttagttactagctataattaataaaagtactgctaataaaagacatctcaaaataaccacctgccccaccgaggtcctggaagatcacaggctcctggctgagaaagcaagcactttgacgcctgccctatgggagggattctgtacgagtatttgttgttttggtatttatttgagactccatccttggcactgctgttaccactcagccagagagcctggagatttcaaaaccagctggtggaccctcactctctcccaccctgcatcccccatatccaggtcacccacttttcctatcctaggacagcctggggacaggaaaggatgatgtctatttcctaagtcaaacctcaggaaggtgaggcacccaggtacgtgtcccttcatctagccagggccagtgccaggttgtttctttcttttttttttttttttttttttttgtgtgagatggagtctcactctgttaccaggctggagtgcagtggcacgatctcggctcactgcaacctctgcctcctgtgttcaagcaatcctcctgcctctgcttcccaagtagctgggactacaggtgtgcgccaccacgtccagctaatttttgtatttttagtagagacagggtttcaccgtgttggccaggatagtctcgatctcttgacctcgtgatccgcccacctcagcctcccaaagtgctgggattacaggagtgagccaccgtgcccagcccagtgccaggttatttctacaatacagcatgtgttggtttggcttttgtgtgtgtgtgttttcacttttttattttgaaataattgtagatatacagaagaattgcaatgatagtacagagagtcctgtacacccttcacccagctcccccgatgttaatattttacataaccacagtacaatgatgaaaactaagaaactggataggtggggttttacatttgtattccacacaaagtccagggaggacgcagctcacctcaaatgagtctcagatactttttgtggcctttttgaagccatttcacgaccagttttttatttgtctcacccaagcaattattactggcccctctcttcactccactgacagatgagggaaccaaaacccagagagatacattttccagcaaatagggccagactaagcctggaagccctaactttcaatccccagcctgtgctctccccacatcacaacactccattttcttttttcttttcttttttttgtttgttttgagacagagtctgactctattgcccaagctggagtgcggtggcacgatcttggctcactgcaacctctgccttctgggatcaagcaattctcctgcctcagactttggagtagctgggattacaggcgtccgccaccacacccagctaatttttgcattttcagtagatacagggttttaccatgttggccaggctggtctcaaactcctgacctcaagtgattcacctgcctcagcctcccaaagtgctgggattacacgcgtgagccactgtgcccagccaagacaacactgcattttctagggcgatgggcacttgcctgagaccctacactccccagcaggctgagacatggcatctcagagacacgtagtggcacgtggcagcaaactccttgtcctctctcatctcctggggagaaaaacagcagagaagtccagaaatcaggaccctgagcctcagtttcttcatctgtagaacaggaacaatgccaaaatgcaccagacaggattattgtcagagtcaaataagatattgcatataaagtgtttcgaatagtgcctggcatatgataagcattcagaaaactattattattattattgctattgttattagtgtagttattattaatgattttgggtgtggcatggcatgatgaaccaaaagatgtggtaggcccatcatttcccacctcacttcactcatctgctcattcattcatttattcattcattcattttcacacttacgctctggggctgctgcagcagaagcaagaacccagagagagcaccacccagggccccgcagtcaggtgtggacagtctctcttgcatccccgcctctgactcactttccttgtcatttttttctgcagaattctccactctggtggctgaaagctaagaagcactgactgcccctggtcttccacctctctgccctgaacacccaatctcggcccctcttgccaccctcctgcatttctgttcagttcgtttatgttattttttactcccccatcccctgtggccctctaatgacaccattcttctggaaaatgctggagaagcaataaaggttgtaccagtcagactctgcttgctcaggaagacccaggcctggtcaggcattggctttccagatgcatctgggcaggaggtgggggctggatttcaacagttagaaaagttgtgataggagggaatggaagggaacagtctcttttctgttctaagtactaagcatggaactctacagaggttacccacttactccctaaaaccaccccataaggtaggtgatgaaactcccattctctgaaaaactgagtctcagagaggggatgtgatgtgtctaagcccacaaatacaggatttgctagtgttgggatttgaatgcaggtccgtggatgggtaggtggatggatggatggatggatggatggatggatggatggatggatgggtgggtggatgaatgggtgggtggatgggtgggtggatagatggatagatggatgggtgagtagatgggtgggcagatgggtaaatggatggatgggtgggtgaatggacgatggatgaatgggtggatgggtggggggatggatggatggtggatgaatggatggatggatgggtgggtagatgaatgggtgggtggatgggtgggtggatagatggatagatggatgggtgagtagatgggtgggcagatgggtaaatggatggatgggtgggtgaatggacgatggatgaatgggtggatgggtggggggatggatggatggatggatggatggatggatgggtgggtggatggatggacagacacatagatggatggataccattaagaattttttttacaaatgacagaaccccaactcaagtaacttaagctaagaaggaaggaaacaaaggacttgactggcttatgtgcctgaatagttaagggaaggtcttcaggaacagctggatcaagggactcaagtgatatcatcaggactaagtccctcttttcctctctctgagtactgcttttctttgtgctgaatttgttatcaggagggctctcccttcgtgatggcaagattcccccagcaactcaaggtgaacattcagcattaccagcaaaaaaaaaagaacttcttgttcccagccactctatcagaagtccccagatttagtcccattaatactagtaggtaacatttactgagcacttactctgtgctgagtcctttacaggattccatctgcacaacagcactgtgaaatgcatgctattattacatcccttgtatagatgaggaagctaaggcatgtagaatttaaatgttggccaaaagtcacacagccaccacggggaggatccaggaccccaaccccagcatcacctccagagcctgtgtcccttcctgagtcagacacagaggccaggaggagggatcttgattggagacaggtggagttggtcacccacaaggctcacggcctgagagtgggagaggggtgtccctgtggaaatgaaaagtggggacagatgctgggggtgaacatggccacgtccctacagaagggcttctgctgttccccaagacagccctggggaggttattttagatttccctgggtggagagggggcattggagtgttagtctctctctcaccagaccccatgccctgcacctcccctgctctctgaggtgttgcccttaggcagggctgtcaggaaggctctccctgagggcccagcccggggcagacagcccatcaggacgcaggctgaagggcaggaatgggcaggccctcatccagggtggtagccaggctgagagcaagcaggcccaggcctgggagaggactcaaggccaacactggaaactgggtcaacacagcagcaaaccccaaagggctgccctgccgggggctcagcc

SEQ ID NO: 16746 - DNA, 12241 bp, Human
taggcaatttcctgtccaatcacagatggtcacatgctgctttcctgagttaacctattaactcacccttgtttcccaggcctcagtggagctaggcttgtcacgtcttcacagtgactagattccctcacagtcgagtatatctgccactccttgacttttaaaacatagtctatgttcaccctctaatatgaagagcccctttcactattttctttgtctgtgctggagtcacttcagtggcaagtgttctttggtctctgccgcaccctccctctgatgcctctgagaagaggatttccttttcgtgagaatgtcttcccattcttcttaccctcttgaactcacatgttatgccacttagatgaggaaattgtagttaaataattagaaaggatatgacttatctcaaatcaatccaagatatactgaagtattgtttatgagtaagatatcagtcttgacgcagaaagaaaacaggaatccataaggggaggaaagtgttgaaaagcaaacctgatacagtgggaaaggtgggagacaccataaggtgctgaagtgataaaacaggccagtgtttctccactgtatgttttcaataaatgcttccaaggaaggagagtggggcatgagtaggggagctacagagataaaccaacttttcttaccaggaatgctacagatagcactggtgacaccggtcaccagtacccaagacaatttaatgtggaacataagtacaggaatacacatctttcattacagagccatgtatttattttaatgggcaggagatgctaaataagatcttttgaatggaggaatgcataaatatatgaatgaatgcatacatgaaagaataaataaatgctgcctagcaccaaggagcgaagatagactcatatcaagggaaacaagtatgattaaaaataagaccccagagtcacgctcagtctctttccagccttttcatcatccggtacattcagacaagtttcagggaaggatcctatttgtcccatgataatgatgggcaaggggtggggagttatctcatactccgcctgtggatgaggggtcttctcaggtaaggctcttaaatcctaggcctgagtaaattttttcaaattttattttagacagggtccctctctgttgcctaggctggagtgcagcggcacaatcacagctcaatgcagcctcaacctcccaggcccaagtgatcctcccacctcagcctcttcagtgactaggactacaggtgcatgactccatgcttggctaactttaaaaaatgtttgtttgtttgtttgttttttacagagatggggtctcaccatgttgcccaggctgatcttgaactcctgggctcaagtgattcccctgcctcggcctcctgaaattctgggattataggcttgagccaccatgcctggctctgagtaaagattaagggaagccatggtgctatcgcaatagggtaccaggcagcttaacaaaggcagaagggaacctcagagaaccccgaagagccaccgtaaagtgagtgctgggggagctgaacttcagtcagtacaggtgccgaacagccatcaggtgcgcagtgttagtaattccaccctctgccctgggagcaaggtgtgtggagaaacctgtagcactttatgaccatcagaaccagtctttttcaaaaagaccatggagtactctttgacctgtgtatataacaagaacctttctcaaataggaaagaaatgaattggagaaaaccactgtttacatggcagagtgtgtctccttcgcacacatcttgtttgaagttaatcatgacattgcaacaccaagtgattccaaataatctgctaggagtcaccatttctaatgattgcctagtctattcatagctaatcaagaggatgttataaagcatgagtcagacagcctctggctttctggaagggcaaggactctatatatacagagggagcttcctagctgggatattggagcagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccaggtaaatgctgcattgcatgtgacaataatgtaaatttttagtttgtatttttctgcagtaatgtaatagagttttttaaggataggtttcttataaagagatttttttttttttgctagaaacagcaccctccacccaaaatgtatctagccatgcatacgctctctttttccagttggaggtgagagtgaactaaaggaacaacatccaaacttgtctccacaaattgtagacttgtaacagtatgcaaatcttgctctacaaaaattgctctactatgaagttcttacttcacaataactaatagtagggacatttctactctgaaatttcatttctcaccaaaaataaggataaaagcaactgcgaaatctaaacacaaggtttaaaagcagttctctgttttggctaaaacttaatgccatcaatttttagaataatgagaaagatttcccatgcagtgtttcgataattttcttttgtcagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggtaggcagactgagggccagagtgagagagctatttcccatgacagtggtaagaagtcatgtccaatgtgtctctattttgtttcattctaaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggaggtaagttcttcttatagcaccttaacctcaccttgcccctagatctcgtagctttgcaactggaattgattgtttaagatgaatgttgattttatgggctcgaagagggaaactgcatcacagttgatggaagtctgttggcctcttaacaaagctaatgcttgcccttctggcttagcttacataagaaccacaaggaatctttgttgaattgtttctttcagatcatcgggacaactctccttttgatggacctggaggaaatcttgctcatgcttttcaaccaggcccaggtattggaggggatgctcattttgatgaagatgaaaggtggaccaacaatttcagaggtaagccaatcaaatttgcctctctcaattctcccaccccttcatgtttcattgtaatattggttgatttagttgaaagaatgcattcatagaagtatatatttttctattaccactcagaaaattagtgatacacttagaaaagtgaaagagcggtcttttctgctagctaacaacatcttagcagtgacaactaggccactctaaaatttttattaagaaaattgttgaaaactttgatgttttaattgtgggcatcaacattgaaactttttcattagaagaaaacagtgaaatttaacagcggtcataaacttatgtggaaattaaagaaaaggaaggctttttgtgttttccaaaatttccagcagtcaacatttatcagttttgtaaataagaaaaatattaaatattaggctgggcgcagtggctcatgcctgtaatcccagcactttgggaggccaaggcaggcagatcacaacgtcaggagtttgacaccagcctgaccaatatggtgaaaccctgtctcttctaaaaatataaaaattagacaggcatggtggcacacgtctgtaatctcagctactcaggaggctgaggcaggagaaccgcctgaacccaggaggcagaggttgcagtgagccaagatcatgccactgccctccagcctgggtgacagagcaagactccgtctcaagaaagaaaaaaagaaaaagaaaaatattaaatgttaatagaacattttgcttctgtgtgaaatagtacgtgtcatttaatcattgataatattgattaatctgtggtgcgctttcagtcagctgagtttgtcttttaattgtatcaatgtaatcatagagtttaggtttcaacatgtctcttcgttattaataaatgcatgccttctgccttcggaaaaaagatatacatgcatatatttcaaaagtcactgataaaatagtaacatgagtccttgtagttgtaaattatttattagttaaatgcctcaaaactgaatacctttcaaataattacaaattgatttattggcctttttagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggtgagtatggggaaaaacattacggacaagggcctggtggtctttatatgtatttcaaataaaacagccattagcgatatccttgaagaagctgtcttcattgtttatgtagttttctaatactaggcaaaactaactccaggtattttattttccttaggacgttcccaaaatcctgtccagcccatcggcccacaaaccccaaaagcgtgtgacagtaagctaacctttgatgctataactacgattcggggagaagtgatgttctttaaagacaggtaagatgtcagttcttctttgtgatctgcatttgtaataataacaacattcaccactatgattaactattatgcttcacatgttacttatttcatgctgatttacatctataatcacatggtagcaaccacatgcatttgtgcaacataatgtacttgtaacaactttgtttttctacatgtattaggtcaactgattctcagaaaatatagttgatttagaaaatcagtatgtatgatctttttttacagattagcaaagtaagtcagagagaaggaaagagatcttttgggggcatagagctcattggtagcagagcagttattggtcttctgttccctatttcaggtctcttttcattatgccactctttatggtgataagtatcattggactttcttaggagaaagtggtcctttccatagcaacatctcactgatgagggttgcatagccatcctttaattatctcccctgccatcctggaaaaatggccctcccaaagcctattaacttgaagggtctctgttgccccctggaggcccagagaagaagagaagagagggcaccaatgctgggaaagtccccaagaactgatgaaatccctcctgggacagataggggcagccacaacgtggtgcttccctcttcaaagaagaatcctagaactccctctgcagcatgtggactcaaaaagttggggtcatctcacatgcaaggaggaggcctgctctctgtaccatagtgattcctaaaggatcaggcaaaataataacacactcttttggtgtgttattgcacaccgcatttggtgaatgatgcagtccacagaaagatcaacacatagaaattcagggtggcctgaaaggctcattctctgcagcctctcaagtgctgtggcactgttttactactctgtagtcgcatctctcctagaattcagggcactggctcataattctttctgccctctctttactttttaagtgtaaaagataaggctggaggtaaactatacagggtgtggttcaatgctgggacaagttaagaaaacacatggttttaaaggaaacctctcagtacaacaggacacacctatcaaaccaaatattactagatggaacaggaccaatttgaggatttgccagaattgaaaggacacagagatcatttaaatgtcgccatgtcgaggagacatgaaaggctagagatagagatagtaactgatttgcctaaggcatcacagccaggcagaggaaggactggacctagaagtcaggtttccgacagccaaggccgtaggcttccctgtggcctggaatctggagctcttctgtgtcagcccacataacagtctatgctgtgctgttaccctagtccctattaagctctataatccactttgtgtaaatactactaaccaagggacaacaaagggattggctgccagagcggagtttaaaaatcaaccttagcctcttaccagctgggtggccttagacacctcccttagtctccccaacctcaatttctcatcctcaaatactctcttgtagtgtccttgtgataaggtctgatgtaaggaatgggcctggtgtgttgtaagtaatcactaaataataggatattagagtcatggtccagttggtaatgtgcacagccgatccctaatggctcaccaaagctgactgttaaattttgaagaattttgcaagctagctgtgaaccatagccattattaaaaattaaattataggccaggtgcagtggctcacacttgtaatcgcagcactttgggaggcggaggcgggggaatcatttgagatcaggagttcaagaccagcctggccaatatggtgaaaccctgtctctactaaaagtacaaaaattagctgggcgtgttggcctgtacctgtaatcccagctactcaggaggctgaggcaggagaatccttgaatctgggaggcagaggttgctctgagccaagattgtaccactacactccagcctgggtgagagagtgagactctgtctcaaaaaagtaaataaataaaaaagagataaaacttaaattatataaacaaaattaaattacattaaaataaaaggtaataaaaataataaaaattcatcagtttgtcataatttttactgcatttttctacttatttatgttcttaaagttacttatgcctattttatttgtatgctatacaatggtgctccactgagactcttgaaattcatcataatgggagtatttcaagctagtgaaatcagcaaatgctataaaccaacccttctttggagagctgaatgttatacatttaccagcacaccactagtgccagcaacaagaaggagctggagctggatatctgccagagattaccagaaattagatggaaacttttcttgctttttttctaatcagattctacatgcgcacaaatcccttctacccggaagttgagctcaatttcatttctgttttctggccacaactgccaaatgggcttgaagctgcttacgaatttgccgacagagatgaagtccggtttttcaaaggtaatctttctaattatttttcactgctttaataaatcaatttttcattccctttggggctgagatataaggttactagctacattctctccagggacttttgaaaatctcagtctcaccaaccaaatcaatgaaagtccatcaacttaactaaacggtgcgtagcgcattttggagtcattttaaacaaaaggcaaatgactggagatagaacgttctggcctttttaatgaatctagatttacaaaaatattttctgcacaaactatgtatttaaaaccccctccatattcctgggagtactcaaagtaaaactcgagacactatgccacgcaccaatatttttgcaaacgtgtgtttaacgtagtacaatgagtaagacatttgactcagccatacactcaaggcaaagaattaaatgcaggtcagatgggccaaacgctttgaaacaggatttttagcctttaaattatgaaattaaatggatgttagagacagaaagtttcaaattcctttttcatgaggggtaaatagcacgtgtgtacagtaacagaaatcttggctttagtatatgagaccagctttatgtgatgaggggcttactgagtataaacacggaatctggacacagcattaattcaagtatttggaactatcttctagtcaaatgcagtgatttgaatccaggattgcaaacccttacaggttatgagtcactacagcacttcaccctttatgatacaaatggtttgaacttccacagtccatgagcaaacctggagaaccgaagtttatatcaccaaggtggcataactaactctttagtcatttgaacatctgactgtggaaagaagcccccaactccataaacaagtcattctcaaagcttgctgcagattagaatcaactaagaagcttccaaagatagacacatttaattggtctgggatagggtcctggcatcagtattttcaaaaatctccctagatgattctaatctgcagccagggtactgcactagcatgtgaaactaagaacttagctgaaaattcacttactgcctattgaagtcttaggcaagtgttttatcactctttcttgattggcagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtaagtttaagtgcagagaatgttagggcctcagttctttctacataaaaagttctagaatagcccatttcaaagtgagtctcaaactgccttggccggcatcctttccttcagatggctggtgccaatctatcatctatttagtctattgaccaataatcatcacacaatgcctgcactgggaatccagagaatgtagggggatgaattttaaaaggatgtagaattgaggacattcatcttaacggagctactttggccaaaagttacttatcttccatagtatgttacctcgataggacatagcgtagaacctactggagaattcgatgctggatttcagaggggccttaaaggccttttagttcacccaacattccaccttatcccatccactccccatttcacaaatgatctataaaatgaaatattctggttaaattcctcattgtgtattttctgtaatgattttcagagtgcacatgtttagcaaaaggtctgacactcttaactcttttctgaccaggtatgatgaatataaacgatctatggatccaggttatcccaaaatgatagcacatgactttcctggaattggccacaaagttgatgcagttttcatgaaagatggtaagtgaatatacatgtatttcctccatttcattgccgtagcaataacatcattattgttagttggaacagcaaatgccaaaaatatctgtgctcacagatgaattggtttctcaagaattcaagttaaacctagaaactacttgtataatgtagtaagtctcttttgttttgtttctaggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgttttatacactttctatatttattattgttactttctgatgacaacgccacccttacagagactgcttttcaaatttgaaatgggaagtagacaatataaaaaatgttcatgtgggaaatgaggatatacaaaaaactcaactattctctattcacatggaatttataccatataaactggggtgggggaggggaatccatttcccttgccccatttatggattccaaaagtggttttaggtaaaatcagtgacatcatggtagagcgttctaggtgtatgtcattttgtctcttctgaacatatgggagggttccattttcccacagtccaactccttgcagagttgggtggtgggcagtggggcatctgactacttctagccagagggttgagtgaagaagtgacaaatatcattttcagactggaacatttaattgctggtggaaatttctctagtagtctactccttctgtcctgtggtagaagtacatcatgagagagttgccacaagacagaacaagctgaattgctggaggtaaatgctccaaatagttacacaaacctcagtagactttgcttaagcaggaaatcaaattttaggctggccatggtggctcacacctataatcctagcattttgggtggctgagacaggaggattgcttgagactaggagtttgagaccagcctgggcaacatagtaaggctctacgtctacaaaaaaaaatttaaaaatagctgagtatagtggtacacacctgtattcccagctactctgagggctgagatgggaggatcacttgagcccaggagttggaggcttcagtgagtcataatcgcaccactttattagttcgttctcacattgctataaagaattacctctgactggataatttataaagaaaagaggtttaattggctcacggtttcaccggctgtacagggagcatggctggaaagacctcaggaaacttataatcatgacagaaggtgaaagagaagccggcatgtcctacgtggctggagcaagaggaagagagagagcaggtggaagtgctacacactttcaaacaaccagatcttgtgagaactcactcactatcacaagaacagcaaaggggaaatccactcacatgattcagttacctcccaccagatccctcctccaacgctgaggaattacaattccacacaagatttgcctcgggacacagagccaaaccatatcaccgctgcgctccagcctgggttacagaatgagattcttgtctctaaacatatatacaacttttatttcctaagccactaagattttctatttgattaatgctgcataatatagtttgtcaagataatcactagtttatcatgactaatttgggaggaaagtttatgtaggcaggagtcttgcaagtagctttacacaggcagaagcaagctctacacaggcagaagtagtacctccctcttgccagaggagcacaaactatgcttgcatggagaattgataaagacctcatttgagacaaaaacctcacaagatagtgcttgccctcatcccagattgatcttccctctgctcattattttcaggcaaatgactaagatcaggtctcagcatagttcagatcctagctatggtaggaaatataggttactaaccaaaagaattataggacctgggcattaagtatcatcagaaatcaaggaaacacatatgggagtaaatctgaaaggcatcagattaagttgggggatgtaaggctgaagagagaagaatttattgacatcgatacacacattcttgacttgggaatcaatttcctagaaaggaaaccaggagcttgtctaatactctgctgacatggattctcaaatcttggacacaatgatgtcctgtggcatatgaggtggagatgccagaatttctgtggcatgattttgaggaagaagtcagaaggcacagagagatttgaaccttaaaatgaatctattacatg

SEQ ID NO: 16747 - DNA, 16207 bp, Human
gattattttcctgttcttactctccaacaacaaggtaaatatctggggacagagagaatgactcaagcatctttgaactgactttgactttgcagcctggtttaatggaagcagaaaggctttggaaacagacttggcctcaaacctcagctatgccacctactagttgtgtggctttggataagttaagttcagtttcctcatccataaatgactactgtgaggattaaataagatggtgcatgaaactgctggcagctgttaaagcctctccataaattttagttctgtttcctttataatacatagatcagggtttctcaacatttattactattcctgataaagaggctttgtagacactttaaagatttccccccatacaaatttaatagcagacataaattgtatatctgctcatgtgctgtatgcatatctgtcttttatacacaaaaatatatatttttgcctttgatgaccaatttttcacccagttgggggtgatatcgcccccattgagaaaggacatcttaatggagtagcctgtaatctacaccacaagatcagtaagtgacccatgacaccagtgtcacctggtctgatgtggcatctcaccagaggattgataacaattttctggaaaacatttataaagccaagtgatctggatttagagatactatttagatcacagaaggcaagtctgttaaactttgtgtcattaaaaagtgacattctcacagcagaataaccagctgtatttgtaggttagatagacacagagaaaacaaatcaatggctagagagaggagaacagatcagcaagaatctgcatagttctctgcaagagtgaggcaagataatttttaaattggaaaattatttttttctatatttttctccttttctttaagcctcactcaagcagccagcagactgtttcccaggccactgaggtgggtaagagcaatggctaaatcttaacacactcttacgtgcaccctaccgcaccatccagaccgtccccatacaatcaggaggcagcgaacttatggtgtgatttgaaggggtgttgagtagaatctatcctcacaccgcagcaccactgcttgcaattctacctttggaattttattccctgacttgtaaaagtttttagtgcttaaatattctctattgagtaagagacagattctgtgcaatgggacaattaggtcaagagggaaagaagctgaggtgataggcagatagattccagaggcaaacttttcccatctgctaaagttgaaaagagttaacccacatcctaccaacgctagacaatctaggatgtagggaaagtttgtctctggaatctatccaggtacccagttgggactgagcttcagcttagatgtctgaagatgttaagttatagaatcaggatctgagccggtacaacacgtggaataaacaatgaagtcgatgttacaaatttttttttgctacatgtaaaatctctgtatcacatttctctagggagctggattccgtttagaaagcactcatttactccaggaaaaggattttatttaatctttcaacatttactttaaaaacttttttttatctataatgaatataaggaaagtattataatgaaaatcaagaatatcaggctttaagaaaatatattttaagttctccttctcttttagttgcttgatatttcttttacaagggcttattttgtaggataggtggacgtagaggcttatttatcattttgaaggtacatactctgaattgcttgagtgatggactagatgctaattgatccattgtcgtctgaataaagtcatgcttttgtttgcatgtttttgagatagatcaagggatgatatcaactatgagtcactcataggattcatattcacagaacccggactaagggctatataaagaggaacagttcaggaacttaggctagaaaggaacacagtaaactgaattgatccgtttagaagtttacaatgaagtttcttctaatactgctcctgcaggccactgcttctggagctcttcccctgaacagctctacaagcctggaaaaaaataatgtgctatttggtgaagtaagtatggacactacagtatttatcgagcttgatgtttgtctttaagatttaattgcattaaccagtttgtttgtttgtttgtttgtttgtttgcttttacgtatcagctgaaaattggtctaggaggctgtctgctttcagtattaagttttactttgtcaaagaggaatataaaaaagaggtattggttttgaaggactgttatgaaattggcaagtgaacttgtttcttcttctaaaaacctttggccaagaaatttccattcaatataattggagttcacttctgttatggtattttacactaatcattaaatgccagttaataatctgagatctgaacaatggcaggattaatataaccacttcaggctgccatgataatttaagcatattccctttaccctcagtcatctcagttatatctttacagcttttctttttcttttttatggagatggggttccactatgttgcccaggctcgtctgtaacttctgggctcaagcaatcccccgcctcagcctcccaaagtgataggattacaggcgggagccaccatgccaggccccatctttatagcattctttatggatttttttcaattcttaaattcttttccttaattaaaagagtttggtctccctattttctaagatgattttaacattgaatttatcatagttatccattttgtttagctttgagtttttaagcaagaaatttgtgtcccaacttatattaataacattaataattcatgtatccttttgttttcttttctttttcttttttttttttttttttgagacagggttttactctgacacccaggctacagtgcagtggcaccatcttagctcactgcaacctccgtctcctgggttcaggtgatcctactgactcatcttcccaagtagctgggactacaggcatgtgccaccactcctggctaatttttgtatttttagtagagacagggtttcaccctgttgcccaggctggtctcaaactctggggctcaagcaatccttccaccctggcctctcaaagtgctgggattaccggtatgcaccactgtggccagcctgggtgaccaagagaaactcctctgtcttaaaaatgaataaatgacgttttaaaaaagatacttccactgggattccgggaataaatctagctaatagtttatgacatgtctttgtttttttgtttgtttttgtttttcttttttttgagacagggtctgtgtctgtcatccaggctggagtgcagtggtacaatcacggctcactgcagcttctacctcccaagctcaagtgatcctctcacctcagcctcctgagtagctgggactacaggcatgcaccaacgctctgggataatttttgtgttttttgtacagaggaggtttcgccatgttgtccaggctagtcttgaactcctgggctcaagaaatcctcctgcctcagcctcccgaaatgctgggattacaggcctgagctactgctcctggctgacatgtctttgatagcacaaaaaattaaggttttttttcctgattataattaattgtccaaaaaacaataatctaacctgtgagtaagatgtgcaaaattcctggtccaaaagcatcagtgtgcaattgagtcatatatgtggagctcccaacagaaattttctgtgtgtacttacacattgctgaatgtatttttttttccagagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatgtccatcatttcagggaaatgccaggggggcccgtatggaggaaacattatatcacctacaggtaacgttggtgtatgtcgccctgtatttttctactttcccataggtctgacttctaacctgaaccagttagacagccctaaatctggaagtagataaagtaacctccctccattgttaatgctatctctgctaaaattcattttctctagaaggaagaattgttcactcaggggagaattgtttggcttgccagtccaaagcagattttaaaagctgcaaataggccaggcacggtggctcacgcctgtaatcccagcactttgggaggccaaggtgggtggatcacgaggtcaggagatggagaccatcctggccaacatggtgaaacctcgtctttactaaacacacaaaaaaattagctgggcgtggtggcgcgcacctgtagtcccagctactcaggaggctgaggcaggagaatggcgtgaacccaggaggcggagcttgcagtgagccgagatcgtgccactgcactccagcctaagtaacaaagtgagactccatctcaaaaaaaaagaaaaaaaaatctgcaaataaaaggagaatgaagctaaatttactataaataagataatttactataaagaagagacagggaagtttatagagtagtcaagatggataaatgcagaacctgggagcaggagcaaaaagcataaccttctatgaaagcaaatccttcacagtgatgatctgtgagttttaaataggaagaaattaagttagattttggttaaggaggaggctgtccaagaaaaaatgtttctgtagttaatgaagcaagttttaaaatctggactcttgatttatgaaatgatccattttccaattgtgctagcaaaaatgaagtattgtggtaagacaaaataacactgccttccatacatttttctctctctttttgctgataaagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggaggtagggaacttgtatttcatctttgtcatttggcatgatctataggatgtatagaaggactaattttctttccttttccaaaagctcatggagacttccatgcttttgatggcaaaggtggaatcctagcccatgcttttggacctggatctggcattggaggggatgcacatttcgatgaggacgaattctggactacacattcaggaggtgggcaaaacaaacaaacaaacaaacaaaaaactaagcaaacaggaaaggaaaacaacaaaaaccctaacaaattcaaaattctggtttcgagagactacattctgacaaatgattatatgatggaaaatcttgttctgattataattttgcctctaaatcaaatttaacacttcgtatgggtctcaattttactctctgtaaattgaggatattaaactagatcatcttgaagatcagctctaacaatctatgaggatgctatgaactatgagctagttcattagcataagctcagaggaaccttaagaagcataatatgaaaaggtaaaagctgttaattaggtggtaagtttttttttttgagacaaggtcttgctctgtcacttaggctggcatcacgtatcatgatgctaacttactacagcccggaactcctgtgctcaagcaaacctcccacttcaacctccctagtagctaggaccacaggtgtgcgctacccacccggctaattttttaattttttatagggacaggatcttgctatgttgcctcgagatcctcctgtcccagcctcccaaagtgttaagattgcaggcagcctaggtgataagtttttgacctagtgaaatccataagctcaaaagcaaacacatactaattctgtgtgtgccaacaattagaggataagatggtcatctgtatgattcataatatgctgacaatttcttagattcatagtgagcaagaaagaaaaagttacagagaatctaagcatccctatagagaaacacaagattatacagccatgtactttcatgtggtcttgggataaaaatttcagaatgcccaactgaacatttaataccttgggggcatttacataaggactgtaacttaccatcctcctcagatagttgacatggggttaattaaactcccctgttatttagaggaatcactagcatgggaaaaccctaaccatcatgacagaagccttcttaatttttctattggaaattttagattctatgactccctcatgtggaaagtaaatgaggagaaagtcatcaataatattctctactcagcatcctcctctctagctgatattgcacaagttggatggcaatacttttataaatactatgtccaccagaaagactatttgttttagtctaacacatagcctaaggcttataaagtttttgaagagaagaggacttttgtattgtcaaaagacagatcatgtaggattaggtagttgctaaactgcaaatcctcagccagacatgttatatgtgcctaaattttatccaaggttatttgggggattgtaattccttcatctaaaatgggatatgtgtgctagttagcctcaaaaaaatgttttggaattctaatagaccttagaagagtaatttaatacagctttctgtaggtagaggaaattaagacaaagagaaggttagtggctagtttgtggaaaagctgggccagaatatgcattcctacctctcaacccagtattttctatctgtccatattgccttattttttaattggattgattcaatgctttcaaaaagtgaagttatttatgacaattataacttaaaatgcttattttcagccgtttttgttgttgttgttgttgctgttatttgctttttttgagatggagtcttgctctgttgcccaggctggagtgcagtggtgcaatctcagctcactgcaaccttcgcctccagggttcaagcaattctcctacttcagcctcctgactaactgggattatattacaggtgctggccaccacgccctgctaattttttttttttttttggcagagacggggtttcaccatgttggccaggctgctctcgaactcctgacctcaggtgatccgcctgccttggtctcccaaagtgctgggattataggtgtgagtcaccgcatccagcctcagcctgttttcttttacccagtaaatcaaataaacaaataggtcaatgtttgctgacctattctattatggtattgggtgatgaggttacttgagtacagagatgaaaagtacacaattcaacccctgagcacgcaatctagtgagaaacagaatacaaacataaacccattatttccagatgaggatcagtggtggtggctcataggcatattataggaattgagaatagttcaggtttaggataaattgtaaaaactttgcttactcttcccagtcttgctgggaaggttactggacccatgatacagaaaattcttgatttgtgtctagacactccccgagagaggtgtagactctttgcacttgggtatgggagagtattccaaggccaggctctgcagctaagtgacgtgtgactctgggcaagtcagttcttctgaactacaattttgtcatagaaaaagacaaaaatgaaggcattggactaggggacaagaatgttagtcaggaattttcaaatattctgcaaattgagcaatttgagagaagggacatacccctctctcttctcttacctacaaaggtgcattctctaggacataacacaaaaatgaacaaggatttcttatgggactcaaaagaaaagccagatataaagccagactattttaatcatagataaaaatggtgaagtctgaatggggctcaaaaaaaagacagaaaacactgtaacttggtagtccaaatatgtctaaattataagtatagactcttttaagaattatttattttttctcttttttgttttttatattctttccttgagtcatatagactctttaattttatttagaatcatgtgtagtaaaagcagaaacattaatcttggctcaagcacttaatttgatttaatcttataaatactgtttcctcatctgtaatggagagcacagtggcttcctttcatttgtatgagaattagacataatgtgttacatttctcagtgactcacagtacctgaaacttaatgatagccttatatttgggcttacgaaaagacgattgctaaagacatttttttctatatctagtaaagcttcatgaagactaaaaatagaattgagtcatgagagttgagaattatttagaagcaatgaaaactgttgaacgcagctgtgagttattctaggaatttttacaacagaatatatttcatttgtctactagtacagaggtccctaaccctaggcaattttgtccccaaggagatatctgacaatgtctggagacattttttggttgtcaaaactaaaaaggatttgctacttgcatttaggggtaaaacctgagatttctaaacaactataatgcacagaacagcccagactactgaactgtaatgtcagaagtgctgagattgagaaacccaactcaaaagggtaaagaaataagtaaaagattctcaaatctttctttttcactgtgtcagatattgtgttcttgtccaagatgataatgcatttcacagctgtcttttggttggtttcttcttaggcacaaacttgttcctcactgctgttcacgagattggccattccttaggtcttggccattctagtgatccaaaggccgtaatgttccccacctacaaatatgttgacatcaacacatttcgcctctctgctgatgacatacgtggcattcagtccctgtatggtgagttgaattctttatcattttgccatataaagatactcgcttttatgaatagtctaacaatatctatatttggataaaacgttaatatctgtctttttttaagccgcataagaaccctgtgtggcaggtgacacaggtattatcttcattatacagatgaggacaagagacctagtatgttaacgtcagagccagaggcagaaccagaggcctcaagtctggtgttctttctatccaagataccattgccttactgatgaaggcccacacattaaacaatctattataactggaaaaggaaagtaaagataatcagattttcttcctccatgatattgcaaccatgtggaaaaaaaaccttactttatacttcctgtgaatgttatagaaagcttaaaatgattttgatgcaatgttcattaagaaaattgagtatttaaaacataactgttcctcctctgaactacaatgcagattttgtttactaatgcttctcgaaatgtattttcaggagacccaaaagagaaccaacgcttgccaaatcctgacaattcagaaccagctctctgtgaccccaatttgagttttgatgctgtcactaccgtgggaaataagatctttttcttcaaagacaggtaggatcattttcatatctaaccaatattaaagtttctgcctttaaattttttttgtcagaaaacagtggaaaataattgaaaatgaagtagatgaaacttgtaagcaggaacttggactcgattctgtaggcagtgaggagatcttaaaggttttgaagcaggagacaggtgtaattacatttgtgttttaactagaaaactggtgtgtaaaaaacgatttgcagtaggaatctgggatggggatttagaagataagaaacagaagccagactattttaatcatagataaaaatggtgaagtctgaaaccaagactgtaaaacagtacctatgcaagagacttgatttcctggttatggaggagagaattccaggataacttatggtttctttcttagaacacagactgaagcagatgttggtggtaaggaggggcagttgggaagactaacatttgtcaagtaggacaaatatttcccatttttgagattataagactgatacacttgaggatagtgacttccttgaggttacaaaactggtgagtgaattgtagggtcgaaccagaagcttagatccctggattccaagctccagggtatttctgtataccagattgcttgttaaagtcattgttattatcaaagagttgattgatatccttttcttgtggatccatgaacatcagacatccatggaacagaatgtgaagacaatggaaagaaatattgggtcttttcacagttccctcccattcacatgccatggttcttgagtctacattgtcttttaacatgtgtcaaatgtctttcatgtcaggttcttctggctgaaggtttctgagagaccaaagaccagtgttaatttaatttcttccttatggccaaccttgccatctggcattgaagctgcttatgaaattgaagccagaaatcaagtttttctttttaaaggtaattctaatctttagttttgccattgagtttacttcaaggaagagaataaattgagaagagactactactttttaatagatatagaccaagaaagcactcttgattttattaatagtggctcgctctgaagtgtaaactaaaatagcctaaatacctaagtaatatatacaacttctgggaaaagtttgtaaactacaaaatagtaatacttgtgaaaaaaaaccatgggaaccatagaaaagagactatgtttaagatcaataagcaataaatattataactgttggaaaggaattatgttgtttatagtaaatcaatattttcttattactcttcctgtataattcaaatttaccctatttctttgtcttcacagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtgagttttaatggttggtcattcgacccctcagattgtgaaacagatatggaatgaggctttctagaaggcacattttctgcgcaaattcccaaagctccttgaccttccagggagagagattaagagaatataggactgaaatagttattgtcaacttagttctttgtgtttttggtttctgatatatgaaatagtagataatgtgtgtttttttttaaaaaaacactctaaataaaatgtcatcttattaatcatagtggaaacacattggaaaatagtgtcatagatgtacaagaccaagtatttaatctacagtcagtttcgagggttatggatttccagattcctttctgtaatcactggattcaaaagacaaaatgagacaaccatcctctaaatgacaggaggtcaggaggtcctgcaagatcttccttaaaagaaagtcatatggtcaagtgaggataggagctcatttgagtgtctgtctctgttgtctcaattgtctacattttgaaggaggagaggattctgtattccttcttctgagtaagccagtcatttcctagattgcttgcctggttgacatgagacataacatatatgttaagcttacatttacaactgttatttattcttaagcatttaaaacacaatatctaattccaattgaataccggatgcttatgacttgaatttgtccaccagcccttagctctgtttgagaaacaaaacttgattttagcaaataacactttccaaagagctcacaaatgggtgtagtttgctgtagcctgttattatgaacattggcatttcaactctgaacagtgtttctgtttagttttccactcctacttggcccaggatttttccctgaaaggccattgagagagtgctaagcaagccataaatacttagagaaccaaattgataaacacaagataacagttagattcagttgccacttggaagtctagagagacacaaagctcttttcacttgctggtaaaagagaatttaagagagaaaccaggatatgaccatacagcctggaaacaaaagtgtttattttcaatttctctcaaacgtgtgtataaaaccctttggttccctggctcttagccccttgacctgtttattatcttcttgggggaaatgggtatttttgtctcagtgaatagctttgaaaagaaggcaatgacaggcaactgaagaatcggtcactggggcctatgctgttgccaaatcaccttctatgccagactctataaagcaggaccaagcactagaggaagtattatgggatagtgggaaaaagacttaaccagagtcaggaagcataggtttgagtcctatagggactcagaggaaatcagtgaactgtttaggtccttggttttcttcatcagagcaacttaagtcctttggggaagagctcttcagtagagaaggtgggtttgtggtgcatgtcaggaaagccactttctgattgagttcctgctggttacttctttgctcaggtatgatgaaaggagacagatgatggaccctggttatcccaaactgattaccaagaacttccaaggaatcgggcctaaaattgatgcagtcttctactctaaaaacagtaagtagatgaggaaaccatgaagatactggaaataacatttcaaagctataaatcctctaagattagagaatagggctccaaattggaaagggacaggtttctgcagttccccatagggccgcaaggaaaaactcacactgtacgtggctctgaataggagagttagaatgagcaggggctggtggcacaagtggtatattcccagggttgtctagcaggcagagggaatgtgattgttcctatttctcatgtacctgagtctctggaatttccttttaccacatcagccacacagtatgtgcaagcgagcacatggcagccaagactcaggcagtctggagtctcaccctttcctacaccttgcactcttgacctttcctatagtcccttctgccctgataggccctcatggactggggactgcgggtgggttaagaaaagcttgagtttgtatcgtatgtcttcaaacaagaccagcctaagcaactgttcatggggtcaagattttttgtttgtattccctcccctccccagtgttgtttcctccatcaaagcccctgtgtgccctagctgggtccaatatcctgtttcatgagtcctccacttggagtatgactggctgttggtagacgttttgggggtatgataccaagggccctcaacttttatgtcctcaaatcacatctcatcttattttttatttgttattttttgatgaaaaaatagagatgaggtcttgtgatgatggccaggctgatctcaaactcctggcctcaagcagtcttcccatctcagcctctcaaagtgtgtagttaagggcatgaaccacagcccataggtcatctattctagataatctatgagaagagatttgtgttgttgttgttgttgtaaagaaatacagggagggaattaaactatttaatttgttttcattttcagaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaaggccaagagaattctatttgaagcatgctctgtaagttgcttcctaacatccttggactgagaaattatacttacttctggcataactaaaattaagtatatatattttggctcaaataaaattgaaaaaaaaatcatttggtttttaatatatttttcttgagaaacagaatgtgtattttgaaaataactctgaacctactcctaaataaaaacaagtctctctgactatatcaagagatgaatagaaatatggcaagtagaaataaaagcttagatttcttttggtcacttgggtaacaccacttgtgtccttggtctcaaggcaagaaaacatcctctaggctacacacaaccccaaggagtgcttacagagtacagccacaagactggagagaagggatgaaatgggaatttcccgttctggtaaaatccacagtcaagtctcacagtgtaattgctgtgtgaccttaacaagcaattaaatctaagcttccttaaatttaggaggaaataaacttaggaggtacccacctcataggtttattgtgaaaaaccacacaatgcatggtaagcacatcattctggcagtgtggcctgtcctgtgtccattttctccactaccctgacacatagttcccctatcttctgggttgcatacattgtagagctctcacttatagcttacgggtttgtggaatgcttttagttttcaatttattagtaaatcattgctgattgatgtacttaagtttgcagaaatggccaagtccatttcaagctggatgatcatttctggctagtgaaatgaactgaactcaggggaaatatgaggctcagaaagtacctagagggagatagagctctttgtccttcatgtctcagatcttttttcttttttttttgaaacggagtctcactctgccgcccaggctggagtgcagtggcacaatctcggctcactgcaaccaccgcctcctgggttcaagagattctcccaactcagcctccagattagctgggattacacgtgccagccaccacgcccagctaatttttgtatttttagtagagacgggggtcttaccatgttggccatgctggtcttgaacttctgacctcaagtgatacccccaacctaggcctcccaaagtgctgggattacaggcatgagctgctgtgctcagatccattcttaactcaagtatgtgctccttcagtattattagagttgtctttgcaaagagtagaatcgattcaccactataagaaatgttattccccacaggttactaaatgctggatttccctcaaaagaagaaaattccctccagaatcagcatcaaaaaaaattgaatggtatctgcatgaattgtctttggccttaggtaactcaggagggaggcgtttctcttaaatgacaactgaataggaataaaagtccagagtcgctatcatgagtgttcataaagatgcctcaaagacttaaatgtgaacctttcttccttttcttctatccgtggtgtactttcaaattttgttaaacaaatccttataatgttaaccatgtgccaggcactgttccaaggctgtatatacacaaaatataaaatgaaaataactcatttaatcctgattacaaacatgaggtaagtaccgtcattctcatttttcagatgagataactaaagcatcaagagtttttaccttgctgtaggtcaggtagccttggagcttgatgcacggtcaggcagcctgacaccagaatctatgctattaactaccacaagattgtgccttttagatttataaagtggaaaaagttaaagctaaaacttctggcatttcactctataaagttttgcatttttacttttcaattaaaagtcttcaaaatgtcttaagagttgcatgtatgtcccgtctggggaatatcactttttctctgggaaatggaggagtattatttcattgatgtaaggaaagaaaatgttcaagacttggaaattacaggtgtctttacaactaagggctgcacattgtgtagctaatattctggagtaactgattttatgagggtatgcatctttgactttttattgggtagactagtttataaatctgta

SEQ ID NO: 16748 - DNA, 14115 bp, Human
ctattatcaagaattatgtactgtacacaattgcatgtgctagactttcgtatggcagcacagtaggtttgtttacaccagcatcatcacaaacacatgggtaatgtattgtactatgacattatgttggctacaatgacaatagctgatgggtgcttatcagctctgtattagtttgttcttgcattgctatcaaaaatacctgagactgggtaacttataaagaaaagagatttaattggttcacggttctgcaggctatatgagaaccatggtggcaccttcttctggggaggcctcaggaaacttacaatcatggcggaaggcaaaagaggagcctgcactttacatggccagagcaggagaagaaagagaggggctaggtgctacacacttttaaacatccagatctcatgataactcactcactcactatgacaagaacatcaccgatgggatggtgctaaatgggcatgagaaatccgcccccgtgatccaatcacctcccaccaggcttcacctccaacactgggaatgacagttcgacatgagatttgggcagggacacagatccaaaccatatcaagctccattataatcatatgggaccaccatcatatatgtggtccattgttgactgaaacattatacagtgcctgactgtacttgctcaatgtccagctgactttatttgagtctagttgtcagtccttctccctctgatattcaagctgatgtcaccacactgtagagcaaactctttggcaacagtaagtcacaagttgacttggctggctcagtgtatatcccagtttctctccaactctggcttggaagtctcagagcctcttggttcctggaagtctcacctgtccaggctaccttaagtagggtggggatggtgggcgatactgaaaagatcattcctacacacttattattttaatctctcatcactttgcaattatgtacttcagacatggtagagttaatttatctttagtgagagaaaaatatagttctttactataagaatttcagggttctttatattaacaggttaatttgacaaaacagttattgcagacttactgtgttactgcgtaaaaagcactttatttggctgagaaaacaagaaagaaaatactatttgtgggcaggggtggatcgttagacatgtgaaagaaagggaggatttgaaatcatttcccattacagatctcaatccatctcctcctttgtaccttaagaggagaaagaaagggggaaaagaatttttaaaagcaaagaagaggaagagggtaggaggaccatttcagtctaacatgcaatttaattttttccatttaacaagttttatggagcagttactttgaacataattatacactgggaaatggagaatgagtgaacaccaaagcttctctctttggattcttttctctacatgctccatgtccttctcacaatacccctactccacggccagtaaatccatctgaaaatcaataatagctattgtaaacaaggactcaagaagtgaaatatttgttttaatatctttgtaaataacaactcccacatttagaccacgactatatttggaatttatttccgttgacctacttaattcttacctgcttatatttaagtttaaaacataatcttcttaaaagaaaattgcactgattttaaaatgtcaaaacatttggcattttaccaagcttgtcagctctctttaagtaaatacagagacgtgaattatctagccaattctttttcgtctttacaaacacagaaatcatttcctggggattaatcattctttcaagtttagaaagttgaaggaaaatactgatgtaggctgtatcaccattacattaaatgtttgtgaacattcagacttaaaaaacacatgcatgaatcatactgttggtgatctcagcattgtctctgtataaaagaaaggccactagggggtagagctagaagcccagtagacaaagaaggtaagggcagtgagaatgatgcatcttgcattccttgtgctgttgtgtctgccagtctgctctgcctatcctctgagtggggcagcaaaagaggaggactccaacaaggatcttgcccaggtaattaacggtggcatctattgcagctactggccagctcaattgtgtctacttggtcttccaatacaaagcagaatgattagactagagatcactttgttagaaaactgtagcatcagagaataattaacaggctggaggtggaaattatttttatgttaacagagaagaaaagaaaggttcagaaagggaatataactgctcaaggttacaataaaatagtagcagtatatttgtggctaagtgaaaagaacatatggagaatatatgaaactcctctggctttagaatttatttagttaaaattattggggaggggagcatgctaagtttgatctttaaatcatatcaggtaatagttttcatatttttacttgtcatatttggacaaaagagtttaccacacttcagtcttaaaccaggtctataataacaatgtaagtagaaaaggttagtattctaacttttcacaaaactatgttaaaagagggtttctttaaaaactaacaaaaataatgctagacttgaattttcaatccccaattccttacttgactagcaaactaacattgcaataaaatttaaaaatttgtatgaaatggggagtcttaatgaaaaatcaaattaaatgtgatagcctcttttgttttaagaaactagaggaaaattacgatggattataaaagttggataaatgatggaaaatcacaaaaatgccctaaaaattctattttccattagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggtaatggttcagattagttttcacataatattgaaaccttataagttactcgtcatatttggataagtaacataaagttttctttaacaatttttcataaaggcaggagaaaataacatcctcttcaatttttctcctccaggattgtgaattatacaccagatttgccaagagatgctgttgattctgccattgagaaagctctgaaagtctgggaagaggtgactccactcacattctccaggctgtatgaaggagaggctgatataatgatctcttttgcagttaaaggtaatcaaataaagcatccatttatctggtgtattcatctgttcagactgctatagcaagttaccttagactgggtaatttataaacaacagaaatttattgctcacaattctggaggctgggaagtccaagattaaggtgccagcagatttagtgtctgatgagagcctattcctcatagatggtaccttctgtgtcctcacacgatagaaagggccaggaggttccctcaagcttctttcataaaagcactaatctcattcatgagggcagagcacttacgacataatcacttcctaaagacctaacctcttaatactatatttcattgggcattgagtttcaacatatgaatttgcagcagacaccaacattcagactatagaatctactgttgttttattggaacagggtaaaaagaaattctgaacacttatatttccattaatttgttccctatcagaacatggagacttttactcttttgatggcccaggacacagtttggctcatgcctacccacctggacctgggctttatggagatattcactttgatgatgatgaaaaatggacagaagatgcatcaggtgggtcgtaaacctctcgggaacatttcaggaataatgtccaatcctacccaaaaataattggattatctagaacgagcaataaatcgaatatactagtaactgaatttttttattacctgagttttaaacagaagtactgtttgtttcaatcattattgaagaattttataaaatgtctgtattttcatgtttgcccccaccaagtacaatattgtaaaaaccattcaacctcatctccacaactcaggatcttgtgggggtttgaggatcagcataattaataatgtttttcatcactttaatgatagatgattaggatagaatgaattccattaaaccagttccaatcctaacatttgccctcaggttttctttctttcttctcattggcctcctttttacttaaaagtagagatcaggagaaaatgccaggaactgaaaaaaaactgttaggtcatcttttcgaataaacatgtcactgtctctagcttagatgggtttttttcgccctaaattggcttggaaacactttacatctaaacataatgactaaaattaactgtatgctatttaatttttaaaatggcttctgaagtttagaaacacactgttgaaataatcactatttctgacagtgcctgggatttttaatgtaaatgcaaagaacatctttcctgagtacaagactcaggaggctgaggcacgagaatcactgaacccaggagatggaggctgcagtgagccgagattgtaccactgtactccagcctgggcaacagagtgagactctgtctcacgagactgaagtttgtgttgcatgaaatgattgccttttatttgaacaactgttcttttctgcacaattcttggagccttggttaaataatatctactactaaattcaataaaaccctttttataatatttttaaaaagctgaatctagctgtgtttgtgctgcagaaaactgttattgggcatgtttctgttttaaactaaagattgtacacatccaatggcacctattactgggaagatttttgacaatcaaaaattatttgattatggccaggcaccagtggctaatgcctgtaatcccagcattttgggaggccaagttgggtgaatcacttgagaccaggagtttgagaccagcctagccaacatggtgaaaccttatctcaacaaaaatacaaaaattagccgggcatggtagcacgtgcctgtaatcacagctactcaggaggctgaggcacgagaatcgcttggacacatactccagcctgggcgacagaatgagactctgtctcaaaaaaaaaaattacttgagtatgatgaagaggaggaagagaaaatcagactaaaccccacaagaaataaccacagtcttctggcttaaaagtttgaacgtaaatgttatatgattaattttaaccaaggttgcaactggcaagtgttcctaaatttgaacaatgactttttatttttagacaacgaagagttatatttactgacatgctattagtcttgtcctttcaaaaaaaaatcttttgaaaataatgcttctcatttgtcaatataggaaaagtgtcttagttttcctgaccaaggagggatctagggagggatacggtgaaaaactgtcttatatattgacttaaagtcaaccttgaaaaacacattaatttctataaagtatggaatgtgccaatcaatgaaccaatccacaaatactgaaaagacattgtggtttcaaggatggcctgtacagctggcatatgttctgtatgtgtatttatggaagaaagagctggtgaattctgaacatttatgattttcatacaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggtgagtgatgctggaaaaattaggcattgcagctctacaatgacagtcctccagaaagctttccagtgctacctaaagtatttctgatttggcctgaagcactttgagaatgtttgaaaggcacacaaattgacagatgcatcacatttttttttaatgtttgcatccccaaatctgtttcctttaggacctccccctgcctctactgaggaacccctggtgcccacaaaatctgttccttcgggatctgagatgccagccaagtgtgatcctgctttgtccttcgatgccatcagcactctgaggggagaatatctgttctttaaagacaggtcagaccagaaaattatattttcctatctattcttttgatgtacagtgcttagaaagaaaaacagaaacttgacagagctttttttttaattttaggttcaggggtacatgtgcaggtttgttatatagataaactcgtgtcacaggggtttgttgtacagataattttgtcaccccagtactaatcctagtacccagtagttactttttctgcttgacagagattttttaaaatataaaatttcctctacattttaaaatcattcagatctagttcttgctgaatttttaacatcttcttagaattgtccagatcattttttacagacttataagggatgattcttggtccctagactgtaagtttgattaaggcagggagttatatctgtttcgttcatttttttaaaatatcatatatcatggaacttcttcagaaagcactggtggatccttagaagcagggtggtatctttccatttactaatatatgctactatttaaattaattacttttggaaaaaagtgatatgtgcttgtggcacaatatttaaacactaccaaaagatacggagttaaaaaatctctctccagtctttggcctaccgtcctccagctcccttcatatgtgcaaccactgctaccaatttcctttgactctttacaaaaatgttctactcatatacaagcatcaatatacacataatattttttaaaatattaggacataatatgcacactgtttatggacttttagaatggaaccaagctaaataattttactggaaccagtcacaagtcctgccatcgatttcattaccctggaatcacatgcaggaggatggtttaatacagacttctatgaatgggtgaattagcatggatttaaaaaaaaagaatttttttttcacatatctaaaagagaaagacaattgcaagtaattttatgtattacagatatttttggcgaagatcccactggaaccctgaacctgaatttcatttgatttctgcattttggccctctcttccatcatatttggatgctgcatatgaagttaacagcagggacaccgtttttatttttaaaggtgagtactatataagaatttcaacttgctggaataaatcctattgcaaaaattttattgacatgagttttatccattatattaaagtttagattactgaaagaccttgtgctaacacttaaataaaatttgtacaaagaacattataaactttattttagagacctcttaagaaaataggtggcattccatattcataaaaaatgcaagatagtaaaaatgtcaatttatctatagatacaagacattttcatttcaaataccaaatgccaaaagatttttcatggaacttgacaaattagttttacaatttatatggcagaggaaaggccaagaatagccaggatgctcctggtgaacccatcttattagatgaggagaaaagccctgtgttataaaactttaatcggtaagatgtagtatcagtgcagggagagataaattaactaatggagatattcaggtatagaggcttctttatcagacttttaaactactgtttcaatttgttttattggtaatatgctattagagtttctattacttcttgagtcagttttgttaacatgtttttctaaaaatttgccaattttgtctgttttcaaatccatcagaaaaagtttttggaaaattattttgttgtaatttgaattattgctgaagttttgttttctttttcattcttaatactgaatccttttgcctttctcttttttcttcatcaatctcataatatatgtaataattttactgatcttttcaaaggactgacttttggctttatttactctctatattatattttgatttcccatttaattagtttctgttcatatctttattgttgccttaatttttgtttactttgaattgatcctgttattattgttatagcttaagtttgatacttaccttattaacttgtaacttttttcttttctaatacaagcatttatacctataaataaccatttcttctgtttcatccagcaaatttcgatatgcagtattttcattttgttcaattttaattctttaatttctcatttttattttttccctagactcataggtgataatggaatatttttaaatgtcaagctttatggagattttaaaaatatttatttctggcaatctcacttatgtgaagatcaaatgaatgtgaaattgcagtagaaattgtaaaggattacataactctaacgtattgttatcaagtaatgtatctcacatttacatatcacttgcactgtgtcagacgccattctcattggtggaggtcaggactgaaaagggctcatattctagaaggggcagcagagatgaagcctttggcagcctacatatgacaagtgctgggactgagagaaggaagggtgccatgggagcacctgactcatacccaggactcagcaaagatcccttaggggaggtgatgttaggatgggtcttaaagttctctattgttgtgcagagatgggctgggtgtacagaaagtagaaaggtctttaagaaagaagaaattgtttttaccaagtaagagcatatctggaactgctcagacagatacaagtcattcggttcagacgaagcaagagagataaacaacagatggacattttagattagtgaatctggcagtgagtgcgaagaaggaattcaggcttggggtctgggagagtgatgtaacaaagtaaatgcagagagattgatgggattttattgtcctaactcactagaatttgaatgaattccgatagtgttcacaagaagcacagattggaattggtgactgtgaaatatctcaaaggaagtgtccaataagcaactgatctattggtatgaaacttaagagagagaggtctaggtgagaaattcaggttaaaagtttaccaacaattataagaaataactaaaactgatctataaataaactataacatatagatacaaatatataagacacagaaagggcagtgaatcagagttatctactcatttattcattcattcattcactcactcattcagggagtatttattaaggactggctgtgaactggacattattaggttggaattaaaaccaagccttcctctttaccacaacaatgcactataattatttttaaaatcaatggcttcaagtaaaatgtcttggatttattttttcaataggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggaggtgagatgcaagagaaatgactttctatgaagcctgattaagaaaattattttctttctttaaggatatttccctaccctacacccaccctctaactttctctaacttcaaaatttatgattatgaggaagacagcttattgttctaccttccggatacaaaggcctctcagaatggtgatcactgggccatatactcagacactaaaagacatcaggagaggccagctgaggtccaaaggcattcacctcttattccatttccagtcaccatgtggctgccataggaagcccaggtgtggcaggctttggagacaggatctacagggtcccagtgtgactgagaaccagaggtttatttttagctaagtgatttaattaattttgcattatgaattcattatgtctacacagtctttatgtatttatagtagacacagggaaatttggtttctgtgtgtccaggcttagaaaatttacctcagacatatgtatggaacctctgtaaaatggcataatgttcctgtttctggaaaatattgttttatgtgttaaacttgtaagcccaggaaagtaacctattcttgtagctctaaaaatgtttaacacttttttacacaacttaaaaagtttgtctaggattccacactggaaaattaacatcacattatactattgtgtgtaatgggactactgcacatcattgaactgtatttctttcatttggtttagatttgatgaaaatagccagtccatggagcaaggcttccctagactaatagctgatgactttccaggagttgagcctaaggttgatgctgtattacaggcatttggtaagaagacccttatttcattgtcaatgcaggaatctccaggcatttttatgatttcaaaataaagtgcagaatcaaaacagtttttaaatcattcagtctgatatcttttttactccaaattcctgaaaatcttaactttccaatttatgcaaagtgggtttaaatttgtgtgtgtgtgtgtgtgtgtgtgtgtgtgttttcctgaataacttcctagtctctgtttcatatccgcacataaaatcaaaggatacttcctcacacagaagccattatctttcaggtcactatgttggtataaaaatacaatctgtgtgagccaggcttactgatggctggttgtcattctactctatcccatcctgttgtcccttttcttctatcccaccccaggggagccttgtctgggcttctgttgcagtctgcgattgcctgcattagtcatttgtaaataaaatactagtcctcccatatgctcaaaataggtcaaatgtgattcctggtaatgggcaaataggaaagcaaaacttgttcttgattactctgaaggaattttggagggagctgccagtgcttgacaatccaatggtcatgaggctgatgatcttgttactaaaatgacttaaccatgatggatgcaaagcaggaaatggacctctggctcatttatcatttgtctgattctcttgggtctagttgtctcccaaactgtaatttagaacctagcagaagaggggaggttggaaagaaagtaaaacaaggttttaaaatattatagaattttatctctttagaaccagtatgacgtaatgttttagagcacttcctttggagtcagatgagatggagtcctccctccttccttccttacagatgctaccttgttaaaattacaaaaccgtcttaatttttagttttgttctcattaataacacatcacagttttttgtaagggtaattgagataaagcatgtaaagcacttagctcagtgcttggcatagagtaatcacttaataaatgccctccattattaacttgtacttaatctaagttatatgtgttgcaaaatgacatatttgaagatgtctcatcattttccttatctatatttacaggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttccttactttctagaacaattcatgttcaataccctgatcatactggggactgattatttgacagatagtctgccagtaggtgtggtaggaacacacactctataaattagtcatgtggctgtcacataccctctcctattctctgcaccaacaggatctttcttttcatctcacagatattgtaagtgttccttacacacctaacaaagaaagaggtaaatcaacagttgtcctgtatctaggcaggatcaaaacaaaatggagaaatggaactctagaatgttagagcctgggaacctgcatattatttaatagactttccaattttacaggtggggaaataaaactagtttggagtccactcacctcttgttttaacccaaatctttcttcagtgggattcctttcttgctctagagactaaatttctcatctccccctcaccctcaccctcctgttagaatactctcttgctaccattttgtacatggaaacccctgagtgataacagtgcatgtgcacatgccaattttgtgacagatttaccatcacgaagttacatgcttacaccatactgacaacactatagaaacttgttccttcttttattgactaattttaatgccagactttgtcatagttgcaaagtatgaaacagtgaagaaaatacatttaactcaatttcattgagttttgtctggtgagagaaagaaatcaaatgaaagaacataaattaatgtataactacaaattataaagctgttattagagaaacgacaaagctgtaaagaagagtactgttggaggaagggttatctgttaaagtttggttattagagaaagtctctctgggaaaataatgttaaaaacaaagcatctaaatccaaatggccaggtgggtgaatgggtaggaggatttagactactctaaggaaagaaaatgcaaattagtgttgaggcccagtgggtttaaaaaaataaaagtccttggcatgttcaaggaactgaaagatgagtgcctattggcatgttggagagtaggggtggaataagatattagacaggtagacacaatcaaatcatccaatgtctttacagtatactaaagagttgtatttcacttttagtgcattgtagattcatcgagtgagtcttaaacagataagttatgccagccattatatttttgaatgattactttagctggagagagttggaaggaagtgacgacaaaagttggaacaggttaaaaatgacagggaagggtggtagggacaggggacctctgggtagattgagagacatgactggattttttttatttttatttttattttatttttggccctgtcacccaggctggagtgcagtggtgcaacaaccacagctcactgaagccttgatctcccgggcttaggaaatcctcccacctcagcctcctgagtagctgggactgcaggtgtgcaccaccactcccaactaatttttgtacttttggtagagacaggcttttgccatgttgcccaggatgattgggaactccagggctcaagcaatccatctacctcaacctcccaatgtgctgggactacaggttgagccaccatacccagccctgatatatatttcaacatcattcagatttcatgataaactagatagagttctgagaaaaaaggaaggtattaagaataattcctagattaccggcttgaacaaattcttggatcacagcagcttcaacagagtcaggggaaggctgaaagagaagcagttttgtgggagaaagttaagattcagtaggaatcacctcaccttttaaatatagaaattcttgtaagttaaccaactaaaggcattagtaggccattagatggaggaatctggagctcaaaacaaagtagataaaactgtgggtgtttggcggcatcagtcaagccatgggaataggtaagtttatatgggaagattgcagagataaaagaagatggttcaggactgaacc

SEQ ID NO: 16749 - DNA, 18351 bp, Human
tccatgagtcgtttgagttttaaaactgtctttttgtttgtttttgaacaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaaataaatccactatcagagtagatttgatgttggcttcagaaacatttagaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaagaaactgaatctgctaattaaaaaaaatatatttcattttatacattttagtgggcaaattatgtgtattcataagttttggtctaaaattaattttaggtaacagtgatgatgtcaaatgcttttgctgtgatggtggactcaggtgttgggaatctggagatgatccatgggttcaacatgccaagtggtttccaaggtaattgttttgaaattctctttgcaaattcttgtgattatcatgagattgcttatatgtgttcacctgaaatcagttgttactttactctgttccaaatatatatttgtgaataagtttaggatggattacttagtaaaatacttacttaaaaagtttcgatggacttaagacaacgaagaaatagatttggggatttttgtttaatttttaaagaaatatatatatatttaaataatacatgctcattataaaaacaaagtcacacattgtagaaaagcacagagaaggaaaattaaaatgtccagaaatcttaccgcctaaggatgagcatggttaccactttagtgaacatccctccagacatatagaaataaatgtatatgatacatatacatatagaaataaatacatatacatatagaaataaatgtacaccattttacataagttaaatattatatctagttttgaagttttttcagtcaacatttgtcttggatatatttccattcattcggtattcaataataattgatcacctattggcaggcattgttctgggtgcataaaatcagttgaacaaaacaaagacccctggtctcctaagtttttattatagcacgagagaacagacaactaataaaaacttgaataagttctatagcatgttggaaaataagtacaatcaataaaaagaacaaagaggagtttagaaatgccaggcaggttacaatattaaattgggtggtcagggtaagtatagactcatctcatctgttttagtcgccacgcagcattttaatgtgatgtgttacccttttgattgtttaactggccacctagtgttctagttaatcctgattagcttgcaagtgtgggtttttatcacgtgggtaagaaacttaatgtactaactaaaatatcagcttcaaaaagttttttacactctcctttttcatctaaatcatgtggcctacaattacattttttcatggtcaaaacttttgctattattcaacccgtttcccatttgccctgagaatactgcactggcaacaagctgcactgttttttttctaaatgggaaatgggttaatatcgattaataaatgtggcatcttaacttattttgattactttttttcctcttttcttttgagatggagcctggctctgttgcccagattggagtgcgatggtgtgatgtcagctcactgcaacctccgcctcttgggttcaggcaattctcatgcctcgagcctcgctagtagctgggattacaggtgcacgctagcatgcccagctaatttttgtatttttgtagagacagggtttcaccatgttgtccaggctggtctcaaactcctgacctcaggactttgaggtgcttgcccggccaacatcagtgtgttttaagaatcttagaagagttgaagagagtagctaagagctctgaggagagatggtcttacttgacctcagtagactgaggggctcctgacccttgtccacttgagccttggtagataactagtaatcaccttcctcttgcttatatcaacctgcctttcactgcaatatctctgaccattccctatatgctaaatgaatagtaaattgattatatgtacatttatactcatttgaaatatttatacttcacaatatattaagagtaaattgattatatgtatgtttatactcacttgaaatagccagtctacaaatggctggattagtcctgcccaaattaagataaacctttagaacttttcaaaattagctgaagtggtcgggtgcagtggctcatgcctgtaatcgcagcactttgggaggctgaggcaggaggatcacttgaggtcaggagttcgagaccagtatggcaacatggtaaagccccatctccactaaaaatgcaaaaattagccggccatggtggcaggcacctgcaagctcagctactcgggaggctgaggcaccagaatcacttgaacctgggaggcagaggttacagtgaactgagatcatcccactgccctccagcctgggtgacagagcgagactctgtctaaaaaaaaaaaaattagcagaagcataatgtatcttggcaaatataaaaatattaattttgtaaaacattcaacctgtatgaaaaatgttgactgtcatgagaagcatcttacaaaacaattaaaaattcacacaaaaaatttgaatcctgtcataggataactatgggttagttttagaaaaaaagttttttttttaaaagcaatacaatagaatcagttcccagtgggctaggatgtatttattcttctaacattaagtttagaataaatgatcttaaatgattctgtgatttgaggcaaacaaccagatttgaaatggaataaacacctagagatgagaaatttatgttattacattttcatttcacttgtataaataatccctcaaattttattttctttacattttaggtgtgagtacttgataagaattaaaggacaggagttcatccgtcaagttcaagccagttaccctcatctacttgaacaggtagggcaagttctttttttaaatattggttgccatcagagaaattgctttctgataattacagagagtgctatttgagtgaaaagacaagagttgttttagaaatacattttctttttcttatcaaacctgacatgattttagaaagtattattctttggagaaaaatagatccataaatggtagtctcctgataatgacacttgtgatgtttttcaaacaagttgcaataaatcaaacttcgagaaaaaatgactgggatagtagtatttaacagtttcactatataaattttccttcaaaagatctgagaaagagaattttattgctttttctaaccttgagaaagcaaataacttacataatagtttgatggtcaaacccatcctagccatgagcaatgaaactgatacagggtccaacttatcccaaaggatgacccagggtaggtaagacctgtggatgaaaggaaaattgattgtcacatggattatggaaaagatatagtccgtttcctgccttaatgaaaatgggttttgttattatatacacacactgaaactctattagtttatggcctagggaataactatcaaatataaatgaaatattgcttttggttaaaaaattattttgccagtaagcaagtggtttgcaacaagttgaataaaatatgtctgttgggtcattttcattgcaatgggtaagataagatttctattttaatttatatatatatatatatatatattttttttttctgcagctgctatccacatcagacagcccaggagatgaaaatgcagagtcatcaagtaagtacaatggataataatgaatgcatttaaatagagtcatttggtactgttaatattgaaagttgataatagtaatgtacctgtatattgatttataatttacgatgaatgcattttcaaatatactgtgttggtatttcccaaacttcagtgcatatcagagttgcctggagaactttaaaaaatatgacagatttccagtttctacttcagacctactgaattaaatctgagtatctaaaggtggggctcaggcatgtatagttttaacaaactacatacatccagcctaacacttgttcttgggccagtgtgggagcagatgtactatgatattagattgctcacatattctttctgtgaaagggaaagaatagaacacgttagtcacctttttaaatagggacgctgaggctcagaaaggttaaatgacttgtacatcaccttacacctaaaatgcaacagagctaatatttgtacaagcccctctactccattatctcatgttcaattcaattcagtatatatttattgtatattgtatatcgcctgttctgaggaaagcatagagaacaggatagagccaacccaaatgtccatcagtgatagactggattaagaaaatgtggcacatacacaccatggaatactatgcagccataaaaaggatgagttcatgtcctttatagggacatggatgaagctggaaaccatcattctgagcaaactatcacaagaacagaaaaccaaacaccgcatgttctcactcatagttgggaattgaacaatgagaacacttggacataggaaggggaacatcacacacagggcctgttgtggggtagggggatgtgggagggatagcattaggagatacacctaatgttaaatgacgagttaacgggtgcagcacaccaacatggcacatgtatacatatgtaacaaacctgcacattatgcacatgtaccctagaacttaaagtaaaataatttaaaaaaaggaaaaaaagaatacagaacaggataaacataactcctggtctcatgtatctactggaaacagacaaatacacagacaggagaaagggatatggcagcaaaagtaaagtgtaatatgagagtgcatataggacaattaacccagacttggagggtcagaaaaggctttccaaaggaagtacttgtcttagcagaaaatccaagggaagagtaggagttaaccgagtgacaaatggaagaaaagagtattccaggcagagggaacagcatatgaaagaccgaagtgacaaaggagaataggcacctttgaagaactgaacaaaattccatatggccagaagtaggagttgctaatagataaatcagggaagcaggccagctgtatgagtggtcagcactacaggcagaattgacactagagccatcagtttgtgacttctgggctagagtgcagaatgtgaatgattcagtggcaagagatgaggctgaagaggtaaacaaggttcagattgtatgagactttgtaagacactttattttggattttatcctaagagcaatggaattgttgatggaatttaagaagtgtgacacatcatatttgtgtttttaaaaagtcactctgattgcactgttgagaatgaattccaaggaagcaatattttataaccatagcctctctgaaaaatatgtgaattattcttgattgaaaactcatttgttcattcaacatagggaaaaataatctcaattctagtgggaggtaatccctgccattctgtttccttctcctgctcacatatgtatatccagttatgacaggtaatgtgtattttgcatctaagtacaatattccaagttgttatttaatgactgaacgtgtatatcattttaaatttaacaatgttcatacaaaataatgcctatacattttgttggttttacatttttaatattataaaacctttcaatttttgatttcatttcaaatttcaatttttaagaaatataaggctatcctaatatgtgttaaattctttgttccatatagttatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaagtatgtagatttattaatacagtctattttcataaggatttgatatcagtctatatgttatgaaaaatatactcatctagcatatctgaaaatatactcaatccagtcaggtttttttcatgtttagtattctgaattcaaatgctgaaaaatttattcatattcaaatatatttgagttgctcataagtcaaaaatgtatgatgtacaaaagtatttttcatgtttttccttaattcatatttttttctctggatagctgacgttgtgtccaattatgcattcatggcacattttttttttcttaacgctttgaaaatggaatccttgttgcatcatggcacatttttaatcccaggctagttgctcactcccctttggagtaaatcagggtgggatcagggacaattattaatttttttttgagacagtcttactctgtcacccatgctggagtgcagtggcatgatctcaactcactgcaacttctgcctcctgggttcaagcaattctcgtgcctccttcccttagctgggattacaggcacctgccaccatgccaggctaatttttgtatttttagtagagaagggatttctccatgttggccacactggtctcaaactcctgacctcaagtgatccgcccgcctcggcctcccaaagtgctgggattacaggcatgagccaccgtgcctggctggatggttattaattttaatgttagcataaaagcatgtcttagcctgtgactatacattaatacacaaattactattaagtcccctacctgtccacacaagaactgagtcttccagagcatccgtcgattatttaggcaagtcctagtatactgtttcacaatctcttaggacaagttgttcatgtccttccatactaaacgtatccactatgttctctattgcccttcacaaaaactcttctgggcacatacattctcatctggctgttttgactgctatcatcattctgtcctagacaaaaagaaatgctgatctctcctttcccaagcatggaccagacctataagtcccttcaacacagctgaaaacagactgcaacttttaacaagctcttactggagacttaaggaaaacggaagggaattatatcacaaatgttgatttacagctgcaactagctgtgacctctcttagtgcccccgggctcatcctcataaatctcccctgcctagcttctggttcatctctgtgtagctttggcaagtttacacaagtcactaggaatgtcccaataatgttttcctttatcaaaattcaggcccccccaatattcataaagctcagaaggagaataaagatttctccttatccttgtgcaaggccatctgggatctatttcttcacaggatgattgacagtcagattgtccacttcatttagggataaatccaaccctgcccatgaagatggatttgttctctgacccaacccagacaaacctatcagaccatagtgatatagcatcatacattcaccaaagtgtgaattactcagtctataaaccactagtgtagcagcaatacagtcacggttaacctttgcccagcctcatcaaattctcttttctctgtgaagattaggcaagcatgtccttcctgtagccttcttagtggtagccatttgtcatcagccaacaattgctcaaagaagagaacacttatctccacaactgttgagagaccccataaaatctaaaactatccacttataaaatatttatatttctttcaaagacaatcagaaaagtctccagaaatgacttcaagtcaacaatatataataatttacattgtgaaaaagagcccttagcgtttctgcctcaccattatatatatatctctactacctagtatcgtgcctgcatatagtctgtgttgtgagtgagtgaatgaaaacacatttaggttaatgattacgttatagtttcccaagaatagtagggatataaataaagaggtaatttaagattttttttttcccagaataaaataataatatggctgagtgtggtggctcacacctgtaatcacagcactttgggaggctgaggcaggcagatcgcttaagcccaggagttcaagaccaggctgggcaacatagcaaaaccctgtctgtataaacaaatataaaaattagcagggtgtggtggcatgtgtctgtagtcccagctctactcaggaggctgaggtgggaggaccacttgagcccagggaggttgaggctgcaatgagctatgatcatatgccactgcattccagcctgggcaacagagtgagacactctctaaaagaaaaaaaaaaaagaaagaaagaaaagcaaaaacaaaattaataatatgcttcaaaggcaactactcaggaggctcaggtacaaaaatagcttgaacctgggaggcagaggttgcagtgagctgagatcgcaccgctgcactccagcctgggtgacagagcaagactctgttttaaaaatgaataaataaataataaaagaaattttatggaagaatgatactttaagaaaaaattgttttaattcaggctgaatgtggtgactcatgcctgtaatcctaacaccttgggaggctgaggcaggtggattgcttgagcccaggagtttgagaccagactggacaacgtggcgagaccccatcactacaaaaaatttttaaaacaaagtatttgtgatggtgtatgcctggtaatcccagctactcaagtcttctgaacttgcaaaccagaatatagtctacaactttgaaatgagactttttctcagttactagcaattaaattttagaaatcttaagaacttcagagaatgcattatattaggttacgtataattacaaaaataaatcttagattgaaaaactagtatacttcaacaccaagtttgtatttttattttctaatatatccctactttgctaatagaaataatttaacaaaatatattaagttctaagtcttctacccctctcaccattacttttcattcctactctttaaattatagaactaaggtttgattgttcatttgttcaacagatatttatggagcattaactttgtgccagacactattctagctcctgacccttttctcatttattctcagagcttccattattttcaaaatatgtctttagccttgtctttttgactaagcatcatctttattttctggttgttgtttttgatttttgctgttttcttttttccattttttattctttcttaaatggttctttttatgagtcctatcacttgacaaagtcagtgtatctaaaatctaacaatcctctctcccaaaacaattcttcagatagctcagcctctgtcattagttattttttagaaacagctttatggattatggtaagctatatgaaaattaataaacttagattcataagttatattccaaagagataataaaactgcagttttaaaatataaaatgttttaccaatggatacaaaatctaggtcttgaaggagaattagatgatatcttgtaggacgagaaggtagtcgttgacaaatagggtttattattcaaaatgctgttactgcctttccctgcttactataaaatatttaggtaatggcaatatgtctaatttctggaaataattaaaatttcaacttaaaatggaattttaaagaaattttatgggccggacataatggctcacacttgtaatcccagcacttttggaggccggagtgggcggatcactcgaggccaggagttcgagaccaggctggccaacatggtgaaacctcatctctactaaaactacaaaaaattagctggatgtagtggcacatgcctgtaatcccaactactcaggaggctcaggcacaaaaatagctttaacctgggaggcagaggttgcagtgagctgagatcgcaccactgcactccagcctgggcgacagagcaagactctgttttaaaaatgaataaataaataataaaagaaattttatggaagaatgacactttaagaaaaaattgttttaattctcttgattttgtctttccccaatttgactagattgaattgaaacgtcaattttaatgggttctaagttccatttggttaaaggcttagcagtattgccaaatgattgaaagcacagtacatgacaccagactacctcagtttgatttttgctagttgtggtgtccttcggcaacttaattgcctcactgcagcttcattttctcatttgttaaatgaggctattaggacctacctcaaagagctgttgtgaagatgaaatgaatcaatacatgtaaagttcttaacacagtgctcactaaatgttagtccttactataagtagcattattattattattattatatttttttaagacagggtattgctatgttgcccagtctggtctctgactccagggctcaagtgatcctcctacctcagcctcccaagtagctggtgctacaggcatgtgccactgcaccctggattataattataataacattattattaagcaaaggagatgagacacccctaaacctagcaatcaacatcaatgccttactgattacgaattaaagatagtttttatcctgctatatatataggactggaaggaagtttgtgagcagagtttgaacatgtttatgcttgttttcttttttataaagatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttggtgagtgatagaaaattatttttaaaaattttctaagtcaattgaaaatacgctcttattaataatttatgactactgaaaataattcaggctgaatgtggtgactcatgcctgtaatcctaacaccttgggaggctgaggcaggtggattgcttgagcccaggagtttgagaccagactggacaacgtggcgagaccccatcactacaaaaaatttttaaaacaaattatttgtgatggtgtatgcctggtaatcccagctactcaagaggatgaggtgggaggatggcttaagcctgagagatagaggctcccatgagctgtgattgtgccactgcactccagcttgggtgacagactctgtctcaaaaaaaaatcaatctaatttatagatattagttacataaaaagattaaagacttctgttgccttgaaatgagtatttggctatagtctaaagtgttcatttttaaaatagattccatagctaaatattaaccttatttgtcatagtaatgctttttctttttctcccttagtgcaacaggacataaaatatattcccacagaagatgtttcaggtaatagtactaatattttaaatcaatagagaacattgtctttattttcttagtttttcactgaagaagcaaactgccttttattaaaaattctttcctctttctagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactcttattcttcattgctttatttcaatgacattggatagtttagtcactcccagactctttccataccttcttaaagcctctcaaatattgaactacagtttatactccttcccataagatgcttcttcattgacacttgtagaacacggggtcaacacatcataaaatctattatggaatgcctgagacaagaatcaaacagtccctttagtaagtttgtttattcacttctctattgattcattcaagaagtctcatgccagccccacctattggaagaaggtctgagttttattcttatctctttggtattaattctgaaacttagaaagtacactggttagcaatgcttgggaccaacaggttgttctggtaaataaatctgtttcatattgtcagtgcaacaaaatgtccccctctgcattatgttattggtactcaacacgtccgagtcataactctgtcctttgcttcttatagaggtattaggtcttcaagagcagaagtaagactgtaatagggaatactcaggggaaggcaggcaaaggctagtcatctaaaccagttctagatgtctgtataggggcagatggctctgtaagggcagaagggaaagaccccttcataagggtcacagctgacaatcctataacaaaagacaggttaacaagagaaaaacttaacaaatttatttaatcacagatttacatcaccggggagccttcgtaatgaagatccaaaattacaggggaaactgtgcatttttatgcttaggtttgataatgaatggacagccctgaagaatagtgattggaaaaaaaggatatgatctaatgggaatagacacaggttggggacccagcaaggcctgtctgttcagattattcttggtctctgtgcagcattccttcctcctggatatagggcagggcctgtatgggatggggatattataacctgctatcaagcaaggtaggtcagagaatttatttatggccagctcttacatagttaggtgaggaaagattagagtactatctttaagatgtaagtctggcattgtggaaagatggttccagtttctatgacctaccttggggaagaggaattcaagtttctgtggcttgccttcagggagaatgaggctgagacaggagggcaggataacatcagagaaaaactttgcttctgaggccttcactttgggttttctgagccccaacatctgctagtgttgtaaagagaacaattagggaccaagtgaggggaggaaagaatccatctctgcattctgatgctgggagacttatttccttgaaatgcaattgattttgcctctgctaagaggctctgctggctacccatgtactagccagtgtcctgcatgggtgctaggctgaattatttgtaattgtgcttaggtgatttgtaactcaggtatagggtatttaaatagtaggcaccctttttgcaccatgtgtttttttttttatctagttcttgtatactacagataatatttgaactttgtcatctcactgtaaaacttttgttcatttctcattatggtaataaatagctattataaccaacccatttattcaaatatgttatttccctaagtgttattttgacattttgttttggaaaaaataaatcaccatagataataatggtagatctatttgctgaccaaatgtcagatgttttcaggtgcttgacatgcattaatccatttgattgcctccaaccccacctaccagccaacgtggtcttcagtcattgggtttaaacctcaatatattaagtgtgatcatacaggactttgcagcaggcttaatttcatacttcagccatgctcattatagcttccattccaacctttctcttaatttccttatatcgcttgataccattagccattaagttcctttgtggtcacaggcaatgtgattgaaccatattcagctcctattggagaagatgtcacctccttttgttgtcttgcacatcatagtagacactatgtatgttactaagaaaattcaagaccagatgcagtggttcacacctgtaatcccagaactttaggaggccaaggcaggtggatcgtttgagtctaggagctcaagaccagtctgggcaacatagtaagaccatgtcttaataaataattaaaaagaaagaaaattccaggcaaaacagatgtgatgtttaagagattcactattttaaaagcaatacaagtacgcttgaaacaaaaaggatcagtgggtcagtattactcaatctcttaaaaactacacccactcctggtcggacgtggtgactcatgcctgtaatcccagaactttgggagaccaaggtgggcggatcacctgaggtcgggagttcaagaccagcctg

SEQ ID NO: 16750 - DNA, 26993 bp, Human
ctgaagtcatacatattcaagcaaggctccaggccctgaaccaagtgactctaattccaaagcccatattcctgtagtacacttttcaaagttcctctaagttcccctgtatcttgacctgaggaaattacagttgcatgggtgctttgaggtaatcattaaaggcttttgtaaactttgggagtaggaccaggctcacagtaactaggagattgagtaccctgagggttctggccccagaatttcatagaaatatggtgtttagaagaaagaagtcatctgttaaattctctaaacctaaaattaagacttagctgctatatatccaaactgacccattttttttattaccttccaagattcagcttttggcactttatcatccaatcaagtttcatggagactggattaggaccataagacttattcagatattaagcctcacatgatacattattttttgtaaaaaattttttagattaatatgatacaaagttttgccaagcccttaagagggagtttatcaattcagcgcttttgcatttatgctgtcaccacccatgtttgaactcattttcttttgttcataagtaaacaagtttttgtttgaaagtcgagactaagaatacctgtccttgtccacacctgtttaactttgtcttatagtgccagcaaacatactggagttcttcagcactactgctaaagcaatggtgcttactcacaagccaaatcaactggcaatggtttttcctggtggatttgatttggttaatgagttgtagtaacaaattctaattacaaattctgaatttgacataatatatgttaaattggatgtacatttactatgttatattgaaagagagatgtgtggaaaaaatgtatacttatttttgaaaagaaacttttgtttgtatctgaaaaataaactcttagcaaatttcatctctgggttgttaagagtccaggttctggacttcatagcttgaacagctttgtctgaagacttagaaaacctgcttcactggatcacttaacaaaagtaaaatatcctttgtgtaaagttttcttggaggtgatggtgtaccagtatgctgaccatctggtgtaccagtatgctgaccatctactgtcaaaaataacatctatactggacattctcctatcaaataatagatccagaagcttctggagccattgcaacttatattaagaaataatggtctgtaatggttaaacagctactcaagaagacctaggtacttgcccaagtagatgaaaaccctctggcattcgatagccagtatgcaggctggatttcaatttctcttgagcccctgcactgtgttacattggtgccgtaaacaaactgtacaaccatatgaggcaactctgtggttaatgggatttggagtcagatgataatttctctatgtgcagacacagaaagttttacttaactttctacacctaaaatacttagaaaccatagtcatccatattgatattttatatcatctcaacttctcttgcccaaacttgacctactgttgcaattattttacatttccttggctctgttttcatttatatttaattccagaaaccacatcaagtctttgcagaatgaagtagagcattaagaagtagagatgtacacacgcatctctaaaatcagccatgcctaggcaaagcagcttgcacttaaacacccaatacatttttcatgattgtgttgaagtgaagtaacctaacccgtttttatatccttcaaaataaggtggataggaatgctttcagcccttttcaatagctttgattatcttgtttttgttagatccctcctcttggtttgatcatagtagttactgtatttctttttataagttggtctgcaaagggtagggcttgcagaccattgcaaagttgtgacggctgtgagtcatattgctgaaggtggaactctgaagccagactatctatgtgaaggcacaagctgctgttatatacaacagagtgaactgagcatcagtcagaaaaagtctatgtttgcagaaatacagatccaagacaaagacaggatgggcactgctggaaaagtaagtggaacatttctgtcccctcctcatcatgacctaatgatgtgaggctgatacttagaactttgaatccattaaagtaattaaacacttggagatattccttgaggaatgaaatgcttggtgagcaggcatacagtgagggaaacactggatatggtgtttcagagaatgtcagtggaagcaggggtaagttggaaatagtatatccaatgtcagcaagacattggtggaaaatagagaaattgatttatattggcattattcataatttgatttccggatagctgggcaattgctccaggaagccaaatgtttccacaaggacacttcaatcgtctcagtagcatgtgctgcactcgctgcagtagttcaatgggaaaccagggtctcatgcccagatgttggaagaaacgttcctgccattaagaatggaaaatgctaattctgggatgcaaaatggccaagaaagtgtcatgaattttaggtttcttacaaatgtaatttttatcaaaatatatatttaaaaattctttaaaatcaagactatattattggtaaagtatgtttatcgttctaaaaacaacagagttagcagagttggtattaactttagaaacagctttgctttgtttttttttatttgaaaataggtcagtatatttccttactttaaatgggtacataattgcttaaaggactaaatttttttgtttgttttgttttaacttgaacaattttgcatttagcttgcttaaggttttggaaaaataaagatgacatgagaagtctgggtaatgtgacaagtcaggagactctatgatgttagaatttgaaataagttttactagaattggatagaactggaataaaaccatcctaatttgggtcagaaatccagcaaaactagattacttgggaagttaattttgcactacagaaactagcaactctacccatggatattaatgaatcttagaactgaaaggaatcttaaaaatttgcaacttttaccacccaacagatgcttcaggtctggttacactatttctaggaagtcgatattcatccactgtaagaacatttctgatgatggagaaagtagcctcaaggcagcactttccaattaataatacagtatataatatataaagagtataaaagttatatgattttgatatatggtcatgcaatagtgtggtttgcctaaggattatatatttcccaactttctgtagtgttccagtgtagctcttgaaaggagtttccctttacattgggattgattttttctctttataataaatgttttctttttcattaaaaaagtaaaagataactgtattagtttcctagggcttccataacaaaatatcacagactgggtggcttaaacagcagaaatttgttttcttgtacatctgaaggctgcaattctgagattaaggtgtcatcagggttggtttcttctgaggcctgtgtccttggcttgtggatgaccctcttctcgctgtcttcacatgatcttcccttttcctaatctccccttctaataaagacaccagccatattggatcaggttccaccctgattaccacattttaaattaattacttcttgaaagaccccatctccaaatacagtcaccttctgaggtacggggggttaggacttcaacatacgaatttggagggagacacaattcatcccataccaatgattattctagaaaatttggaaggtcagaaaatatgaaggaaaaaaatcaatcataatatcacatccccaaactaccatttttgtgtgtgtgtttccttctatttttccatccatagtttatgtagctgtactcatacaatatacaaatattttatcctatttttccatcttaaacatttttcaatttataacaatttataaacatttttaaatgtctaatttctgcatttagcacaatttatttcatcattcctctattattgtttatgtattttcctttgtaaatagtgctgtgatgacatctgctatatagagaggtttttctaaaattaatatttcttcgaggtagcctttaaaaatggaattacatgggtaaacatgccacaacatccttaaatatcttgatgtaccatgcaaattactttctaaagggttgacataggtaagatggcccattttaccatttatctgacaatactgtgtattctcattaagttctcattaagtaaaaagtcattttcagagcatggtggcttgtgcctgtagtcccagctaactggggaggctgagatgggaagaccacttgagcccaggaactagagtacaatctgggcaacagagtgtgatattgtcttaaaaaaatttttttttttaattcattacagacttgataggcacagaattgtatctcatttttatttttttaaaaggcgtttttatgagtgagaacaaacatgtcacaatctattcattaatctgttgcagttttttccataggtcctttgcctgctatgtatctcccaggatgtaagtgtggtatgtggaagtgggaaggagtgttaggagtgaagttgttaacacttcctctgtaaatttgagtaagcattgtatttatcaaatgtggtaacttttatctatttaatattttccctcagtactatttgatgtcaatgtggaaaatttactatttctcaacacacaaaattttaattcttagaagctgtttcctttatgactttttttaacttttattttaggttcaggggtacatgtgcaggtttgctacataggcaaattgtgtatcatggggtttggtgtacaaattattttgtcacccagataataagcatggtacctaattggtggttttttcatccttaccctccctccaccttccaccctcaaatgggccctggtgtccattgttcttttctttgtgtccataggtactcaatatttagcttccacttataagtgagaacatgtagtatttagttttctgtttctgcattcgtttgctcaggataatggcctccagctccttccatgtccctgcaaagaatatgatcttatttttttatggctgcatagtattctgtggcaaatatgtaccacattttctttatctagtctagcattaatgggcgcttaggttgattccatgtctttgctattgtgaatagtgcttccgtgaacatacgcatgcatatgtctttatggtaggatgatttatatttctttgggtatatacccaataatgggattgctgggtcaaatgttaatcctgttttatgttctttgagaaatggccagactgctttccacagtggctgaactaattaaccttcccaccatcagtgcataagtattcccttttcgctccaacctcaccagtttgttttttgactttttagcaatagtcattctgactgatatgagatagtacctcattgtggttttgatttgcatttctctaatgattagtgatgttgagtattttttcatatgcttgttggccataagtatgttttgttttgaaaaatgtctgttcatatcctttgcccagttttttatggcgttgtttgtgttttgcttattattttgtttaagttccttatagatgccggatattagacctttgttagatgcatagtttgcaaatattttctccacttctataggttgtctgtgtactctgttgatagtttctcttgctgtgcagaagccctttagttaaattaggccccttttgtcaatttttgtttttgttgccattgcttttggcatctttgtcattaagtctttaccaggtcctatgttcagaatggtattccctaagttatcttccagggtttttagagttttgggttttagatttaagtcacatcttaagttaacttttatgtatgatataaggaaggggtctagcttcaatcttctgcatatggctagccagttacctcagcaccatttattaagtagagcattctttccccatggcttgtcctttgttattttttctatcactcttaagcataaaagttactccatgctcagtatgatcaatatttacatcttcactgattgataaaatagtttgactttaaaaataaatcttgggccaggcacagtggctcacacctgtaatcccagctctctgggaggccgaggagggcagataacaaggtcaggagatcgagactatgctggccaacatggtgaaaccctgtctctactaaaatacaaaaacatattagctgggcgtggtggcacacacctgtagtctcagctactcgggtggctgaggcaggggactcactgaacctgggaggcagaggttgcagtgagcccagattgcgccactacactccagcctagcgacagagcaagattgcgtctaaaaaaaaataataaaaaaataaaaatcttaacaatgaatccagcttgaatttgtttgggaatgtggtgtgagatttctaacgtcaacattgggccatattacactgtaacccataacattttcattagtaaggcagagggtaaatattaaattgagctactgatggctttcagccgcccatctgttaccagtgtatcatttttcacatttaacctttttacaaaagagccacttaagaatccataagagctctctaggactgttgtgtttgttgacaagttgaaggtaacttattttgcatctgaacaaattaattaaaatattttataggagtcctagacagattgggaggtaggaaggtggaaacaatttctctatgtgtgtctgtctctgtctctctctctctgtcataattcaataatcttagcaaaaccatttaattgaataactacagcaaaaccagttgaacaactggatgccagtcactggtatctccacacctagtgtccactactataagatgacaagctttaacctgcctatcaagccctaccaggtgcaagaactgggctaggtgcaaatgggatgcagagatgcagacacaaattcaatcatccaggaactcacagtcataatctgtatgcttcatgatgttcatggttctcttcatccttaccatgctaatagtctaatttcttcaccattgctatgtgattatatgcagctattaaatactggtttaaattcttacagacaagtcagcagcattttctgttttataaatttgtctcttgtgaataagcgatacacaaaggacaattttgttaatctattagatttgaaattgtaacaaaataacctatttttgggtgggggtgttatgtgaacagcaaacaaaaatcaataagttgggaaaagtacctcaggtctagtccagctctgcatgtcatgtgctaggtgaccatggatccatcatttagtcactctgggctgcatttctcatgccttaagcaaaggcacacacaagatgatttataaggcttataatactagtgtttgatgaaaatcattctggaaaacttaaaatattatatatgctcttctgttcatatttatactagtcagggagtctgtaagttaaaggcataattcagacccattataatacttgcctatttcttaggttattaaatgcaaagcagctgtgctttgggagcagaagcaacccttctccattgaggaaatagaagttgccccaccaaagactaaagaagttcgcattaaggtaagcgtgagccctagagaacttaagccaaaagcgttatcaaacttatattgaatatagcactgttgtgaggctggattcttaaataaggagatgcttcccatgtttggagtattaattcctttactggctcttatatattgttaaggatctggttgtactcgatgtgaaattaatgagttcattatccttttaaaaaacaacagtgctaacatgctttattatacctttgatttgttgaatttttattcatatagtgtctaatttaaaatggttaataatcatagctaaagacttcttttaaaatcttctgggagtcagattgttttgaggttactttttgcaaagaatgaggaactcacttgtgcctggagaaatgacaacttcgtggaacgttttcctccctttctttggacagagcttaaccttggctttggacaccagttgttgagtaggcattgctaccaatctttctttgaccctcttactgttacctgagcacaacagtagcaggaagattttgctctttgcttaccttcttgcatgccatttcctctgttctttgttaagagagcccaataagggcctagctataaaaatctactttggggccatcacatagtaacatctgtattctggttccctcacaagagcaccaatttactacagacaggcaccaagattcaacctagggtataagggagcaatattataagttccgtcagagagggatcttgtctgatggttgatttttggctcagaatagtctaagagtaaatgttgttatattaggcaaagatattgattaaacaattataatttcttcaagaagttaaatattctcccaacagtgaaatgatcagtttgttgattggtgcaatgtttttgtctttgaacacagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtatatgcaggtgtcaaaccacaagtttgaaataattaggctttgattagcctatcaaaggaaatagcacacactaggaattattagagggatccttaacacaattcagggaattaaaaggatacaagaatggattttactgagtaatgtttaatttggcaaaacctcaacctttagaaggcaaaccttacggtgtttataaaccttagaatatatttttaaaagttttacctatagtatgggctcaattcacatttgttaatttcatattttaacattaatgaacagcatcttatatcatgatttttttcctgtaggtgacaaagtcatccctctctttctgccacaatgtagagaatgcaatgcttgtcgcaacccagatggcaacctttgcattaggagcgagtaggtttcagtcatttttactttaatgtatttacatttttcctatgctaatttttgaattgaattaattaatacgtgtatttgatgtatcaaacagtattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtaagaaacagggtaggctagtttatttgttcttctttccttttcttaaatgatttgcttggaatcttgaagagttttggaaaaaaaaaaaacatttaaaagaatgtattgcatattcaggctgccaagcaacacaatgccaaatcaactaaaagaaaaataaaaaattcagattagaaattttatttcttctttttacacttgagaatatttattgactatatttgcaaactgcatcatttctccatctttaaaatataccccttccccatatgttaagtttgttaagataggacaatctcagtattttagttacagcagaggctttttgtcagagcttttactcctagtttcttgtcagctaagtaagatttattgtataactacaaaatacagtagtaagtacattaccaacttctcagaaaaaagtacaattttgtcagatcacctgttatagataatataaagagcaataaaatcattaatcattttgattaccacctataatgcgtatcagaaataaaatacagtagtgtttgttgcctattatcagtaatgctgttactgttcaccaaaactgatttctcagtatacatttttccatcaactgtgatgttagataggatccctggaattttaagttaatcacatgaaatttcacaagtaaattggagttcaaggaattaagaatctttgacctcttattattttgagatacgtcccatcaatacctagtttattgagagtttttagcatgaagcattgttgaattttgtcaaaggccttttctgcatctattgagataatcatgtggtttttgtctttggttctgtttatatgcagattacatttattgatttgcatatattgaaccagccttgcatcgcaggtatgaaagcccatttgatcatggtggataagctttttgatgtgctgttggattcggtttgccagtattttattgaggatttttgcatcaatgttcatcaaggatattggtctaaaattctcttttttggttgtgtctctacccagctttgatatcaggatgatgctggcctcataaaatgagttagggaggattccctctttttctattgattggaatagtttcagaaggaatggtaccagttcctccttgtacctcttgtagaattcggctgtgaatccatctggccccggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgcatctatttgattctcctctctttttttctttattagtcttgctagcggtctatcaattttgttgatcctttcaaaacaccagctccatgattcattaattttttgaagggttttttgtgtctctatttccttcagttctgctgtgattttagttatttcttgccttctgctagcttttgaatgtgtttgctcttgtttttctagctcttttaattgtgatgttagggtgtcaattttagatctttcctgctttctcttgtgggcatttagtgctgtaaatttctctctacacactgctttgaatgtgtcccagagattctcgaatgctgtgtatttgttttcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaatgtatattctgttgatttgggctggagagttctgtagatgtctattaggtccacttggtgtggagctgagttcaattcctggatatccttgttaactttctgtctcgttgatctgtctaatgttgacagtggggtgttaaagtctcccattattattgtgtgggagtctaagtctctttgtaggtcactcagggcttgctttatgaatctgggtgctcctgtattgggtgcatatatatttaggttagttagctcttcttgttgaattgatccctttaccactatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtctcctgaatacagcacactgatgggtctcgactgtttatcgaatttaccagtctgtgtcttttaattggagcatttagtccatttacatttaaagttaatattgttatgtgtgaatttgatcctgtcatgatgatgttagctggttattttgctcattagttgatgcagtttcttcctagtctcgatggtctttacattttggcatgattttgcagcagctggtaccggttgttcctttctatgtttagttcttccttcaggaactcttttagggcaggcctggtgctatctatgacaaatccacagccaatgtcatactgaatgggcaaaaactggaagcattccctttgaaaagtggcacaagacagggataccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggacacaaaatcaatgtacaaaaatcacaagcattcttacacaccaataacaaacagagagccaaatcatgagtgaactcccattcacaattgcttcaaagagaatgaaacacctaggaatccaacttacaagggatgtgaaggacctcttcaaggagaactacaaaccactgctcaaggaaataaaagaggatacaaagaaatggaagaacattccatgctcatgggtaggaagaatcaatatcatgaaaatggccatactgcccaaggtaatttatagattcaatgccatccccatcaagctaccaatgactttcttcacagaattggaaaaaactactttcaagttcatatggaaccaaaaaagagcatgcatcgccaagtcaatcctaagccaaaagaacaaagctggaggcatcacgctatgtgacttcaaactatactacaaggctacagtaacaaaaacagcatggtactggtaccaaaacagagatgtagatcaatggaacagatcagagccctcagaaataacgccacatatctacaactatctgatctttgacaaacctgagaaaaacaagaaatggggaagggattccctatttaataaatggtgctgggaaaactggctagccatatgtagaaagctgaaactggatcccttccctacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacagacaacctataaaatgggggaaaatttttgcaacctactcatctgacaaagggctaatatccagaatctacaatgaactcaaacaaatttacaagaaaaaaacaaacaaccccatcaaaaagtggacaaaggacaggaacagacacttctgaaaagaagacatttatgcagccaaaaaacatgtggaaaaatgctcaccatcactggccatcagagaaatgcaaatcaaaaccacaatgagataccatctcacaccagttagaatggcaatcattaaaaagtcaggaaacaacaagtgctggagaggatgtggagaaataggaacacttttacactgttggtgggactgtaaactagttcaaccattgtggaagtcagtgtggcgattcctcagggatctagagctagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaacaaacaccgcatgttctcactcatagataggaattgaacaatgagaacacatggacacaggaaggggaacatcacactctggagactgttgtggggtggggggaggggggagggatagcattaggagatatacctaatgctaaatgacaagttaatgggtgcagcacaccagcatggcacatgtatacatatgtaactaacctgcacattgtgcacatgtaccctaaaacttaaagtataataataataataaataaataaataaaatagatctattttattagaaaaaaaaataaaataggtctattttattagaaaaaaaaaagaatctttgacctaatacattattaaaagaaaaacctttatcaagaaatgcaattgaaaatgaagtttctagatttaatttttgtttcttccacatctccttctgattcaaatttctaaaatttatatttgtatctaaatttatttacaaatgactcagagttatgattttttatttcttctattaaaaaatgggatatatgtgcagagcgtgcaggtttgttacacaggtatacgtgcgccatggtggtttgctgcatctgttgactcgtcctccaggttccctcccctcaccccccacctcctaacaggccctgatgtgtgttgttcccctctctgtgtccatgtgttctcattgttcaactcccacttatgagtgagaacatgtggtgtttggttttctgttcttgtgttagtttgctgagaatgatggcttccagcttcttccacgtccctgcaaaggacatgatctcatttctttttatggctgcataatattccatggtgtatatgtactacattttctttatccagtatatcattgatggccatttgggttagttccaagtctttgctattgtaaatagtgctgcaataaacatacgtgtgcatgtgtctttgcagtggaatgatttatattcctttgggtgtatacccagtaatgggatggctgggtcaaatgatatttctggttctagatccttgaggaattgccatactgtcttccacaatggttgaactaatttatattctcaccaacagtgtaaaaagcgttcttatttctccatagcatcacgagcatcgattgtttcctgactttttaataatcgccattctgactggcatgagatggtatcacacggtggttttgatttgcatttctctaatgatcagtgatgttgagcttttttcatatgtttattggccacataaatgtcttcttttgagaagtgtctgttcatatcctgtgaccacttttggatggggttcttcattttttttcttgtatatttgtttaagttccttgtaaattctgcatattagacctttgtcagatgagtagatcacaaaaatctcctcccattctgtaggttgcctgttcactctgacgatagtttcttttgctgtgcagaagctctttagtttaattagatcccatttgtcaagtttggcttttgttgcaattgcttttggtgtttttgtcatgaagtctttgcctatgtctaagttctgaatggtattgcctaggttttcttctagggtttttatggtttggggttttacatttaagtgtttaatccatcttcagttaatttttgtgtaagatgtaaggaaggggtccagtctgagttttctgcatatggctagccagttttcctagcatcatttattaaatagggaatcctttccccattgtttgtttttgtcagatttgttgaagagcaaatgattgtagatgtgtggtgttatttctgaggcctctgttctgttccattggtctatatatctgttttggtaccagtaccatgctgtttttgttactgtagccttgtagtatagtttgaaggctggtagcatgatgcctccagctttgtttttttggcttaggattgtcttggctatatgggctcttttttggttctagatgaaatttaaagtagtttttttctaattctgtgtagaaagtaaatggtagcttgatagggataacattgaatctataaattactttgggcagtatggccattttcacgatattgattcttcctatgcatgagcatggaatttttccatttgtttgtgtcctctcttatttccttgagcagtggtttgtaattctccttgaagaggtccttcacatcccttgtaagttgtattcctagatattttattctctttgtagcaattgtgaatgggagttcactcatgatttgtgtttttaactggaggcccttttcaggtttcactttttgaccctaacacctaacatgttcaagaacattcctctccacaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatggtaagacccaaaatttgagaagccacaaaatacccaagttattagacatgcacaaggtaaatttaattgtctataactttattaatagtcaataatggaaatatctctgcgatagtcagttttactcaggcaaaaactgataatcacatagcaattttgcctaaaaagtcaaacacttaagagcaggttcactggaccaaagttaaataccatatcataccactctcagctgactagatggcaaggtagtcaacccttctagataattgttttaagtaggatcttccttgtatatgtagatttcttggcgaaagcaattctgtctcttgaatgtcagcaaagtaagcatcagaaggtgactgaggagaggtgaaaagggattattccaaatgttgtggtctattcccccaaatctgtgatccatcgaccttctcactctttacatctgagctttgtttgccctcatctgaattcccttagaatatgaaccttcaattttctaaccatgccacctgtatggcagcccgcagcaccagaccttcagttagacctgtaaaacagatctgagattcctggaactagaaagctccaacctggcatagcgtaaagagacttggaaaaatggaataaagccacttttgctcaagattgagtggcagattaactcaccttaatgcttttggtaatttaagaataaatagtccttaatttatcattgctgtcatatttctttcctagtgaatcacttagatttatttcatatcaacaaatagcattctaggtcataagtttttgaagccatatgtgatactggatatatcattagagcctactgatttccagttgctacttgatgaaggctggtctctaaaaacaatgccatctgttgctccaatctagcaagtattaaattattgcttaataactggatgggttaatgaccagaaaatgtgaggttagtctcagaaatgctcccaagaaaagggactcttttgtcccacattttagtattttatttaattttaagactaaacttaaaaaaaaaactacgctaaatgatttggtatacttaattcaatttagtttggttcaaatggctttctaaggcttatctgaagtggtgatattggtatgaaaatatcacaagaatttcccttgtattttagtgcatggtacactaaaaatgccacaaacactgaccacattgattgctgtttctgccttaaagggcaaatgtgtatagaaatttaattaaggactaaagttgcactgaaatttttttaaagcaagtaaaaaacaaggtggcttaatttaatttcatgactttgtcatagtacataggtcatttcagagcttatgtcacactgtaagagacacaggaagcaaacgatctcctccgttttaaactcagattgatgccctggcatcctgccacatgaactatgggaccagcgtggttgtaggagttcctccatcagccaagatgctcacctatgacccgatgttgctcttcactggacgcacatggaagggatgtgtctttggaggtcaggaaagcaaagcctctggatggggagtgatggctttcactctggtgcttggcaagtgggagaagcctgtttcctcaggcctttcttccaagaatgagtatgaagtgatctaaaatggaactgtgatcataataacacaaaagataattctccactcctcaccttgatgtaggactaatattggtggacgcatttttaatattaacatctgcaactcaagttccccaaaggcctgaatgagagacaccagtagtgtttctatagggatgaattatgtaacaggaagttccgatttaatccattattattaatatacacaagaatgtgtattaaagtgaatttattcgattcataatagcaccaacaaaaatcctggacccaaagccaaaaccaacaacaacaacaaaagggattgtcacattttatgggaacagttcagattcacactggaaggacttagattatcactcaacaattaatattgttttaggagagatggagccagggccactctgctcaaggtaggtgacacagtgagtccttttttttccctccttcacaaagtctcgttttctagtgccttcatacagagttgtactgggtgctttgaaggtactcccaatattagagtctgctttatacaatataagagaatagtaactattcaagtacttgttaagagtataaaaaggagaaaatgattgttcttcacttagagaagtacataatgtagcgaaggatacaaaaacaaatataaaagaaagaatataaaaataagtgcagctataaatattataaaacaaattataagaggagttttttagcatttattctatgttaaaagttttacattaatgtgtttgaagtttattttatttctcagtaactctctgaggaagctacttaatgaataataaaactgagacttggaactattaagttttttgcccctatagctctcaagttgagaactgagatttaaagctggtccatgggagaacaaagtttttcctctttctgcaacattacttggggcataaaaaagcaagaggctagttggtatggatgaggttttatagagaaggctttttagggaaaatgaaacttgaagaacaaaacaataagagatataagaagttgaacctccttgctttgactatttgtgggaagtgggaagattatagattattcaggaatattagaggtaaaattcagttattcagcaaatatttgttgagtgtatactgagtacaggtaccattgtgtacatagtgtaccattccaggagctaggaacggagaagagacaaaacataccaagtccctgatctcaggaagtgtgagaatcctctcactttggtatagagagactgacaataaataaatgaatgcagaatataccataaggttacaagtgcaaaggataataataaaggatgggtaacgggcagtgccagaggactggggtggaggtggaggtgaatgctattttataaagttcaaggaaggcctccttgataaggtaacattggagcaaaaacataaataagatattcagaaatcttgggaaagaatattccaggaaggagacgtagtaaatacaacagggtgttggcaagaaccataagaacggggaaaaggtcagtatggctacaacagagtgaggacagaagaacagtcacagctggggtcagaggaccttaaattatatggggcctttgggccattgcaaggttttaggagtttattctgagagagaaataaaaccacagaggcttctgagggaggtgtcacctgatctgacttccattttaacactctccttctggctgctctatggggaatactctaaatggggcaaagggcacaagcagggagaccatggaagaagtcattataatgctggaaggaaaggatgctggcttggagtgatggggctggtgagaagtagtcagctcttggatacattttgaagatagagtcaacaaaatttgccgaaatagttattgtatggcaaaaagagtagcatccaagatttttgggcctaagcaacaggaatcatgtcaccatcatcatttattgagaaggaagactatagaaggaatagattgggggctagggtggaagtggtagaaaccaggagtggtttggggcaggttacacttgtgcaggtacctgtgagatacctgaataaagatgtctataaaatgtaggcaattggctatgagtctgtagtacaggtagaggtttaggatgggtatagaaacctaagtattttaagaggagtatatcgaaagccacaagaccagaggaggtcaccctagaagtaaatgtagataaagaacagaaatggaccaaggaccaagccctaggaatcgttggagttagaggtctgggagatgtagaggacccagcaaagatctgtggaagaagtaactagtgagcaaggaaagtgacaatgatgatgacgatgtagtatctagaagctaagggaacagagtgtttcagaaaaggggagccaccaacagtatcagttatacctaacagttcatataagaggaggactgagaaatgacccctgtctgggtcaaaatggagctcaaagatgaccttgatgatatccattacaggacagtgctgggggcaagagcgtaatcagagtgggctcagagagggtgagaggaaaggaacaggatccagaaacagtgaactgaagacaattctttctgtaaagtaaagaagtttctctgcaatagaagcaaagatatggggtgactggaaggagatgtgggtatcagaagagtttttttaacctttgtttctttttaatttaatttaatttttattttactttaagttctgggatacatgtgcagaacgtgcaggttcgttacgttggaatacaagtgccatggtggtttgctgcacccatcaacccatcatctaggttttaagccccgcatgcattaggtatttgtcttaatgctctccctccccttgcctgccacccaccgacaggccctggtatgtgtcattcccctccctgtgtccatgtgttctcattgttcaactcccacttacgagtgagaacgtgcggtgtttggttttttgttcctgtgttagtttgctgagaatgatggtttccagcttcatccatgtccctgcaaaggacatgaactcattcttttttatggctgcataacttttgtttcttatgctgggacaaatacagcttatttgtacactgctgggaatgatctaacacagggaaagtcatagtgcaggaaagagaaggaataaatataacataataaaagataaggattatttagtaatgtctaaagagaaaatgtgtgcttatttgcaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaaggtaactgtttcttatgatgatcttgtctcttctccacaggctacttttaaaatttagtacttataaatgtgcctgttttcttcatattttatttctaattatttaatctagccagattgatacagctaattacttctctttacccactgcattagtgtattttcatactactataaaaaaaaaaaactgcccgagactgggtcatttataaagcaaacagattcaattgactcacagttcagcatggctgggggcttcaggaaacttataatcatggtggaaggcaaagaggaagcaaggcaccttcttcacaggctgcaggaaggagaagtgtcgagcaaagcgggaagagccccttacaaaaccatcagatcttgtgaaaactcactcactatcatgagaacagcatgagggaaactgccccatgattcaattacctccacctggtctctcccttgacatgtagggattatagggattataattcaagatgagatttgggtggggacacaaagtctaaccatatcaccaacttagtatgccattgtactatattaatcaattttttaaaatcttttggattttgtttacctagttgatttcattgtggctatttttatttcatcataaagctgctatttatttcaagtaggccacaaaatttccttattttacagttttcaaagtgctttctcaaatgtgcattattcagatccctgtaagccaggtattatttttaccatttttagatgaagaccaaggttgtgaaagcaaataaataactggtcaaacctcctggggtagtgccaggatataaactaattgcaaaacttgtgctcttttgaccatataacaaacttctctgacagagcttggcaagctttgggtaaacatgggtgtgatgattactactcttgttgcttctgagggttgggcaaggatagaggtcaagtatgaattcatgcaaattttatctacaacatctacctcatggaggtctcaaacagcaatcaaaaagcctgtctacaagatgaaatgactttcactcattgggcctataaataattattgagcttccactatgtgccaaggacgtggatttcattagtaaaaggaactgtatattgagatccaaatttttactaatttttttttttacctgagagatttttcaatgttgtgtcttgtctccacatttggtctagcctacaggatcatcatattatgaacatacatttttttaagcaagtaaacaatgggattttgtaagaaaaactgtcagaaccactcagtactactttactcagataagcaaaactaacagcttagtatggcctgcttggaaaataattactatttgttttccaaagaaacataaattctgctttcaggaattttgcttcaaatatcaccttaaagcagggacatccaaactaacatttgtaaacctaaactcttcaatttccacctacttcctgcacagctctatttgaatgtcccacttggaaatattttttcgccagtaatttttatctcagtcattatattatgcgttcctcttttatagatgagaagccatagcatcatgtctgacttctttttcactcttgcctaccacatacaaaccaattctaagccttgatgatgcaacccttgatttctccttcagaatccctcatctcattgcccacgctcattgctttaattcagtctaatcatttctgacatggacatggtagtgagataataggttttccaccttctgtattaaaatacattccagttagtctttcactaagctgccaagctcaagttttgccaaaatgccaatgtcttagcatggttttgaaagcctttattattgaactaaaacctattttgtttcaacagttaagaatttggcattcattctatcaccctctgcagcaggcttttgggataaagtgagggaagtaggtctcatctacttgcaggatctcttgggcacccagaaatctaaacatattggattacctttcctgttcacatgttcctaggcttgttcatgctttctcctcaacctggaaaccacttccctcttgttggcatactgaaattatactgatgctttcagaattagctcagatacccttatcagagttgcgtaacaaagaaaactaattgttaaggactttgagcccagaggatttccaataacagaatttacttgaagtttctatgacagatagaaaggacaattgtttaaactatcctttcttgaaagatatgaaaacaagtcattaaaaactctcattttacatttcagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatataactcaaaacagatatagcgtataaagatatagtaaatgcatctcctagagtaatattcacttaacacattgaaactattattttttagatttgaatataaatgtattttttaaacacttgttatgagttaacttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagaatcatattatcatacttatcataatgttcaatttgatacagtagaattgcaagtccctaagtccctattcactgtgcttagtagtgactccatttaataaaaagtgtttttagtttttaacaactacactgatgtatctatatatatctataacatgttaaaaattcttaagaaaattaaaaattatataaaatgttttgtggtgatatatttttaaacaggcatatgttgttattaagcttttatttgttataaacaaagtgttgaagcgcctgaaaacataaaaatactttataagacatataagaagttgggtggtcatagcagaaattgaggcttccaatgttagggcataatatagattggacacttctaccatggtaaattgcaaaatgtccaggtatttatgaaccacttttacatgatgaatatttcccagtgaaaagtggcatgaactcgaggagtaaaatttcctttttcttttaccagtttgtcaatctaggcttaatctaggtttaaaaaaaatagctgaaaagtgtaaataattattttgaagtatcttcatcatcagctgagtttagctatggcaattctcaaaacactatgaatatttacagcttataagaattatatttttatgtatacatatatatatctatatttatgtcaataaatagatacatagatagatgatagatagatagatagatagatagatagatagatagatagatgatagatatagataagtatagaaaatctctatccaagaatcatttggagacatttcctctgtccattagcaatatctgtagctaggatctcagaatccattaaggaaggaaaactgccccccaaaaaagcatttttaacaagaaaaatatgtagaatggattaattcctttatgtctcctgcctcaaattttgaaaaacatgtaaataaggatactaaaagtaatatgcaaatataggtacatcaaaagaaataaatccaagaaggaataaacacatttatattctcagatcacagctttttaaatgaaatccactttatgcttagataaaattatattttgacaaatatgctgcatatgtgacaattttatttatttaatatttattatgatactttgtggaatcattcctcatgtctgagcttgtcatggccaaataatgaacagaaagaccttctactatctttctcagggtaacctgcacatgaatagcattttgagtcatcagaaaacactggttctaagaagagatcaggaaatctgattatttttgcatatttcttatttctggtcaatgaaaccacaaagcattgtcaaactgagttcttgaatataaatcaaaatataagtaagcaataaatagctagaggaatgctaaaagaaatatccagcttcttctttaaagaatagtctagacttctaatcatttaactgatatgtggagaacattcattgggcaattttttttttaatttcaaccagtattaagcactgagctaggtgtttggtatacagtaatgaataaaacagaataatgaatgtcctttggagcatatggtctagtagtgatggcagctcctctctgctaggaactgaacactcttcgggacaccctggctgcagaaaggagtgacccactgcaggtctcctctgagctgttctatcactcaataaagctcttcttcaccttgctcactcttcagttgtctgcatacctcattcttccagttcgcaggacaagaacttggggcccaccaaatagccgggctaaaagagctgtaacaccaacagggctgaaacacgccccttgctcaccatgttgtgggtgacaaggagagaaaagagatggagagaagagctgcgaccctttggggagcccagacctaggagctccctaagccaggctgtaacaccctctttggaactctatggttcctgatgtctccaagcttccaggcaccactgcattcttggtgtcagctgtggaagctgcttatggtatgcctggtccagccacagacttgcaggaagcgggtgctcatgccagcacctggagctgcccaccctgctgcagccagcatgcctggctgtgtgcagtggccagaccccatacttcc

SEQ ID NO: 16751 - DNA, 7153 bp, Human
  misc_feature (1)...(7153): n = A,T,C or G
ggagggtggggccaaatccgggatagatggggctccaggccaacagcagctggggctcagtgcccaggactgcggcaggaagcaccaaggcttccctagcccctcctcacacccaccaagcctcccggccctatcccgggtgggaccctacccctcccaattcccaggagttaggggaggccaagctgtcatttattcgtcctgtcccatctctcccttcctcccgcttcccactcccctggcaaccaaaccagacccatcaaggagaaggaactggcagctgtgcagggagagactaatggcccggaaggaaggaggggcctggaaaggagacgaaggcggtagggacgtgagcagggcgttggccctggcccatctcacaggacgcacaaaggggggagggggctgctgccctgcaatactgaggagctggccagccagggagccgccctccttacccccagccagatatccaggcaggaacctgaaacctgcttccccagatgcactctcttgtcctcaggtcccatctgaggcagacctgtctcacaggacagcgctggagtccccagcagcagcagcagccccagccctatggttcctggcaaacccagcagacctcagcaacccggctcctgcagaccatccgagctgcctctgtccactcctgggcaggttgtgcttgcattctggaagctgtttgacatacaaaggccagatatcagccttctcgctaactctggagtaggggagggtgtggtgggatgtgtgattgtgtgtgtatgtgtgtgtatgtagtgtgtgtgcgcatagatatacaaagctgtgtgtatgcatctgtttgcgtgcgcaggtttgtggacctgttctggggccttctctctttcagactgctggggatgggcactttctctttccccatctcttccccatccagccccacccatccctggtacctgcaactcatcaatactggaaaccagctcctgccagtccatccatctctcagccttggcagccgctgttgcccctcagccccctccccttcctacctcaggaatcactctggttcctgtaaagcccatgactgagcagcaattggtgtggggttggggggagggagaatccagtaaaccaagacagaatacaaaaggcccacttagcccagcccgtggcatggggcagaccctcccgagtgggatccagagctgggtccagccaccctcagccccctatgatgtacccacctcattggggcttgttgcggggtaggtctaggtttgggggctgtgtctttaaggctgaaacatcagcagacaacctctgctgggccgtcttcaggggagggggaggggggctggtcagcccattagcagcagagctggcgccaggcaccagcccttcacagggccctggggattagggagagtagctcttccccagcccgatctgcctctgcgcccctgtctcctattcctctctgggtgtggtgaaggaggggtagctgacagcaggtgaaaatagagcctggccttcagggggcaagtcaaggcactagctatggggcctaagccaggtcaactctccctccagctggcctcctccctactcctgtgccagaagcctgccctttaacttcaggtccttctacctcgcaattttcagggactctagttcaagtcaggccttcctaccctaggttctagctttgggtgcttgttgggaggaagtgacccccaccccagcggcaacagggggcaatcaagtgggtagaggcctgcaaccagggaagggaggggaaggcgctcctgctgttccgcaggggtggggcatccccctccccatacaacccccctccagcgggccatcaggccagtgggaggagctgcccgtgccccccctgagaccgcagggctataaagccgcctcgcagcggtctgcggctccttcccagcccccggcctagctctgcgaacggtgactgcccatccttggccgcaatgagccaccacccgtcgggcctccgggccggcttcagctccacctcataccgccgtaccttcggtccaccgccctcactatcccccggggccttctcctactcgtccagctcccgcttctccagcagccgcctgctgggctccgcgtccccgagctcctcggtgcgcctgggcagcttccgtagcccccgagcgggagcgggcgccctcctgcgcctgccctcggagcgcctcgacttctccatggccgaggccctcaaccaggagttcctggccacgcgcagcaacgagaagcaggagctgcaggagctcaacgaccgcttcgccaacttcatcgagaaggtacgctttctggagcagcagaacgcggccctgcgcggggagctgagccaagcccggggccaggagccggcgcgcgccgaccagctgtgccagcaggagctgcgcgagctgcggcgagagctggagctgttgggccgcgagcgtgaccgggtgcaggtggagcgcgacgggctggcggaggacctggcggcgctcaagcagaggtcagggggcagggctgggccgctgccgtcgaggcgaggtcgaagcggccgtcgaggcggctgctcttccctcccctcgcttcccctctccatcagcagcccaagggtgtggctccccttaccaacccaggtgtgtgcgggcagcatccctgcccacgggctccaagtgccccccgctacccctttgctctgagtgtttggggaggtgggagaagtgggtatctgtgcctcccctgagtaatgaggaaacccccttttcagctcccagtccgttagagacaatgcggggcaattccattagacagcctcagccctccatttagagtcctgggcagcagaacagcctctaaccggatcctggggggcgtgcggtctggggtgcgagctgggcggcgaccccgcagttcagcctctgcacgctcttcccgtcaggttggaggaggagacgcgcaagcgggaggacgcggagcacaacctcgtgctcttccgcaaggtgagtccgagcccctctccgagttcagcctccccaccgctacccccgatctcagtatccagaggtggcatcggtgggcgcggggagaagggggtaacccagatgcctcctgaggcagacagggaaggcctggtccttccttggtctgcgcagcccctaacttatcttgaacctccactgccacccctcgaaggacgtggacgatgccactctgtcccgcctggaactagagcgcaagattgagtctctgatggatgagattgagttcctcaagaagctgcacgaggaggtaagtgggcccggtatcaggggcggtttctgaggttgtggggtggtctcgctggagctggcgggtggagcggaggcatcgccctggggatcaggacgatgctgggtagacgcagcccctccaccctagtctacaggtggttagactcccacccttgcgccacctggcggcgggcagcggggctgtacctccgaaacctggcctctggtctcgcgcccgcgggggcgcagggctgtacgccctgccctccctggcgcccacttctgttcgttcaagcgtttcttctcttttctgtgcacgaactgcgtggcccgcgtggaatttgcgccgctgtccatcctctgcctgctcccggccgtaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaaggtgcaagagccgggagggcctgcgaggcgggacgctggggtggtgtcgcgcgtcccagccgactaaagcctgggttacccccacttctcagtacgcggacctgtccgacgctgccaaccggaaccacgaggccctgcgccaggccaagcaggagatgaacgagtcccgacgccagatccagagtctaacgtgcgaggtggacgggctgcgcggcacggtgagtacgaagctgcgcgctcgggcccggggagcggacgatgaaatgttctgcaactggccccttccactctcctaccccagaacgaggcgctgctcaggcagttgagagagctggaggagcagttcgccctggaggcggggggctaccaggcgggcgctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggtgagggtggagctgctggggcggggcagggcggggtcgggactgggccgggcagggcggggcctgggcaggggcgctgacaacttgcttcgcctctaggatctccgtgcccgtccattcttttgcctccttaaatataaagacgactggtgagtctggcttacagcctgtacctctccttgtccacttctgccctcctcgggctcttgctctggctcacctcagggatctcttctccccacggaacttctgggtcctggcctgtacccacccctactcctcaaacccgcccctcccctgccctcagggatagcagtgggagcctaagaggagagattcccacgccttcccccttgaaccctttatcctgctttcttcagtgcctgaggtggagcctccccaggacagccacagccggaagacggttctgatcaagaccattgagacccggaatggggaggtgaggcaggtcccctaatgccaggaccccaccatttcccatattatttctgagccccagcctggctgtcgctaatcttacttagggtgggtaattcttggggagagacagagaaggagacagagaacgtggatagataaccaggagcctctgctggttaccccagggagtggggctctatgatccaaaggagtaggatggagggtggcgctgaatggcttgtgcccatcatatgccctgtccccagcaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagagaaaactctccagtgcatttgtttctgtggaagtgtgtgtgcggtacctgaggggaggagcctcggcggtgttctccctttgtctcgagtcatttcttttctggctgtcactctcttggcatcaatatacccttctaggttttctacctctgtccattccttttcagcttttgtccctcacctgcagcctggaatgcccagccacctgctgggtgcctcacaggccactcaaactcaacctgtcccaaacagagctcctcacctccctctgcaatcatgctcttcctctggattccttgccccagaagaaggcaccactaagacacctagtgcccaagttagaattcacctcagcttatgcacccttcttttcttcacctgaccccaaattctgtgaagtctacttcttttgttatttaaaaaattttaataggctgggcgcggtggctcacgcctgtaatcccagcactttgagaggccgaggcaggtggatcatgaggtcaggagatcaagaccatcctggctaacatggtgaaaccttgtctctactaaaactacaaaaaaatggccgggcgtggtggctcacacctgtaatcccagcactttgggaggccaaggcgggtggatcacttgaggtcaggagttcaagaagagcctggccaacatggtgaaaccctgtctctactaaaaataaaaaaattagctgggtgtgatggcgggtgcctgtaatcccagccacttgggaggctgaggcaggagaatcgcttgaacctgggaggcggaggttgtagtgagccgagatcgcaccactgcactccagcctgggcaacagagcgaaactctgtctcaaataataataataataagaagaagaagaagaagaagaagaagaagaagaagcccggtggccaggcacggtggctcatgcctgtaatcccagcactttgggaggccaaggcgggcggatcacgaggtcaggagatcgagaccatcctggctaacatggtgaaaccccgtttctactaaaaaaaaatacaaaaaattagccaggcatggtggcgggcacctgtagtcccagctactccggaggctgaggcagaagaatggtgtgaacccaggaggcggagcttgcaatgagctgagatcataccactgtactccagcctgggcaacagagcgagactccgtctcaaaaaaaaaaaaaaaatagccaggcgtagtggcacgcgcctgtagtctcagctacttgggaggctgaggcagaagaatcacttgaacccaggaggcagaggttgcagcaagccgagaccgtgccactgcactccagcctgggcaacagagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttcaagcaattctcctgcctcagcctcccaaatacctgagattacaggtgtgcaccaccatgcccagctaattttgtaaagtttttttagtagagacagggtttcaccatgttggtcaggctggtctcgaacccctg

SEQ ID NO: 16752 - DNA, 20347 bp, Human
tggacgggttgggtggggggtagggtgagggctatccctgagtggcatgcccatacctagtgaggcagggtgtggcccggagctcccactttccctcagtcaccaaactgctgctggtctggtgggaaggggtggtgatgtgggggtgggggagcttagtgtcagcgcggggagggtggggggtatttatctatttatacatgggattgtacatagtcttgtggggcatgggggagccggctggaggtgagaaccctcccctctccccccaccccccggggagagcaaatgtaaaactactaatttttgtgctttatatattctatataaatatatctattttctttttacaaaaccagtttataaatggtaggggggtgtggggcggacacatggagctccccttgtgggggggccccctccattacccgacctaccgcccttttcctcaccccccaccccactccccaccccctggctgtgactgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcaccggatgtggggcggggcctgccccaagagagtttcctaaagcgaggaaaccaagccgggcgcctcttgcaatggagacggtgaggagtgcaggagggcggtcgggggcgctgtggagcctaagacacccccccaacccttaggagaccgggagggccgggcaggggctggcgctggtgtctagcaaacaaaaagcagccgggtgtctgccctatcccgtgaccctgttcctccgcttcttcgttgggcgcatctcctggaactgggccgcgtccccgccgcctttccgtacgcggtacccttagcccaagcaggcagtgactcctggctccctccttggggcccacgtatgccgtggcaatctcgggcctcctttcctattggcacctcaagcccttttagaggtttgagagcgcagggttgtgagccggctttgctgggtgaggcacggggcgtccagagggatctccgcttgcaggtagctcctggacctcgatggtctttctgtgatccctgcaatccccggcaggaggacatctgaagatctttatactgcgtccagtgaagtcacattcccttaataagaccgagaattgaggtttgcttgaaagaggaaatcttgcagtgttagaggccgatgtgtccctggacaattttaggtcatggcccgctctgcgactctaagcaggggttttggcatagctcattcttggcgagcaggcattgaccaattgtggcagggccctgtcaccctcccacagatgctgcgggttgcctgctacatgtttgcacccaccctcactctcaggagtctttttctagcgctctgtaacccctcccatacacttccctctccacagtttttaaccatgtgtcttctttcaggcagagtaactctttccatcttggtttttatcatctgctactgtagttacgaaaggactgcaggttcactttgctttggattacatgcccagagtaattctttgccacaccgtttctctgctcacagagaggttgtttctttcaggttttcaaaaagaaaaccgaccaaagtactaaaatgattcgcagttggtctcccaggcaagggagccaattctgactaatcaggataatcttaaacaaaaataaggagtctaattccattaaatttaaaatgacatgtcatattctacttacttgtaaatgtattatggtttacaaagcatttttatatagattttctaatttagcctttacactttatgtactggattaggctctggggtagaagttaaaaagaggaaaaagaaaactcagccaggtgtggtggctcacgcctgtaatgccagtactttgggaggccaaggcaagtggattgcttgagctcaggagttcagcatcagcctgggcaacatgatgaaagcctgtctcgacagaaacaaaaatacaaaaattacccaggcgtggtggtggtggtgtgtgcctgtagtcccagctactcgggaggctcaggtgggaggatcgcttgatccaaagaggtggaggctggagtgagctgagatcatgccactgcactccagtctgagtgacacagtgagatcctgtctccaaaaaaaaagaaaagaaagaaaactcctgctttgaaaatgttcagcctaactggagtgatggtgagggcaagccagcaacagctgttatttaaaggtagactataataaatgctgtcatcaatatgaaaacagaggactgtgacagaatagctgagagaaaaattactttggacctaggagagggcactgcaaattgagagaacagtgtgagcaagggcactgaaattggggtatgtagagaactgggggtgagccagcggcatgatgttgctggctttggattttggtcacagtgggagaaaagactggaaaagcaggctaagatcaggttgaaggtattacacaccatgctaaatttgaactttgttttgtaataggggacccatggaagatttatgagcaagtcagtgaatgtcctttaggaatgttcatagcagctttctgtacatggactgagctacttcgaaaagtaaagtttcttgttaatggggatgaaagtcccttccaaatctgagatgctttggtgaacaaacttggtgaaagcatgaaagataaattgaagaacagatagatttgggccaaggaccccagtttaaacaacgttgcagaggtgagaggtaaaagcctaaattaaggctgtgatattggcaatgagagagatggatctgagacatttctaacataccagcttagctgataagtgttaagaagacagctgtgcaaaacaaaaaaacaagatgggaaccacagcgagaataataggattggagggacaaatgttttgtttcgtattcaagcatttgaggagtctctgtgacatctatggttgtcaaacaaataattggaaatgtagatcagaagtttggaagaaattgcgagtctatttgtcagatgtagactgtgtctctgtaatattttgtacttgcgtggtacagtggtactttctcaggtcccttatgttattaaaagtagaaaggaggccaggagcagtggctcttgcctgtaatcccagaattttgggaggccaaggtggccggatcgcttgagcccaggagctcaagactagcctggtcaacatagcgagaccccatctctacaaaaaaatacaaaaagtagctgggcctggtggtatgttcctgtagtcccagcagcccgggaggcagaagtcggagaagctggggaagttgaagatgcagtgatctgtgatcatgccgctgcactccagcctgaatgacagagtgacaccctgtctcaaaaaaaaaaaaaaaggtagaaaggagtagatgtaattacataatcccccctctgatatggtgaaacaggcagaaagttaaaagtcacggccaggctcggtggcgcatacctgtaatcccagcactttgggaggccgaggcgggtggatcacgaggtcaggagtttaagaccagcctggccaacatagtgaaaccccgtctctactaaaaatacaaaaaaaaacttagctgggcgtggtggcaggcatctgtagtcccagctacttgggaggctgaggcaggagaatcgcttgaaccccggaggcggagattacagtgagccaagatcgcatcactgcactccagcctgggagacacagcgagactctgcccacccgcccaaaaaaaaagtcacatatgcagttgtgtttgactctcttatgttggtatctgtatctctagttagctctatgtttctttcctccctctgtaacttagtcttgggcatatctgttcatatcagtgtgcatcattctttgagaattaaaaaacaaaacaactgtgaattatatgcaaaaccctgtgcttggtggtatgggagatacaaagtataagatagttctaggtttccaggaatttataatctgtttggatagataatgaacaaaataactgtagcacagtacagtatatatcatatgatgggtaaattctacagaagtagctgtttttgtgcctttgtgtagatctttgtgagactctgatatatcatgtgtctatctttatcacagccctctctcccacttataagtgatgaggctgttgttctgatagtcttgccaaaatggcaggccaagctgacagtcttatgcagtccagtgggaagagggagattatcccccttactccctgcactctcccctagcccattaagggagaaaagtttagggctgtcttaaacttccctggtttaggaagtttgtcagccaacctcccaggttgaagtttttaatgtcatgttactacagaagctatggggatgaagtatggttttattttggagatatcacccagagaaaatggagccaagactgttgatgctagcagatgaaaattgttgtgatcccttctgggttcctaaataacaatggcatttccaaatgttcccacttgagggagcacagaaatggttctaagttttgtctagtcaaagcactctctaatctcagactatcttgggaagggaaacttggaaaaccagcatcccctggctatagcagcctttgactcacaagggtgctgagtggactcaagttcccagtttcagtacattcgtgttccttatccacctctcagtcattcaggttttgactggctgacagtcagctactgggatcctccccagttgtggctctctctctgccatggagctagacaatggtggaaccagtgtctgtggttctagtgcctacaactatgcctagtgagtgtctgtgtttggggaagacaatgctgtctctctggcttccatgttttaataaagtagatctgtgagaatcttgtaggggttagccctaagctcagatctttagtcttagcttttaggacctagtgtttcattaggcagtatagtgtacaagaacatgagctttgcagataatgctcgttcagctcagaagtggatagaagcatttctggaaggcacaatattgtagcagtattggtttcttctcttctgtgattccagagaggtagaatttcatcagaatggagtaaatacattcaaaaattttataaaaatggccgggcgtggtggctcatgcctgtaatcccagcactttgtgaggctgaggcgggcagatcagttgaggtcaggagtttgagaccagcctggccaacatggtaaaaccccatctctgttataaatatgaaaattaggtgggtgtggtggtgcacgcctgtaattccagctctcaggaggctgaggcacgggaattgcttgaacccaggaggaggcagttgcagtgagccaagatcacgccactgcactccagcctgggcaacagagcaagactctgcctcaaaacaaaacaaacaaaaaaatttacaaaaatgaacactgccaagataaacccaaccaaactcttcatcagttataagaaattattttgttaggtatacgtagttttttaaaaatttgttttttcaagtatgttatttattaaaattttgatgtaaacaaaagcaaaccacaagctctggaaccagaagataggtgtttgaatgcctactccaccccttatcagccatgtgaccttgggcaagttgcttaatgtctcttgaccctcagagacaatctgtgaaaataaggctaataatagtatttacctcagggttgttatgaagattaaatgagatcatatttctgaagagccttataaggctgggtgcagtaactcgtgcctgtaatcgtagtgctttgagaggccaaggagggcaatcacttgagcccaggagttcaagaccagcctgggcaacatggcaaaactccatctctactaaaaatacaaaaattagctgggtatagtggcttgcacctgtagtcccagctactcaggaggctgaggtgagagaggatcacctgaccccgaggaggtcaaggctgaagtgagctgtgatcacaccactgcactgcagcctgggtgacagagcgagaccttgtctcaaaaacaaaaaaaaaagggtttggcgggggcagtggctttatagtgctttaaagaaagtcattatttgttcaccagcccttcccctaatgttgctaggctaaaatggatggaaccaggttaagctgaatctgttttcttatctctccaggtcatttcttcagatagctccccagctgtggaaaatgagcatcctcaaggtaagtttactgaagaaaggaaactgggcatgaaaacaatagcctgaccctaacaatgtcttcaacaatgcttttgaatctctcccctggaaaaatcaaagcagggccagataatgtgccaaaccacaaaaatcagtgacagtagtttggcaagatcacccaggaataaatcttgggcagagtggggatgattaatatcttcaattatcaaaccacttgagagaaacatctgaggtacaggcaaaacttccataggcaactctgggctggctaccatgttttagaagtcctgggtattttctgcatagtccagaaacagtgctaccaggattttatcacccagcaagctcactaaagccactgaatgtacaccaaaaattatgcaaagggcttggtgcagtggcttacacctgtaatcccagcactttgggaggccgaggcaggtggatcacttgagctcaggagtttgagaccagcctgaccaacctggtgaaaccctgtctctactaaaaatacaaaatcagccaggtgtggtggcgcatgcctgtaatcccagctacttgggaggctgaagcacaattgcctgaaccagggaggcagaaattgcagtgagccaagatcgtgccattgcactccagcctgggcaacaagagtgaaacttcgtctcagaaaaaaaaaaaaaagaaagaaaaaaattaggaaaaggctcttagaactaatctagtaatagaagcactaaacctctaaaatccagagcacagggaagacagttccaatgctggccagtgcctattttatgtttctgagtacatttgcattagcaccaaggcagaaactagaaactcaaattgcctacatggaccaagcagtgaagtgaactacatatgaaaagaaggcgacagctgggccgggcatggtgattcatgactgtattcccagcactttgggaggccaaggtgggtggatcacctaaggtcagaagttgaagaccagcctggccaacatcgtgaaatcttgtctctactaaaaataaaaaattagctgggcgtggagctgcatgcctgtaatcccagctactcgggaggctgaggcaggagaatttttagaacctgggaggcagaggttgcagtgagccgagactgtgccactacaccccagcctgggcgacagcacaagactctgtctcaaaaaactaaaggcagctgggtgtggtggctcacgcctgtaatcccaccacattgggaggccaaggcaggtggatcacctgaggtcacaagttacagaccagtctgatcaacatggtggaaccccatctctactaagtagaaaaaattagctgggcttgatggtgggcgcctataatcccagctgcttgggaggctgaggcaggagaatcacagaatcgcttgaacctgggaggcagattttgttgcagtgagccgagatcatgccattgtactccagcctgggcaacaaaagtgaaactccgtctcaaaaaaaaaaaaaggcgacaactatctaggtctggtcaactaagacctatttttgccagatcttcaagtctgggcacagtgtaacaccagcactttgagaggccaaggcaggaggatcacttgagctcaggagttcgaaaccagcctggataacttagtgagaccctgtctctacaaaaaattaaaaattttttgcactccagcctgggcagagagtgagatcctgtctcaattataaacaaacaaacactgagaaagccaaatccaatatgtttatgggcctgtggcctgaatgatagtatttaactatcaatgtagtgtatgtatcttcaactggtgtccaaagacatgttcttgggagtctgaattctcaagtttgaataacaatggtaggcttccagttaaagacggtagattggtagattgggctgcgcgtagtggctcatgcttgtaatcccagcactttgggaggctgaggcgggtggatcacttgagaacaagagtttgagaccagcctggccaacatggtgaaaccccgtctctactaaaaatataaaaattagccaggcatggtgacatgtgccgtaatcccagctacttgggaggctgaggcatgagaatcgcttgaactcaggaggaggaggttgcagtgagtggagatcgcaccactgcactccagcttgggtgacagagcaagactctgtctcaaaaaaaaaaaaaggtggtacattgaatatatattcccaaaaactcccctaaaaccaccataaaggaatttttttaaagaaaaagacacaaacacaccatagggaaaacaggagaggagataatagcaatgaatttttggaagctgaaaagcagacaaaagagtgatgaatgacttagacctgagaaaactgaattataactagcagtgaggaaagccaagaagcattgaaggtctaagaaacagtcagatcccaagacaccctaccccattgagtacagtgggcaactctgcctcccaactgtggcagagactggaaatctggcaagggactcgggcacagcttagggctgaagtactgcactgaaaacaggagcatgtagtgaactatactcgatgctgagcctccagccctttcccccttttcagtttccagagcgctggcagaagagccttcaccctccaagcatgaaattgaataatccttctctccagaatcctcttgaagggaagtcctaaaatatataagtattgaatgttccctatccaaatgactcactgtcagcaaggctcacttacacacttagagcttccactcagctttaaagcctccactcttaagttatggtttaagttctcctttaaactagggattaccaaacatctaaagaaaggatctgtgaaaaaaagtgatccaaactgccccccaccccactctggaatgtacctttgttttactctgaaggctgtatctccctggtaaaaaataaataaaaatgaaaaagcaaactgcctctcccaacctcatgtacacacagaagaaacaaacaggaaaaaagcaactggaaggaaaagatgagaagaaaactttaataacattaatataatcttagataaaggaacatatttctcaatacctgtgaaagtagtatatctttaaagaaaacaacagccgggcacggtggctcacgcctgtaatcccagcactttgggaggccgaggcaggcagatcacctgaggtcaggagtttgagaccagcctgcccaatatgatgaaaccctgtctgtactaaaaatacaaaaattagctgggcatggtggcatgtacctgtaatcccagatactcgggaggctgagacaggagaatcgcttgaacccaggaggtggaggttgctgtgagccgagattgcaccattgcactccagcctgggcaacaagagtgaaactctgtctcaaaaaaacaaaaacaacaacaacaaaaaaccttatttccaccatgaaacaagtataggatacaattttttaaagaaggaattttcagaaaacaaaaaggaactcttggaaattaaaaatatagtagcaaaaatttaaacccagctggaggtttcaaaaatcaacatgaggaaatttcccagaaaggagagttaaaaatcaacaaagtagaaaataggagagaaggtgcagtggctcatacctgtaatcccagcactttgggagactgaggcgggaggccaggagttcaagaccagctcagcaacacagcaagaccctgtctctacaaaaaaataaaaattagccaggcatagtggcatacacttgtagtcccagctactcaggaggctgagataggagaattgcttgagcccagaaggtcaaggctgcaggtgagccatgatctcgccattgtactccagcctgggtaacagaatgaaagcctgtctctttaaaaaaaaaaaaaaaaaaggagaggaaagattccaacaacccacaaaacaaacaaacatttaaaggatcagtctaggaggtccagtatctaaataggagtcatagaaaaagaaaaatggcaacacagagggaaggaaataattgaggaactaattcaagaacatttattggaacttgaggacattagttttcatattgaaaggacccatcgaatattcagcacaatggatgaaagtgacccacccaaagcacagtcatcctgagatttcagaacactggaaacagagatcctatgagttttcagagagaggaaaaaaaagtcacatacaaaaagtcagaattgccttggactctcaacaacaccagcagctagcaggcaatggagcaatgccttcaacattctgcaggaaaacacattccaagctttcctgcagattctctattcagccgaattataaatccaaggatgagggtagaataaagatatctacaggctgcaaggtctcaaaaacacatacctcccatgcaccctttctcaggaagctactggaagatgtgttccaccaaaataagggagtaatcaaaaaagataaaaacgcgatataggagcaccagtagaggacagacgtgaaaggggtacccaggatggtgatgaagaaagatcccaggatgacagcagtgcacaccagacaaaccagcccagatttgagcaggtcagaaggctccagggagatttctttgggtagtttaaattttgatagactgtctaatgcttttgaacctcttaaaaggagatttaaatagttggtgaagcatttgggggttggattagttataagaattatacatagaaaattaaacaaaaggacaagacattaactccaggtaaaacaaagttgtgaaggaagaaaaaaaaatcagagtttactatttggcttatctctgaataataaatattcagtcaaaatgatttaaatactggccgggtgcagtggctcattcctgtaatctcagcactttgggaggccaaagcgggcagatcacatgaggtcaggagttcgagatcagcctggccaatgtggtgaaaccctgtctctactaaaatacaaaatttagccgggcatggtggcgggcacctgtaaccccagctacttgcgaggctgaggcaggagaatcgcttgaacctggaaggctgaggttgtagtaacctgagatcgtgccactgcacttcagcctgggtgacagagcaagactccctctcaaaaaaaaaaaaaaaaaagattgaaatacggatataaccaacattatggtttagctcctggaataatgaggagaatgggaagtacgtgtttgtggtggagtcctagtaggagagagaactagaaattctcatcttctttggtagatagatgataaataatgccccaaaatgaaaaaaaaaatggaaactagcaatacaagcatgttatttaaggacatagaattaagtaccaaaataatcaactaaggtagatagatgttctcatctctggggaagggtagtacagggaggtgggttgcaaggagtgcaattttttcttaacaaaatttgtaaaactgttggactgatttaactgtgtgtctatataactttggttaaaaaaataaatattaaaaaccaaattgattaaagacttaagagcatgaagtttggaaacagatctgggtttgtttgagtctttcttgccacttattaatggtgtgaccttgagcagtttatttaactacacctattttctcatctgaaacatgaggacattacttacacatttgttgtaaggattaaattatgtaattttttttttttttttttgagacggagtctcactctgtcgcccaggctggagtgcagaggcacaatctcgtctcactgcaacctccacctcctgggttcaagcaattctcctgcctcagccccctgagtagctgggactacaggcacgtgccaccacgcctggctaatttttatatttttttagtagagacggggtttcgccatgttggccaggctggtctcaaacttctgacctcaggtgatccacccaccttggcctcccaaagtcctgggttacaggtgtgagccaccacgcccagccaatgtaatttatttatttatttatttatttttttgacacggagtttcactcttgttgcccaggctggagtgcaatgttgcgatctcggctcatcgcaacctctgcctcccgggttcaagcaattctcctgcctcagcctcccgagtagctgggattacaggcatgcgccaccatgcccggctaattttgtatttttaatagagacagggtttatccatgttggtcaggctggtcttgaactcccgacctcaggtgatcctcccaccttggcctcccaaagttctgggattacaggcatgagccaccacgcccagcctcaatgtaatatttttaagtgcacgtagtatagtatgtagcacattcaagctattattttgggagattacttccctagtttagagcaagcaattaaaatcacaggaatagaaaaaggtaaactagccaggatctcccatttgtctagagtaggtgggatgatttctgatttacagggtgatcccagaatggactatcagggtgttttgagccaggttgattgagcactgggctccaacttattgttaatgagaaatggcccaacttggaccatgactttcccatttgcaggtcttagaataattttttttttaattgagacaggggttcgctgtgttgcccaggctggcctcgagctcctgggttcaagtgatcctctgcctcaacttcctgagtagctgggattacaggtgcttgccaccatccccagcacagtcttggaagaattttaagaagcttacttcattgaaaaaagaggaaagtgaaaatgtgctaagtatatgaaagggaaagcttggattaaagatgagaaacatttttagactataacatgttaaagagagatactataggctttatgttttagtcaacttcttttacctatagggaccaatagataaagtcttaacctggagacaggggttggatgaaatggtttctaagaggtttatccaggttttgtggaaacaataggaacaagacagataaaataaggggtcttattaaaaaataatgctctaaatatttgagatactagaacactattttgttttctgtctcttttgattgggagtttttatgtggaaggaagctactaactatcccaccctatgcagagaccccagaatccaacaatagcgtgtatacttccttcatgaagtctcatcgctgctatgacctgattcccacaagctccaaattggttgtatttgatacgtccctgcaggtgggtgaaatcctcttttcccttccccctttggagcctgtggtttaatacctctcatcctatctcatcctaagggtaatatccttatccttctgtgaagttagtctcatgttttacccaacatgcccaaacactgttctttttttacagtcctgcccctgtggatttgcctttatgattattactgtcttggctacaggtgaagaaagctttttttgctttggtgactaacggtgtacgagctgcccctttatgggatagtaagaagcaaagttttgtgggtaagcaaaagtttctggaacacaatattattggcatcttgtgctgggcagggagacaagcttcaggcagtgctgagggctctgtcttgtcctctaggcatgctgaccatcactgatttcatcaatatcctgcaccgctactataaatcagccttggtaaggaaccttaacccaatgaccaaaatcactttccctgccctaaatccctcattctcatttctttttctccaagcaagccacgagggcttaaggaagcagagagatcaggtctcaaattctgttgcttctgctttcaggtacagatctatgagctagaagaacacaagatagaaacttggagaggtatgtagagaattggggttataaaaggataaagggatggcgggtttctgggaaacacttttccatggtggtattttgtgacccatcccttttcccttcagaggtgtatctccaggactcctttaaaccgcttgtctgcatttctcctaatgccaggtgagttccagttacccatctgtccaaaaagcggaagagattttgtcatcagcctagctaatgccctagacacccagggaaaggggaagaagagagaaaagacacacacacacacacacacacacacacacacacacacacacacacacagtctctctctctctctcattctcactctctctctctctctctttctctttaagtctggcctgtacactgccccccttccctaaccatcagttttccctgttgagcaatacactgtatggacctgtttaatcacccccagccccagcactgtggaacttattatctcccaccctctcacagcttgtttgatgctgtctcttcattaattcggaacaagatccacaggctgccagttattgacccagaatcaggcaatactttgtacatcctcacccacaagcgcattctgaagttcctcaaattgtttgtaagtgctcctcagcccagttcttttttctcttttttcattgattgattgattgattgattgaaaagagagacgaggtctcactgtgttgctcaggctagtgtcaaactcctgagctcaagtgatcctcccgcctcagcctcccaaagtgctaggattacaggtgtgagccactgcatccagccccacttcttatttatttattaatttattttgagacaagttcttactctgttgcccaggctggcgtgcagaggcgctatcatggctcactgcagcctccaacctcttggtctcaggtgacccccgacctcaacccccagaagagctgggactacacgtgtgtaccaccacacctggctaattttttggtattttttatagagatagggttttgccatgttgcccaggctggtctcgaactcctgggctcaagcaatatgtccccctcagcctcccaaagtgctgggattataggcataagccggcgcacccagcccttatttctaatatactgggttggagggggtatccaagggtggctttgggtgccttgaaagttaagctgatggttctttcctcagatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaagggtgagagattgggcagaaggagagggagggaagatccaggcaagtcagggtggctctgggaagatctgctttcccctcagcttagccaggagggtgattctatgagtagggggagctttagatcccagatcctccttactgagctgcctctgtccccctagggcgtgtggtggacatctactccaagtttgatgttatcgtgagtgattgtggagggtctgggaggtagggaagtggtggggggggggcactgttaaatatggagagggagaagggagtctcttctgtgatctaagggtcttagaagcttccaggctttcaaatcctatttgaaaaggaattgaatgagttgggtgtggcttgtggctgacaattgccctgaatccctctgttgaggttggatgggttcagggtttggaggctggctctcttgcttccctgcaagctccttcctctgtctccccagaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggtagggaggccagcaaccctaaaggagctgaggggagcagccttgagagtggggtttggcaaggagagtaggggcagaggggcttcccctgaggccagcactaaacattccctttctcccttgttgctctgtgccaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacgatattgcagtgtttgatttttacagttgatgggtactaccttcctactttatatggcttcttcaactggtcattaacaataataataacgtgtgtacgcacacacacacgtacacacacacgagtagacagacttgagggtctcctttgggcagagaatcctgccaccattatcagcttttcttagttggggaaggttggactgtttggcttttgctgagttggcactatctttttttttttttttttttttttttttgagatggaatctcactctgttgcccaggttggagtgcaatggcgcaatctcagctcactgcaacctccgtctcccgggttcaagtgattctcctgcctcagcctcctgagtagctgggactacaggcgcgcgccaccacgcccagctaatttttgtattttttagtaaagacggagtttcacccatattggccaggctggtctcgaactcctgaccttgtgatctacctgcctcagcctcccaaagtgctgggattacaggcatgagccaccgcacccggccagcactatctttaaacctacaaatcccttgcctcttccaaggtgagaatgagctggatggtgggagaacagcagggcagtggtcactccatcagatccattccctgtattgaaagcatgtagacccaaacagcagtcagcacccaacatcagaagaactgctagactggagtatgagctaaatttgggtgccagctcaccccagccttgcaggtatgatacagtttcccatccaagccaggagcaatttcggagtcattccttgcccctgccccacagtgcctaacccctctgataaccctccagccagggcatactgggttctcctgatggaacacagggaaaagcatcaaggccctcatcagattcgacctgaggaagcttattttaaaaaaagaaggtggccctcatcagagctcagctttcagtgttgcatcatggctgtggaggagcccctgcttctgccttcacccctttacagctctcacagcacattctcaaccttgggggaggaaggcttccaagttattagaattagagtatgtttatgtgtcaggagggtaagcacatggtggaaaggacagatggccccttatgtcacattccctcattaaggaagatttgcctagggaggaggcaagggctttaaaaagcctcaggactctagtgggacctagggtggaaggaagcatcttcgagtcaagtcatcagtgcagctggcaggtgtgtggaatcaaggggggtagggtggatgggacgggatgtttgcgttctctctaaaggtttgtgttagggagcagagacctggttttgttgagttgtttctcagtctgtcagtctctgccccacaacctttctggttgttccccatccccttaaaaggaagggtctggacccaaagggctccatgtacattagtggaaaactaattgggaactcttgcttctcccatttccctctaaaacccaacctatccgtctcagtgtgaggatgaagctgagggagagacaagggatgaaatttgggagactcacaagcttctattcttacctattcctctccagagaggcaaattatcccttcttcccgaggaaccatgccccacacactctcccctctctctgcactgctcccctccactgaagctgctgccatggttgccaggcatggttgctaagtctctgcatggaagggttggcgtgggctgtgctgccactaacattaccatggtgaatcaggggacacctggtataagcttaggaggagggatcatgtggatataagcaacagccccccaggacagaggcagcccaaaaggtgagcatc

SEQ ID NO: 16753 - DNA, 14802 bp, Human
  misc_feature (1)...(14802): n = A,T,C or G
cggctgcctgtgctggggtggggaggagtagagggcgagaagttggtggggaagggaagcggcgccaaaagaatacccacaacatcttgcacctggaaggcaaagcagagggcagtgatctctgcagacttgcgggggcgacgcctgaagcaaacagggacatacaagctggtgccttctgtggttgtgcatggggtcttcatgcttcctgtctgagttcccagaagcttgtctctgcttttctaggcagctgccacagcctgtcacaaacagctcctggttctccacttctcatagtctcgatttcaaaatccattgcctcaccctccacctcctctccacctccacccctcctagcacctcctgactgcttgtgttctgtgtctccccactgtctcccaacctggggtggggttgggggggatgtctttcctcctgtctgctctttgatgtccagctgaagtgtcacctcctacaggcagcctcccctggctatgccagcttgtactgattgccctctcctctgaattctgtaagcatttcctatgtgtacctgcccctgggcaaggtgggcctgacttgttagagtgttagagttttaccctgttcctctaggagggcctggtaccaccacagcccagcatggtgtggtgcctcagcaggaggcatctggttacaatcaacacaagctgttccagccaatttaaagaaacttcaggaggaatagggttttaggagggcatggggaccctcctgcacccgaagccaggatgtgccaccaatcataaggaggcaggggcctccttccgctgctccctgggactctctaggtgtccgtggcctcagcccccctctgcacacctgcatcttccttctcatcagcttcctctgctttaagcgtaaacatggatgcccaggacctggcctcaatcttccgagtctggtacttatggtgtactgacagtgtgagaccctactcctctgatcaatcccctgggttggtgacttccctgtgcaatcaatggaagccagcgaggcagggtcacatgccccgtttagaggtgcagacttggagaaggaacgtgggcaagtcttcccaggaacaggtagggcagggaggaaaggggggcatctctggtgcagcccggttcggagcaggaagacgcttaataaatgctgatagactgcaggacacaggcaaaggtgctgagctggaccctttatttctgcccttctcccttctggcaccccggccaggaaattgctgcagcctttctggaatcccgttcatttttcttactggtccacaaaaggggccaaatggaagcagcaagacctgagttcaaattaaatctgccaactaccagctcagtgaatctgggcgagtaacacaaaacttgagtgtccttacctgaaaaatagaggttagagggatgctatgtgccattgtgtgtgtgtgttgggggtggggattgggggtgatttgtgagcaattggaggtgagggtggagcccagtgcccagcacctatgcactggggacccaaaaaggagcatcttctcatgattttatgtatcagaaattgggatggcatgtcattgggacagcgtcttttttcttgtatggtggcacataaatacatgtgtcttataattaatggtattttagatttgacgaaatatggaatattacctgttgtgctgatcttgggcaaactataatatctctgggcaaaaatgtccccatctgaaaaacagggacaacgttcctccctcagccagccactatggggctaaaatgagaccacatctgtcaagggttttgccctcacctccctccctgctggacggcatccttggtaggcagaggtgggcttcgggcagaacaagccgtgctgagctaggaccaggagtgctagtgccactgtttgtctatggagagggaggcctcagtgctgagggccaagcaaatatttgtggttatggattaactcgaactccaggctgtcatggcggcaggacggcgaacttgcagtatctccacgacccgcccctgtgagtccccctccaggcaggtctatgaggggtgtggagggagggctgcccccgggagaagagagctaggtggtgatgagggctgaatcctccagccagggtgctcaacaagcctgagcttggggtaaaaggacacaaggccctccacaggccaggcctggcagccacagtctcaggtccctttgccatgcgcctccctctttccaggccaagggtccccagggcccagggccattccaacagacagtttggagcccaggaccctccattctccccaccccacttccacctttgggggtgtcggatttgaacaaatctcagaagcggcctcagagggagtcggcaagaatggagagcagggtccggtagggtgtgcagagggccacgtggcctatccactggggagggttccttgatctctggccaccagggctatctctgtggccttttggagcacctggtggtttggggcaggggttgaatttccaggcctaaaaccacacaggcctggccttgagtcctggctctgcgagtaatgcatggatgtaaacatggagacccaggaccttgcctcagtcttccgagtctggtgcctgcagtgtactgatggtgtgagaccctactcctggaggatgggggacagaatctgatcgatcccctgggttggtgacttccctgtgcaatcaacggagaccagcaagggttggatttttaataaaccacttaactcctccgagtctcagtttccccctctatgaaatggggttgacagcattaataactacctcttgggtggttgtgagccttaactgaagtcataatatctcatgtttactgagcatgagctatgtgcaaagcctgttttgagagctttatgtggactaactcctttaattctcacaacaccctttaaggcacagatacaccacgttattccatccattttacaaatgaggaaactgaggcatggagcagttaagcatcttgcccaacattgccctccagtaagtgctggagctggaatttgcaccgtgcagtctggcttcatggcctgccctgtgaatcctgtaaaaattgtttgaaagacaccatgagtgtccaatcaacgttagctaatattctcagcccagtcatcagaccggcagaggcagccaccccactgtccccagggaggacacaaacatcctggcaccctctccactgcattctggagctgctttctaggcaggcagtgtgagctcagccccacgtagagcgggcagccgaggccttctgaggctatgtctctagcgaacaaggaccctcaattccagcttccgccctgacggccagcacacagggacagccctttcattccgcttccacctgggggtgcaggcagagcagcagcgggggtaggcactgcccggagctcagaagtcctcctcagacaggtgccagtgcctccagaatgtggcagctcacaagcctcctgctgttcgtggccacctggggaatttccggcacaccagctcctcttggtaaggccaccccacccctaccccgggacccttgtggcctctacaaggccctggtgggcatctgcccaggccttcacagcttccaccatctctctgagccctgggtgaggtgaggggcagatgggaatggcaggaatcaactgacaagtcccaggtaggccagctgccagagtgccacacaggggctgccagggcaggcatgcgtgatggcagggagccccgcgatgacctcctaaagctccctcctccacacggggatggtcacagagtcccctgggccttccctctccacccactcactccctcaactgtgaagaccccaggcccaggctaccgtccacactatccagcacagcctcccctactcaaatgcacactggcctcatggctgccctgccccaacccctttcctggtctccacagccaacgggaggaggccatgattcttggggaggtccgcaggacacatgggcccctaaagccacaccaggctgttggtttcatttgtgcctttatagagctgtttatctgcttgggacctgcacctccaccctttcccaaggtgccctcagctcaggcataccctcctctaggatgccttttcccccatcccttcttgctcacacccccaacttgatctctccctcctaactgtgccctgcacccaagacagacacttcacagagcccaggagacacctggggacccttcctgggtgataggtctgtctatcctccaggtgtccctgcccaaggggagaagcatggggaatacttggttgggggaggagaggaagactggggggatgtgtcaagatggggctgcacgtggtgtactggcagaagagtgagaggatttaacttggcagcctttacagcagcagccagggcttgagtacttatctctgggccagggactgtattggatgttttacatgacggtctcatccccatgtttttggatgagtaaattgaaccttagaaaggtaaagacactggctcaaggtcacacagagatcggggtggggttcacagggaggcctgtccatctcagagcaaggcttcgtcctccaactgccatctgcttcctggggaggaaaagagcagaggacccctgcgccaagccatgacctagaattagaatgagtcttgagggggcggagacaagaccttcccaggctctcccagctctgcttcctcagaccccctcatggccccagcccctcttaggcccctccaccaaggtgagctccccctccctccaaaaccagactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacagtaaggccaccatgggtccagaggatgaggctcaggggcgagctggtaaccagcaggggcctcgaggagcaggtggggactcaatgctgaggccctcttaggagttgtgggggtggctgagtggagcgattaggatgctggccctatgatgtcggccaggcacatgtgactgcaagaaacagaattcaggaagaagctccaggaaagagtgtggggtgaccctaggtggggactcccaccagccacagtgtaggtggttcagtccaccctccagccactgctgagcaccactgcctccccgtcccacctcacaaagaggggacctaaagaccaccctgcttccacccatgcctctgctgatcagggtgtgtgtgtgaccgaaactcacttctgtccacataaaatcgctcactctgtgcctcacatcaaagggagaaaatctgattgttcagggggtcggaagacagggtctgtgtcctatttgtctaagggtcagagtcctttggagcccccagagtcctgtggacgtggccctaggtagtagggtgagcttggtaacggggctggcttcctgagacaaggctcagacccgctctgtccctggggatcgcttcagccactaggacctgaaaattgtgcacggcctgggcccccttccaaggcatccagggatgctttccagtggaggctttcagggcaggagaccctctggcctgcaccctctcttgccctcagcctccacctccttgactggacccccatctggacctccatccccaccacctctttccccagtggcctccctggcagacgccacagtgactttctgcaggcacatatctgatcacatcaagtccccaccgtgctcccacctcacccatggtctctcagccccagcaggccttggctggcctctctgatggagcaggcatcaggcacaggccgtgggtctcaacgtgggctgggtggtcctggaccagcagcagccgccgcagcagcaaccctggtacctggttaggaacgcagaccctctgcccccatcctcccaactctgaaaaacactggcttagggaaaggcgcgatgctcaggggtcccccaaagcccgcaggcagagggagtgatgggactggaaggaggccgagtgacttggtgagggattcgggtcccttgcatgccagaggctgctgtgggagcagacagtcgcgagagcagcactgcagctgcatggggagagggtgttgctccagggacgtgggatggaggctgggcgcgggcgggtggcgctggagggcgggggaggggcagggagcaccagctcctagcagccaacgaccatcgggcgtcgatccctgtttgtctggaagccctcccctcccctgcccgctcacccgctgccctgccccacccgggcgcgcccctccgcacaccggctgcaggagcctgacgctgcccgctctctccgcagctggccttctggtccaagcacgtcggtgagtgcgttctagatccccggctggactaccggcgcccgcgcccctcgggatctctggccgctgaccccctaccccgccttgtgtcgcagacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttgggggcgcggcaccagcaccagctgcccgcgccctcccctgcccgcagaggtgagcttcctcaattgctcgctggacaacggcggctgcacgcattactgcctagaggaggtgggctggcggcgctgtagctgtgcgcctggctacaagctgggggacgacctcctgcagtgtcaccccgcaggtgagaagcccccaatacatcgcccaggaatcacgctgggtgcggggtgggcaggccccctgacggggcgcggcgcggggggctcaggagggtttctagggagggagcgaggaacagagttgagccttggggcagcggcagacgcgccccaacaccggggccactgttagcgcaatcagcccgggagctgggcgcgccctccgctttccctgcttcctttcttcctggcgtccccgccttcctccgggcgccccctgcgcacctggggccacctcctggagcgcaagcccagtggtggctccgctccccagtctgagcgtatctggggcgaggcgtgcagcgtcctcctccatgtagcctggctgcgtttttctctgacgttgtccggcgtgcatcgcatttccctctttacccccttgcttccttgaggagagaacagaatcccgattctgccttcttctatattttcctttttatgcattttaatcaaatttatatatgtatgaaactttaaaaatcagagttttacaacttttacatttcagcatgctgttccttggcatgggtccttttttcattcattttcattaaaaggtggacccttttaatgtggaaattcctatcttctgcctctagggacatttatcacttatttcttctacaatctcccctttacttcctctattttctctttctggacctcccattattcagacctctttcctctagttttattgtctcttctatttcccatctctttgactttgtgttttctttcagggaactttcttttttttctttttttttgagatggagtttcactcttgttgtcccaggctggagtgcaatgacgtgatctcagctcaccacaacctccgcctcctggattcaagcgattctcctgccgcagcctcccgagtagctgggattacaggcatgcgccaccacgcccagctaattttgtgtttttagtagagaaggggtttctccgtgttggtcaagctggtcttgaactcctgacctcaggtgatccacctgccttggcctcctaaagtgctgggattacaggcgtgagccaccgcgcccagcctctttcagggaactttctacaactttataattcaattcttctgcagaaaaaaatttttggccaggctcagtagctcagaccaataattccagcactttgagaggctgaggtgggaggattgcttgagcttgggagtttgagactagcctgggcaacacagtgagaccctgtctctatttttaaaaaaagtaaaaaaagatctaaaaatttaactttttattttgaaataattagatatttccaggaagctgcaaagaaatgcctggtgggcctgttggcctgtgggtttcctgcaaggccttgggaaggccctgtcattggcagaaccccagatcgtgagggctttccttttaggctgctttctaagaggactcctccaagctcttggaggatggaagacgctcacccatggtgttcggcccctcagagcagggtggggcaggggagctggtgcctgtgcaggctgtggacatttgcatgactccctgtggtcagctaagagcaccactccttcctgaagcggggcctgaagtccctagtcagagcctctggttcaccttctgcaggcagggagaggggagtcaagtcagtgaggagggctttcgcagtttctcttacaaactctcaacatgccctcccacctgcactgccttcctggaagccccacagcctcctatggttccgtggtccagtccttcagcttctgggcgcccccatcacgggctgagatttttgctttccagtctgccaagtcagttactgtgtccatccatctgctgtcagcttctggaattgttgctgttgtgccctttccattcttttgttatgatgcagctcccctgctgacgacgtcccattgctcttttaagtctagatatctggactgggcattcaaggcccattttgagcagagtcgggccgacctttcagccctcagttctccatggagtatgcgctctcttcttggcagggaggcctcacaaacatgccatgcctattgtaggagctctccaagaatgctcacctccttctccctgtaattcctttcctctgtgaggagctcagcagcatcccattatgagaccttactaatcccagggatcacccccaacagccctggggtacaatgagcttttaagaagtttaaccacctatgtaaggagacacaggcagtgggcgatgctgcctggcctgactcttgccattgggtggtactgtttgttgactgactgactgactgactggagggggtttgtaatttgtatctcagggattacccccaacagccctggggtacaatgagccttcaagaagtttaacaacctatgtaaggacacacagccagtgggtgatgctgcctggtctgactcttgccattcagtggcactgtttgttgactgactgactgactgactggctgactggagggggttcatagctaatattaatggagtggtctaagtatcattggttccttgaaccctgcactgtggcaaagtggcccacaggctggaggaggaccaagacaggagggcagtctcgggaggagtgcctggcaggcccctcaccacctctgcctacctcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtgggaggcgaggcagcaccggctgctcacgtgctgggtccgggatcactgagtccatcctggcagctatgctcagggtgcagaaaccgagagggaagcgctgccattgcttttgggggatgatgaaggtgggggatgcttcagggaaagatggacgcaacctgaggggagaggagcagccagggtgggtgaggggaggggcatgggggcatggaggggtctgcaggagggagggttacagtttctaaaaagagctggaaagacactgctctgctggcgggattttaggcagaagccctgctgatgggagagggctaggagggagggccgggcctgagtacccctccagcctccacatgggaactgacacttactgggttcccctctctgccaggcatgggggagataggaaccaacaagtgggagtatttgccctggggactcagactctgcaagggtcaggaccccaaagacccggcagcccagtgggaccacagccaggacggcccttcaagataggggctgagggaggcccaaggggaacatccaggcagcctgggggccacaaagtcttcctggaagacacaaggcctggccaagcctctaaggatgagaggagctcgctgggcgatgttgggtgtggctgagggtgactgaaacagtatgaacagtgcaggaacagcatgggcaaaggcaggaagacaccctgggacaggctgacactgtaaaatgggcaaaaatagaaaacgccagaaagggcctaagcctatgcccatatgaccagggaacccaggaaagtgcatatgaaacccaggtgccctggactggaggctgtcaggaggcagccctgtgatgtcatcatcccaccccattccaggtggtcctgctggactcaaagaagaagctggcctgcggggcagtgctcatccacccctcctgggtgctgacagcggcccactgcatggatgagtccaagaagctccttgtcaggcttggtatgggctggagccaggcagaagggggctgccagaggcctgggtagggggaccaggcaggctgttcaggtttgggggaccccgctccccaggtgcttaagcaagaggcttcttgagctccacagaaggtgtttggggggaagaggcctatgtgcccccaccctgcccacccatgtacacccagtattttgcagtagggggttctctggtgccctcttcgaatctgggcacaggtacctgcacacacatgtttgtgaggggctacacagaccttcacctctccactcccactcatgaggagcaggctgtgtgggcctcagcacccttgggtgcagagaccagcaaggcctggcctcagggctgtgcctcccacagactgacagggatggagctgtacagagggagccctagcatctgccaaagccacaagctgcttccctagcaggctgggggcacctatgcattggccccgatctatggcaatttctggagggggggtctggctcaactctttatgccaaaaagaaggcaaagcatattgagaaaggccaaattcacatttcctacagcataatctatggccagtggccccccgtggggcttggcttagaattcccaggtgctcttcccagggaaccatcagtctggactgagaggaccttctctctcaggtgggacccggccctgtcctccctggcagtgccgtgttctgggggtcctcctctctgggtctcactgcccctggggtctctccagctacctttgctccacgttcctttgtggctctggtctgtgtctggggtttccaggggtctcgggcttccctgctgcccattccttctctggtctcacggctccgtgactcctgaaaaccaaccagcatcctacctctttgggattgacacctgttggccactccttctggcaggaaaagtcaccgttgatagggttccacggcatagacaggtggctccgcgccagtgcctgggacgtgtgggtgcacagtctccgggtgaaccttcttcaggccctctgcccaggcctgcaggggcacagcagtgggtgggcctcaggaaagtgccactggggagaggctccccgcagcccactctgactgtgccctctgccctgcaggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaagccactagagccttttccagggctttgggaagagcctgtgcaagccggggatgctgaaggtgaggcttgaccagctttccagctagcccagctatgaggtagacatgtttagctcatatcacagaggaggaaactgaggggtctgaaaggtttacatggtggagccaggattcaaatctaggtctgactccaaaacccaggtgcttttttctgttctccactgtcctggaggacagctgtttcgacggtgctcagtgtggaggccactattagctctgtagggaagcagccagagacccagaaagtgttggttcagcccagaatgagctcacagtgtcgcgggggaagctgtttaagaacaatgttacaccatcatgaacagcagtaagaaagaggctctggcttaacctggcctgataggcctaattgaatgagacagaaataagtcaaggatgctctgatttgaaatcatgaagtacctgatgaaaagaaatggtggtgagataaagctgagaaaattcatctaaagcccaaaattagtctagctctgtgtgtggcctcaggcaagtctttttctcctctctgagtgtgatggttaattttaggtgtcgatttgactggatgaagggatacccagatggctggcgaagcatgatttctgggtgtgtctgtgagatgttctggaggagatgggccactgagtcggtggactatgtggggaagatccgccctcagtgtgggcaggcaccatccaatcagctcgggacccagacagaataaaaaggcagaggacaggtgaattatctgtctctcctagagctgggacacccttctcctgcccttggacatcagttccaggttctcaggcctttggactctgagacttaacactagtggccctccagattctccagccattagccctgtactgaggatcctgctatcagcttccctggttctgaggccttgagacctggactgagccaggccggcttcccgggctctccagctggcaggtctgccatgggactcctcagcctcaatgatcacagaagccaaatccttaataagccccttctcatctatctgtgtctatatatacatcctattagttctgtctctggagaaccctgactaatccaggggacatcagtaaaatgaagggattggatgagagcagtggttctacaccctggctgcacatttgcatctcccggacagcctttttgttgttgttgttgtttttggtttttgagacagagtctcactctgtcacccaggctggagtgcaatggtgcgatctcagctcgctgtaacctctgcctcccgggttcaagtgattctcctgcctcagcctcccaagtagctgggattacaggtacctgccaccacacctggctagtttttggttggttttttgttgttgttgttgttgtttgtttttgtttttttgagacggagtcttgctctgtggcccaggctggagtgcagtggtgcgatctcagctcactgcaagctccacctcccaggttcatgccattcccccgcctcggcctcccgagtagctaggactacaggcgcctgccaccacgcccggctaatgtatttttagtagagacggggtttcaccatgttagccaggatggaatcagtagtgatgattnnnnnnnnnnnnnnnnnnnntagtcccaggtacttgggaggctgaggcacaagaatcacttgaacccagaaggcagaggctgcagtgagccgagatcacaccactgcactccagcctgggtgacagaacaagacactgtctcaaaaaaataaaaataaggcggtcgggcatggtggctcacacctgtaatcccagcactttgggaggctgaggcgggcagatcacgaggtctggagttcgaaaccatcctggccaacatggtgaaaccccatctctactaaaaatacaaaaaattagccgggtgtggtggcatgcgcctgtagtcccagctactcag

SEQ ID NO: 16754 - DNA, 71387 bp, Human
atggtaatttcacaggtagttgtctcatctttgatgctgatctatctctgtcattggtcaggaagctctgtgagggcaagagctctgtgtcttttcatagctgtattccagggtcggtacatatgatctggcacatagaagctgctcttttgttgtaagaataaatgaatgaatgaatggatgcattttctgacctctacctgggcaccatcctttcctttcttttcccatttatgtttggctctcctaaaagatcaaagaatggctctgtccctcctttgaagtcctttagtacttccagttctctctcctgctcgcttcactttctatgccttgtacttttggaacttggcatggcctggctgcctgcacctgcacctgggttcagggctggacttttcctgtgggtgggttcacttccagactagaacagaagcttcctaagggcagggactcttcctgggatacattcaggtgaaaaaacttggctgaatgcaggaatgaatgaacacaggcaaaaggcgagttgctccaagctgcagctgacagctgagctctaagtcttgggaggcatccacagcagacagcccctgctttcaggttcctcgtaagaattcctgcttcctttgggcaggcattatactggccccaggacatagccttatatagtttgcagtcctgggggatgtgtgggggaaatggggaagacctgtggggatgctgtccaaataatgattctttgtctgcagcttcagtgggaagaacagttgctgatacggaaggaggggaggcagacctctgaagcattgagtgcaaaggaacaggatgctcacatttaggcagtgggtggttgtctagcagtgggcagggagggcctgaggcagaccagagtcctggcagggtttctgtggtcctctgcctccctgcacctccccatcagagcaaggcccccctctttgggaacagtcacttttggctgctctgtggcctctagagccagcccctgagaataccccacagccctccctctgaaccctggcatgggctgcagggccagctctgctgctggtttcctgtatgaccttgggcaagtcatgcctcctctcttggtcatctctgttctgagccctggcttgctgtttagacatgtgtttccagatgggtgagctgagtccccaggaaggtcagggtttgatgaactccttggaaagggttctctagtatcttcccttctgctgcctctggagggccctgcatcaatactgggagagggacagggcaaggaaatagctcccggtgagatcccttcccccagtctcagtttcttcctctttacagtgggggtaacagtggacctgggggctgcaggctgtggagggggagtcaggaatgtgggtgggtgggtggctgtccttgtggccaagagattaggattgtgctggtttttttccagtgacacccagcaactctctgtcctctcaagaatgttctccagggagaacaagacttgactgattcttcagaagagtgctgcacccattttacaagcggacaagccaagtccttagaaggcatgggactagtccaaggatgggtggcaggtgatctgaagcctctaggctcctagccccaggtggcctgttccctcaatggagccactccagctctggcaagggcaggtgcggtggcgctgctggtgcctgctgtgggagtacagtgggcctttgtgccaggcgggcaccaccccctggctggcccctccccattcgcaggacagctcttacctgccgggccgccgccccagccaacagctcagccgggtgctccttcctgggctccacgcccggagctgcttcctgacggtgcagccgcaaggcatcgcaggggccccgcgctactgccctgctccctcaaagtcccaggtcccctcccctggtgctgatcattaaccaggaggccgtataaggagctagcggccctggcgagagggaaggacgcaacgctgccaccatggacagtagcacctggagccccaagaccaccgcggtcacccggcctgttgagacccacgagctcattcgcaatgcagccgatatctccatcatcgttatctacttcgtggtagtgatggccgtcggactgtgggtatgcagcgggttctgggatgcgggtggggagggtgcgcacagaggaggagcaatggcctcgctgagctgcaaggggcagtaggcttaagtgtcggtggaggggagaggaaatgacttggaagcactttagaagcactcagaggcacagcatgaagggaggagggcaagcaaggatgagcagaagtgagaagggtgcccagggcagcctgccaggaaggaccaaggaggatacctgagcctgtgagcagagaaggaaggtgggggtttgaagagaccgctggaaagtgtaaggggcaggaaagcggctgcttagagctacagggagggctctggggcttgggagatgagcctctagcaggtgactactgtcctaccttttagtcatccagtttcagatgggaaagaaatggtgtggagtgggaaagccacagcctctgccagccccagagatggggatgctgaggtggcagacagagggatgctgacccatgccccactcctgggagaggctaacccagaggccttgtgcatgaggatcccaggggctggatcaagttagagatgagaaagatgggtggaaaaggaggaggaggaagacctgggggtgacctggcactggggagagggaaatgtgtgtgtctccttttgggactctggggacacagcaaaccagagaaacttgttctcagccacctggaacatgggcatttcacttatgacagactgtggcaggcccaacaactagaggaggagatgttttaaaagtgtgcaggaccgactgtggtggttcactcctgtaatcctagcactttgagaggccaaggtgggaggattgcttgagtccaggagttcgagatcagcctgggcaacatagtgagactctgtctctacaaaaataaaaaaaattacaaaaaatatataaaatgtttgcagatgttccagccattctcgtgattgttatggaggtggaggtgataagcccagggaggctgctgtagcagctggtgattgtgttgaactcttttgacttagaggagaggaaggtaggcatgaacacttctgtggacacagagctttttcagggacaaaaggaagtgtttttttttttttttccaaaggaattgtagaaactagatgtggcagaatgcctcccaagtgtcacatggggtcagtatggctgacttttcctcaatactctcagcttcccagacatagtggaaactgaccaactaggagccaggatactcaagttcactactggctttcacatggttcaaatcatggaacattgggtaacttccctcagcctccagtttactcaactttaacataggtacactcttatctattctaatgactcccccatggttgtggtgaggatacgcagaggtgaatctgaaagctgtttatggactctaggattaaaaaaaactactattgtcatttaccttccatggtatgatctgggctctgaacaatgtttatccttttaagtaaaatgggcagcagtggtcaggtgggtagtatatttttacaaaagccacaagacagggaaggccagaatgctaatccccgttttacagaagaggaaattgaagcctcatgtggttgtgatttgtctaaggttacaatagatgaaattgttcctggaactcagatctcttgactcctgattttttatggtaccaggcactctgccactgtgactgacttcctccttccaccccaccccagcttataagtgctggagccaaggtgtgagcccgtcatctgctggctatacagtactgcctgtttcccagacaatctctgataatatcggttctcttaaccaatctcattttagccctgccagtctagtaggtgtttatactttttaaatggtgtttacatgtttcaagtatctgtgaatcagtatcacttgtcctgctaaatgctacttaatagcctgtttagtatttgtctatgtttaatcttcccccattagacaatgcctctggaccctggtcatttaatgcattggatttcttccagtttatcctcctctgtctgctattaaagtggcaagagtggcttgattcaggggtggccactctgactccttcatgatctctgggctgcacaggcagaatggtccaggcccattgtgtttcttcaacttagaaaagacccacacagtcaatgtccctctgtcaccttctctatctcttccaacattatttggttctgttttgctcttttacaattctgcctcctccaatcatattttagaatttggcttcttacttcttcagagttaatttccatttttctttcaccacctatcagtttgtttcttagggaattctatatcctttgaagctggatctctgaccttattcttcctggaagagttcatcaagctatcctgaaatcccctcaagccaggggttgttaaactatggaccatgggccaaatctgtctcacagcctgtttttgtatggtccataagccaagaatggtttttacacttctcaagggttgtgaaaaagaaataacaaaacaagatatgaagaatttgcagtagagaccctgtatattccacaaagcctcagtatttaccatcaggccctttttctttaaagaaaaaaaatttactgacccctgtcttatgcagtcatttgaaccgacagcatcactgaatgattgaattggaatggcccttgagggagcccaacctttctgttttacagatgaggatcggagagggtgaccagaagtcattcagatgaatcagtcccagagctgggacaagaatcaaggtcttatgatgccaaagccaatgctctttccactattctacctttcccactccccaagacacttgcctttctgggaatactccctccatggtccttactatcattgcattgttgtgacagtgtcctggtggtgctgaattcctttgctctttttttttttttttaagttggtgcttttctttagatcatttgacaaaatcaccttgactagttgtcaacagccttcacctgaacacttccagtagaaactctcccaagtggctttatttcaatctctggacagctctgacagagaggatattccttttggctctgggctcagacgcgatgtcctggaacttctctcattttgtctggttgtgtcctatgtgggccacaccaagcatcatgtctgtcccactttacatttcagaagacaacaggccacacttgaggcttctctcctccaggcccaacatcctcagtttcttaagttgttcctcatctggacagaggcctaaagttcttcctttctgctcaatgatatttgtattccatggagatagaacccaagtaaaccccaaaccaaagcattgtgggtcagtaattgtccttcttttaccccagcagcttggagttgggagttcattctcttgtagttgtagagtggacaggtgaatgtaacactgttgtttacaaagtggtgtctggaactttaaagttttcctttgagcctcttgtgctcacagaacaatgattttctgtgcacaaggcattatgcccaaagcattatgtgaaattaaaaatttgtaatatggtaacacaaagtaaaaaaaaattgtaatggctgtgaacaaggcataagtgaagtcatctgggtgttcacagactttcatttggagaagtgaggaggctgtagggaaggaggaggtttccatgggggagtgtcaagtagggtttcatgggggaaatggattttgaggggccttgaaggatgaataggtaggatctgggcttgcatagatgaggagatgaaaattccagagaagaaaagacttggtgcatacactcctctcttcaccttttgtccctccccatcatctttcctgaattatttcagctccccactctagtctctgccctcacattcttcctctaagctcttcatttctgagaccaactggggatatcaatcttcaacttcacagtgaccttcagaatggcttttccttggtcagttgctacagaccaggtccttgggaattttttctgttttggcccttagctaccttttctgattcttaggtctcttgctattcccaaaaaaactgctacagaggacttcacagtatctcctttgggaggaagagccctgccaggagtccagaaagacccaagccatgctctcccgggtactgcccagcacatgggggtgctcaagaaatctatgttgactgatgggacacaataatggccctgcttcctaaaggactaagttcaatacatcgttgcagactgagcacctagcaaaatgttatctgtctcaggcatgtttgatgaataaattacaagtgtctaagtgcctgagatgtcaccatcaggagttaatgcctttggaatagtgatttggaatagtgatgctttttagcctcagtggtcacctatgaaaatgcagacatcggccgggcatggtggctcatgcctgtaatcccagcactttcggaagccgaggcgggcagatcacctgagatcaggagttcaagatcagcctggacaacatggcaaaaccctgtctctacaaaaattagccaggcgtggtggtgtgtgcctgtactcccatctactcgggaggctgaggcatgagaattgcttgaacctaggaggcagaggttgcagtgagctgagactgcactactgcactccagcctgggcaacagaatgagactccatgtaaaaaaaaaaaaaaaaaaaaggtgccacctctgacagggttaagtcactatcagctactaacattattagcaagtgttcgctgagagaagccaataacacagaagaagagggaagatggccaggggccaggaacagaggcactgaccccattttctgctggaggactggccctgggcttgagctggaccagaaataatccgaaggcttagaggcaacatcccaagggatctgtgggaggagctggtcatcgtatattgaagattcatgtcatttttctcctcatgaaccctcagtggctccctactgcctatgcaataaagcctgcactttttagcctggcatttgtgagtgggtgttctgccccacttctcaccactctctccattcaaatgcctcagccaggctcatcagataacactgttcgccattctctccttctccacgctgggtgaggttccacctctagatctgctgtttctggaatcttaccacattcctccctcttctctaataaaattccactctttcttcaatcaagatttgctgaaatactgctctctctgtaagcctttcctggctccctggtctgacaaagtcctccccttcctctatactaacacaatagtcatgatatattggctgggtgcggtggctcactcctgtattcccagcactttgggaggccgaagcaggcagatcacttgaggtcaggagtttgcgaccagcctggccaatatggtgaaaccagtctctactaaaaatacaaaaattagctgggcgtagtagcacatgcctgtagtcccagctactcaggaggctgaggcacgagaattgcttgaacccaggaggcagagagaggttgcagtgagccaagatcgtgccactgcactccagcctgggtgactgagtgagactttgtctaaaataaataaataaataaatatatatatatatatatataatcattatatatatataatcattatatatatataatctatattatatataatctatatctatatctatatctatatctatatctatatctatatctatatctatatctatatctatatatatgatgattccagcaacctgctacctacaccctcagagaggaaagacttgaatttgtctggtcttttatttaatatttagtacaaatgccttgcattcttagagcattttttcacttttctggtaacaaagatataactcacatcccatatggtactttttaaaagtatgatatttctttttcttttttttttttttgagatgggtgttgctatgttgcccaggctggtcttgaattcctgggctcaaatgattctcccacctcagcctcctgagtagctgggattataggcacatgccaccatgtggctgtaatcccagctactcaggaggctaaaataaatatagcattcattaggaacctcaatatgcttgtaagaaaggcataaaaagttccattcctgccatttaacagacaagcaagcagatccaggtggagtgacttgctggaagtgatactggaagctaatttcgcactagccctacagtaagctgtatgtatcttctgagcctcagtttccttgtctgtcaaatgtaggttcctgcctccttcatctaagtcttttgaggctgcaggggaagaaggaatgtgaaagtgtttcagaaagtggagtgggtagaagaaggtgcacgaatggggaggtatgtccttttggctggcaaggccactcttctagttttcgattacatttttgaccctttcctcctcaggctatgttttccaccaatcgtgggactgttggaggcttcttcctggcaggccgaagtatggtgtggtggccggtaagttttctctgaaatgctatttacataactgcttaactgatactccctttaggaactcattttcttcttggctttgggtggtggtgattctaggattcaaggatcccaaccagattcttgacagtgagtctcatgctcatcgggtctcctgggcacccttaatctcttgtagtaagggaatagcctttaaataaatcacccttagagtccttcaataaaatacaaagttggttcaaagcctatcattggtccataaatccataaccagaatattagttctcaaatgcgctggcccaaggaacatatcacaggggtcagaggctctccactgctgacatctcacttgccctttgcccctccatctgcctttatcccagtcgctttgtgccacaggaagagtgggcagcagagaagcttctggaagaaggaacaacttgtattgacctgggttgatatacctgagacagagagggtttgggttgtcacccacaagaaaagtaggagaaaatcagagctcataaagtctgaaaacatactggatagaggagagactggttttgggcattcctggggtttagggggctttgaaaggagtggttatgacctgaaacaggtgaagattcagaaactctggaaacagactctgttcctgaaaactgaatgaggcccagagagaaaaacagtttgtgtgttggcttgaggatagaagcaagggacaatcagagggaaggagcaaggactccaggattgaaattacaagaagagtcagcttacatagggatctgggctgggaggtccccggaagcctgagtcatgcttgaggcaagccaaggcaactcatctgagtaacatgaaaccatgaaactgtaccttacgtaactgtgggctggttggtggcccaggattccctttttatgtggcaccagggtttgccacgtttcactcacagctgtctgtgcggagatgtgatggtaggaaagctgtgaagctcaggggctgagcttcgaaggggaattccccactctttggatattggcagcagaaattacacagagaagtgaggccccaggtacacagcccagtgagagactcttgttttggaagagagtttgatcacacctaccaggactactggcagagccagctccatgggatcagctcccttagattcagaaagaagcattccaaagggcagggagtgggaactgcacaaggagccacaggatttggcttgttccagctttgtgacattgggcaattcattaatctctgagtctctgagagtctcctctataatgtggagctggtcagataaggaatctcaaaggctcttccaggactaaaattctaagtttcagctaggcacagtgactcacacctgtaatccaggcattttgggaggcagaagtgagagaattgcttgagctcaggagttcaagaccagcctgggcaacatagcaagatcttatctctacagaaaaattaaaaactagctgggcgtggtggtgtgcacctgtagtcctagctacttggaaggctgaggtgggaggatcgcttgatctgggaaggtgaaggctacagtgagccatgattgcattactgccttccagcctgggggacagagtgagaccctgtttcaaacaacaacaacaacaacaaaaaccccaaaaaacaaaaacaacaacaacaaaaatcccaaacccaacaacaacaaaacaacaacaaaatagttgacaaactttttctgtaaagggccagattctaaatatttctagctttgctgctatgcaatctctgtcacaactattccactctgctgttgtaacacaaaaacatccaaggaaaatggatgaatgaatggatgtggctgactttatttgcaaaaataggtggagggccagatttcttgttttgaggacacacacagacagtctcagaacagagcctggcacacattaaaccctcaggtttagctcttgttcttctttgcaactgaaacctattgaaggactgtcatatcacttatctgattgaatcctcaatgatctagtgaggtaagtagagtgaagatgatgattaaccccatgggttgcccacgtttacacaagataatgacagagctaagacttcctctgatcttctggttattcaggtctctttctccttgtcttttgagatggaaatttatgaggccaattggtgtggcctaaagattggtctgaaaaccaagaaattatttcatttggggccgaccagagaccctgatgaaaattttccctgaagaaagaggacaggttctcaaacttttcaagtcctcttgggtaaaatatatctgattttatcgttatgtttctaaaacctaatgatcaggtcaaagtccagccacttatgatgtcaccagaggggccaaagggtgtcttagaaaaacctggtagtcccaacacatgggtggggagctcatgaattggagaggaagagagggaaccaggcaactggacatgagagaggcagggatgcactccaggaagaagtgagaaggaaagataagtacttgactcttcataagcctgggggaaacaattcctacctcttctggcccaggtccatttggccctctctccctgctctacttgctttttacctgcatgtgctcttacttatcccagtgccctgtgatgagagctaggcctacgcttttcttaattttttttttttggcctcacaacaccaaggccttgcactgcaagaaggcacttgacaaatatgggctgaattaaagagaaatgagggagaagagggacatgtccccagaacctcatgctggtcccccttagtggtgtcacctgagacctgagtctatattctggcctctggtgcaggggccacacagtatagacagtggtaagaattcaggaggttagaagggtgctgggtctaagtcaaagcctgcctccagcagtgctccaaatttctgtttttatgcatagagaaaaattgttgttgtttaggctcatgggagtaaaactggaaaaggaagccttaatcagagttcccaatttcagcccacactggactccttggtaaagtttggtgtggctatgtttcctcactctcaggccatttgttttctcggtctgagtcgaggttttgcaaaacttggtagttccccattggtatattttgggtgggagcttttgggttatcacagcagtgtctgctttgctctttcttcttcctccttcttatttttcctcccttttcttctcttcctattactcattctccttttcctattcctccaccttctcttcctcctttttattctcctccttctcctcattctttccctccttccctttcttccttctctttcccctctcttctcttttcctctttctctccccttcatccttctctttttttggtggaatcacttccctcccattcttcatagcttagtctctcctctaagtagcttctctgattaatacacaaccactcaccactccatgtattcttggtgtttctaggcatcaattgattgatgtgtaaccaagtccctgccatctagttagtacctaagcatctggcttctcctttctcactggctgccttcccagaattttctaacagattagtgcttctgtagacagaaaaaaaataccattttttgtaatccgtatttctggttggtagaagtcggaagaggcagaaaggtggtgaaactatcagttaaaatgaattcgttgtattattcatattagaaatatatctgggattaaattagttaatacatgtaaatctcttaggacactatatagttaatgctgtccaagggatgcctatcatgattatcatcattataattgtttctcagccgggtgcggtggctcacaccagtaatcccagcactttggcaggccgaggcaggcagatcgcctggattgggagttcaagaccagctggccaacatgatgaaaccccgtctctactaaaaataccaaaattagctgggcgtggtggcaggtgcctgtaatcccagctacttgggaggctgaggtaggagaattgcttgaacccaggagatggaggttgcagtgagctgagatcgcaccattgcactccagcttgggcaacagagcaagattccatctaaaaaaaaataaaatagtaattgtttctcatctccagcttctcctccttaagctgtgaattgaatcattcatctatttatgtagtagtattctctcattccacaactgcatgttgatacctactatgtgccagatgccatgtaggtgctgatatatccatgtgcatgtgtgtgtttatgtccctcacattcttacaaaatatacgtaaaattatcaataatagttaagtgctcagaagaaagtgtatttgagtcaagggtgaggttcagtgggagggagaagggtcttccttattcaacataggctcaaagagggcctttctgaggattgagcattcaggttgagatttgaatgatcagaaggagccagccatgtgaagattctgggatgagtaacccaagtggaaggaacagaatggccaaaggccctgatgtaggaagaagcttgggatatttgaaaaactgaaagggggccagtgtggggtacagatggtatatttatttatttatttatttatttgagacagggtctcactctgttgcccagtctggagtgcagtggtgcaatcttgactcactgtaacctccaccttccaggttcaagcaattctcctgcctcagcctccctagtagctaggattacaggcttgtgctaccaagcctggctaatttttttgtatttttagtagagacagggtttcaccatgttggccgggctggtcttgaactcctggcctcatgtgatctgcccaccttggcctcccaaagtgctgggattacaggtgtgagccactgcacccggccaagatggtatatttagatcaggtgctttgagtgagtgaccctgaattgctgatgattccaaagatgggctcatctcgatgagaggatggattggtcttcagcctccttaacctctaaacgccagtggaagacctcacctgccttttgtgccaaaaactggtgggaaaatgtcagtggtttcctgatttcttgcccctttgtttctttgggcaaggagagaagttcatgaaggtaatgagtgaaagaggaccattgtccatgggaataggagttggccgagtaaatagagactgtgatgactctggaacaaagcctgtgcctaaatatttactagagtctcagaaataaaatactctgaatataggagctccatctgattttctgtcccaatccaggaagtgtgatccttgagatggcaatgatccaagattaaatcttttcaaacttcctctgtggaaagagagagcttcctaagagagacactaatcatgattaaagacaagttcctagaaggtgaagaaggaatatgaaaacatgacacagatgagcacattccattcctgagtttacagtgggatgggtaggaggttctcaccccactgtgccccttcagggacattcagaagggaatgtcctgggaaaaaccagaaagtcagtgtgtgctacagcctctccctgtgcccctgggacttcagtcacctttggctataagaccttgggcaagtcacttcaaccttctgatccttattgtcatctgtaaatgaagatcagaataatacaaacctcacagaactgtagtgggcattaaataagaaaaagcaaatgaaatacatggtccaacccttggcccaaaggtggtgctgtaaaaattagcattctcctctccctttcttattctcccaggatggggctctcaaactgtggtacccagaccagcagcatcagcaagacctgcactcttgttagaaatgcaaaatttctagcctcaaaccagacctactgaatcacaaacgctagcaaatggggcccagtaatctgcgtatgttttttgttgttgttgtttgtttgttttttgagacacagtcttgctctgtgggagtgcagtgacgtgatcataacttactatagccttgatctcctgggctcaaacgatcctcccaccttagcttcctgagtacctgggactacaggtgcgtgccaccacgcctggctaatttttgatttttagtagaggtgaggtctcgctatgttgcgcagcctggtctcgaactcccgagctcaagcagtcttccccctttggcctcccaaagtgctgggacgataggtgtgagctaccatgcctgaccagtctgtgttttaagtcctccaggtgattctgattagggttgccagatttcacaaataaaaatacaggatgcccagttaaatctgaatttcaggcaaacaatacataccttcctgtctttttttttttttttttttagcataagtatgtcccatgcaatattcgggacatacttatgctacaaatgtataatgaatatattatctgtgaatctgcatattcaagataggcagacttaactgtatatctcgtgttctgattatgttaaagtttaaggaccactattggaggatatcccaagggaggagtccagcacagcctagagaaggcatggagaagacgccctgggatctcccgatatcccttaaagagaaggacaaaagcagggagcaggaagccatctccagaattctggacactctgggtcttagatggtttgttaacaaagaaaaatgtttcctgaaattagctgactgcattttccatttgggctatgatgaccttgtttcctcaaggagaaaacgatgactctgtttctttcaggaaattcagggtaatctataaaaacatgggctgtgtaaaagcatcaatacttcttcagaatagcatgtctttgtggagcaaaactttcttaaattttgtcacatcattaaagtccagtaataccctttagggtaggccaaaaaagattattatccttggtttacagtggaagagactgaggctaaaagcagtaaagtgactgcctcaaggtcacatagtttgctatggcggaaccaagattagaaccaggttggaaggttcacagtgtgctttgaaggaggggaggaaaaggatgtccatgccatttaattgtactttcaagtatgattattgatacaggatcctttttaaaaatcccctggctgcctctgattgtgaagccagttgtccattgccctaggcaattcttttcattgttttttgagatatgatctcactctgttgcccaagctggagtgcagtggtgtgatcacagctcatcaaagcctagacctcctgggctcaaaggatcctccttcctcagcctcccgagtatctgggactatagacagtgccactgcacccagttaattttttatttttttggagagatggggtctcactatgttgcccaggcaggtctcaaactcctggattcaagtgatcctcctgccatggcctcccaaggtgctggcattacaggcataagctaccgcacccagcccccaggacaattcttgatgcctggatttgtgatcctgagtgtgcacatgctgacttactgtccttagggtgtgaaagtaaagataaaattaatatgtaaacgtgaatcactttcttcttctgggctacaattttattttcattggaaaataacaaggtcagctgtaatcatttccaaggtaattccagctctaacatcacatgagctgggttaagatgtcaattttctatttccaggcacacaaaacataactgtagctagcactcagtgacattttcacgtctttttctacatccccccaaaaaacacataacttacatgcctactttgctttcagtcctcaggctctgctagtgaatctgagacagctctggaattgttgttccttattcttaaagattttaaaggattgtgttctgattataaaattatacaaaccccttgtgaaaaaactggaaaagtattttaaaaatgcactcattgttttgtcttcccaagataatcattgttaaatttggatatatatatgtatacacaggtacacacacacacacacacctatgcatatatttaaacattttggggctcatagggtatataggtttgtatctcctcatgtcataacgaattcttcaaagctataattttaatggctgcacactattccatcatatggctgggtgcagtggctcatgcctataatcctagcactttgggaagccaaactgggaggaaagcttgaggtcaggagtttgagaccagcctagtcaatatagcgagatcccatctctacaaaaattttttaaaaattctatcataaatatgaacttgaatttatccaattgtttttctattgttgggcccttacgtggtttccaacattcctctgttgtaaatgacatagcaatgaacatactgatgaaatccttgtatctaagtctttgtctgcatctctgataatttgcttaaaaccgagtcctaaaaatagggtcatataagtggaaggagacaaacttttaaatgattttaacgtgtaccaaccgacaactttccagaaaaatggtatcaatttacatctctaccagaaatatgtgggagagcctatttatttgccaacaccaagtatttaacattaaaaaaatcctatttgacggactaacctataaggtcagttccccttatggtcttgttcttatgaacactgagcttgtgggttgccagactgatatttcacagagccacttcatagtctccagtataccctgctgttctcatgggccctgggtaggcctggcaggctaggtttattgcctcttcttcaggagagagtggtccttggcatgtccctgagaagagtcctgactccatgccccagtgggaataaatgcagctctcagacatttggttgctatggtttctgttgtttccccaagtggaacattcaaagatttgatatcacttactcactcagcagatctttactgagtccttgccatgtgcaaagaatgtcctctgttaagtggaagcaggactggattgcagagagcctggagtgcctgaaattcctcttctgaatttcatgccacagctgagaggcagaagttacagtgagccgagatcatgccactgcactcctgcctgggcgacagaaaaagactctgtcccaaaagtgggctctttgaaggctagaaggtatttggggcagcagacttgtgtggaagcagttatcaaagtggggatgtgacacgcaccaggagaggggaacagacaacacatgaggtaagagattggaggatggagatcggctctggatggtgtcagtggagaggtgggactgggctttattctgcagatgagggaagtgtttttatagacagagcttgatgaagagggcattccaggaaaaacgaaaatgtcataaacaaaagcaggaggcaggaaagcacagagcacatcttggaaattgagccagtgtggttttgccagagtggaggggacatggcagggcatggcagggctgctgagattggagaaggtgggactgactttattgcagagagtctggagtgcctgtaattcctcttctgaatttcacgccacagctgagaggttgaaaagtgctctggtcaacaacctttgttgtctctggtggttgagatcacctctgagaactctcacaatcccatctcttgaggagataaattgtttgcggaatgatttcccaccaagattttgagtagcttcagtggatttccagtcgaaatatctttgctttcataactttgctgcggcctgatggtatcatggaagtcttgattctaccaagccttccagttccggggcctccctggtgagatcagtcaaagtttctttcactccatgttctatatgttggcatgtggttgaagtgaaaatgccgcccactgggcagcacaggggccatggttatacacacacacacacacacacacacacacacacacacacatatatacacacacatatatatatacacacatgtatacacacacatatatatacacacacatatatatacatacacacatatatatatacacatacacacacacacacacacacacacacacacacacacacatatatatatatttttttaagagatggaactttgctcttgttgcccaggctggagcccaatagcgcgatctcggctcactgcaacctctgcctcccaggctcaagtgattctcctgcctcagcctcccgagtagctggaattacaggcacctaccactacgtctggctaatttttttgtatttttagtagagatggggtttcaccatgttgaccatatctggtcttgaactcctgaccttaggtcatctgtctggctcatcctcccaaagtgctgggattacaggtgtgagccactgtgcccagcgggtaacagatctttaaaactctggcagttaagcagggaattttggagagagcctctttcactttttgtcctccagatcttagcattttttggaggggacacggtcttattctgtccccccaattgcagtgcagcagcatgattacactcactgcaaccttgaattactgggctcaagcgatcctcccacctcagccttccaagtagctaggactacaggtacatgccaccatgcttggctagtttttaatttttttgtagagacggggtctcgctatgttacccaggctggtcttgaactcttggcctcaagtggtcctctcacctcaacctcccaaagtattggtattgcaggcctgagacaccacaccaccaggccagattttagcattctaattgtgtagttacagactgcatccctgcttccaaagagtgatgaaaacaaatttaaggaggaaacagtggctttcaatacactctagggcaggcttctcaaactttgttgggcataagaatcacccgaagagcttattactctgatttcaataggtctgggtgggtcattaaatagagtaacacctgtctttggttcgagagacagatgcaattcctgccagcttctgacttctaacattaattgtcagtagcggctggctgcggtggctcatgcctgtaatcccaggactttgggaggctgaggcgggcagatcacctgaggtcaggagttcaagaccagcctagccaatatggtcaaaccctgtctctactaaaattagctgggcatgctggcatgcagctgtagtcccagctacttgggagactgagtcaggagaatcacttcagcctgggacggggaggttgcagtgagctgagatcatgtcactgcactctagcctgggtgacagagcgagactctgtcttaaaaaaaaaaaaagtcagtagggagaaatgattttgcctgatgtttttggtttaggtagttttccctttagaggaggcacaagggggaaacattaaatttgtgccaaaccctggagggactaaagtaaaaagaatttaagtgatagagccattgtgtcttgttaaggcaaaccaaattggtcttttcaggaatctaaattgcaatgggaggaaatctgttcttgctgaatgttccaaataacagagaggcagattctttaatagtgatggcaattagagggactggcctaggtcctccgtactgccaagaactcatggctgagtgacaggtttcaaagaggatttgaaggtggatgatgttaaaatcttacaggaagtcaagaggggcagcttgcttcattttggatggctcatgtttggaatagtctattcaggtctgaggtccactttggggacagagatggggctcagggcagcagagaacaacaatggtgatgagaatcaagtccattgtcgatgaggaacagacacatgagaagaggaacagacacatgagaagtctggggaaaactgaagcagggaaaccatccctgtcctcagatattggaagggctaacttgtggaagagagattttacttgttctgttgcactataaagggtggaagcaggactgatgggtagacttcagctcaaataaagaatgactttttaacaagtagagttgttctaccacagattcagctgcattgtaaggtagcgagttctctgtcactagaggtatgcattaagaactgaccatcacttgggaggtgttgcaaaggggacttaagctgtggcatccacagacccattccactctgaaagattcaatgattggttaatttttccgtacatctcccctcccaccaaccttccaggataggacatctacgtggtaaaatgtgattaattccctaaaatcaaaagaataaatagcctttctgcattttgtgatgtgacattatgttattttcccaattctcatgctctcagacctgttgggtttggtcagactcagttcatcttgcacaacaagcagcaaaagtatccacatacttgtaatggccttttgagtcccattggagggtgaggagggttggtaaagtagtaagtgagaggtgagatcaagttggggaaattttagataaagtctgaaatcctgaattcacaggaacatgggggagaaattctagagaaggacgtgatgattgacggcactgggtcactccctgcatgggagtggtgcccattctcaaatgggcatgagcatggatgaggagtggacagagaaaatgtttgggaaattggcatgatgaacgcattgttggtgagttccagcaacaggagtggcagtgtaaaaacctggcaggggagtacaggtcataaaacaatggtgtctgtcttagttggctcaggctgccacaacaaaataccacagactaggtggcttaaacaacagaaattaattttctcatagttctagaagtcaaaaattgaggtgccttcagggttggcttccggggaggcctctcttcctggcttgtagacggctgcctttttgctgtgtcctcatatatggcctctttactgtgcatgtatatggggagagagagaaagagatttctggtgtctcttcttataaggacaccaatcctatcagattggggccccacccttatgagctcatttaaccttattatctccctaaaagccctatctccaaataccatcaccttgggggttggggctttaacataggaattttgcagagaggacacaattctgtctataacagtatccattgtagcttttgctaagtgtctttgagggtgaagtaattatcctcttgggaggagaaaggagggaagggacactgattgagaatcagctgtgtcagtcacaactggttcattatttcatttgactcctgcaccaaccctgccatgagagaagacggaggcttgcagatgttctaatcacccagagagtaagaggtcaagaaaacattcaaacttgagttgtaaagctcatgctgtctctgcacttgagggaactttaccttgaaaccttgctatattcctaagacagtttttaggcctgtagctgtcaggaagaccacctgacaggcccttttgggtgtccaggaaagtctctgaataggtcagtgttatgatcagagttgtgctttagggaggttgcttggccatgtgggtgggtggggaggtgactgatggaaaggagagaatagagatcctctagcagcccgctacttggtcctgttgagagatagtgacaggcagcacaagggctatctagaaagagctaggtggccataatattgtgaaggcagagtcagagttttggtaaatgattaagtgtaggtcatggggtaaagagagggagtccagaatgaggaaggttgttcccctaatagaaatgaatagaacctgggctcaggacattctgatacccgaactctcctggcctcattccactctcttctcagatagtgagtggggacttcaggacagcctgacattgcttaaaggacaatgtccctgtttgggagagatattggagaggactttttgaacttatgactcatctaatgcagttaataatttctggtaattatgtccttaatagtacagcattaggcttaattatttatcaagcaagaggtgataaatgaaaagatagtgggtcagggcaggtaggccacttgcagaatgaaacttttgattaaaagtggactgttaggctgggtagggtggctcacatctgtaatcccagcattttgggaggccaaggcggatggattgcttgagaccaggagttcaagaccagcctgggtaacatggcgaacccccgtctctacaaaaaatacaaaaactagtcggctgtggtggtgcgcgcctgtagtcccagctacttgggaggctgaggctggaggatcacttgagcctgggaggcagaggttgcagtgagttgagatggaccactgcactccagcctgggtgacaggaataaaaccctgtcttaggaaaaaaaaaaaaaagtggactgttatccccctcaagctttgagcagaaggaggtagatgtctctaaacaacctgccttcccctagtttccccttcttaatgaatggcgtccacccagttactcaagtcccaaatctaggagttacctttgattattctgtcccacatttcccacatctaacctatcaacagagcctgccaactttgtttctaaaacatactccctaatctctacgcttgcctttgtctcaactgctgtcaccctagtccaagccactgtcccctctcacctaagccagggatagtctcccagctggttgttctattttcttccttgcccccaacactgcaatctatacacaacttagagcaatttaaaaaagcaaattaggtcctgtccctctcctgcttaaaatcctccagtgtcatcccatctcacttagaataaaactaactttttttttgagtcagggtctcactctgtcacttcagctggagtgcagtggcacgatcatagttcattgaagcctgcaggtcctgggctcaattgatcctccctcctcagcctcctaagtaggtagtactacaggcacgcaccaccatgcccagctaagtttttacattttttttgtagtggccgggtctcactatgttgctcaggctggtctccaactcctggtctgaagcaatcctcctgcttcagcctcctaaagtactgggattagaagcatgagccaccacacccagcctaaatgactctattttaaaatgttaagatcacaaatcattatcatatatcaaccttctttttgcttctcaactgtgcatacctgtgtcagggggtctttgcttaggtggaatgctattcctgtggtctctgaatgattaacttttttgtcatttagatctcagcttaaaggtctgaattataatagtaattctttaatattagagaaagtccatagagtcaccttctcagactcttcaatctaatcactctgtcataccctctattctcttcatagcacttaccactctcggatcattgtttttgttgtttatttatttatgtttacagtatttgaatataagcttcttgagagtagggattttgtctgtgttattcacagctgttattagtgcttaacacgtgtagtagatgctaagttaatatttgttgagcaaatgtattaatgcacctgcaccaaccactgtctcctcattgtcattctgagaacttcttctggctaagccttcagaaatctccctctcccctgacttaatatttggcactaagcaccagctgccttatactgggaataggggctggtatagttagaacagtttcttggcataatctcttttgggaaataagcgttttgttccaggtttggaccatctttgggacattagataagtaactacaagccactcttcatctgcttagcaagaatggggataattacacttgtttggttcttatcaaatgctgctgtaccttctcctcttggatacagaaggactttagaactttctggagttctttttggcctcaaatgcaattgaattgctgacacagtattatgattggttgtgcaagatccctctcttgctttacctgatactttctttttttgtctaccattcacagtcttattctcctttccccttccagtcttccactcttgggtatttgatacatgtgcttccaatctgtcttctataatctgtatttagacatgtgcgtatccttgaaaaatgcagtgttttgtgcacgtgtccgtgtggtccctagaacctttgtaaaaagtatcaatactgtatgatctagagaatcattattattattaatatcatctctgttacttgggagttcatggagtcacataatttaatagctaggaatcacttgcaaatcatcagctccacgcccctcctcatttgaccaaatgactaaggtccagaggcttcctttgaaatgatttctctcaagaaaattgtcagtgtttactgagagcctgtattgggcaagaccctaagccaccaggcatgctgggggatatggagatcaagggctcatgctcctaggcacacagccttgaaggagatttttagggaggcctggtggctgtgggacttcccatatcttcttcaggattggacacggggcccacaaaagactcacagatgatctggttttgggatacatcccactgctccttctccaatcctctccttttcatctttactgttttccaagtttccacatctgccttctgaaccagctgtccctgatgattccagcacagttttctcccagcccacctctgctctttcttgtccttctcttggctgacatgtctcctctctctttgacccactctgagtgtcctgggagagcacagagccctcacctgactttcttttgcgtttccagattggagcctccctctttgctagtaacattggaagtggccactttgtggggctggccgggactggggcagcttcaggcatcgccattggaggctttgaatggaatgtgagtaacactgcagccatggtgcactggggctggaaggagccttagcagtcaaccagttcaatctatgctcagaggagctgaagatgttagggaacccttcagggtcaccccagggtgcagacagaggaggggcatgacttcaggagcctcagggccctgctccctttccaccagagtagcatgagaaaaccactggtatgacagcaatagtattttttctgttttctcttcatgttaaaaagccaaggcccttctagccatgtttgaggtttggaaatgcttaccaccagatttccattattattattattattttttttaaaaaaatttttattattttatttttagagacaaggtcttgctccactgctcaggctggagtgcagtggtgcaatcatagcctactgcagcctcaaactcctgggctcaagcgatgttcccacctcactctcccaagtagctgggactacaggcatgtgccaccatgcttggcgaattttttaattttttgtagaagcagggcctcactatattgcccaggcttgtcttgaactcctggcctctaataataatagtagtcgtcataataaatgtaattattaattattattattgttattattaaagctctctaaatggcattttactctgtgtaaaccagggaagaggtgaaggagaacccagtgctctagctgtggcccactgctgtgatgttgatgagcagcctcctgggctcctctctgctgttttctagctgctatttccatgggtcagttaggcagcaaaggcctcctgcagtctctaacggctccttaggggagaacatgctgggtaatttttctgcagcagctgaggggcccttcaggtggcagggatgggctaagtttcctcctaatttgagtccaccttttgtgttcatttcaggccctggttttggtggttgtgctgggctggctgtttgtccccatctatattaaggctggggtaagtatctgctctgttatttcatttcctgctggcaaatgtatctgtcagcttggtcttcctagagggcagaggagacattatgggataaatggcagaaaaatctgtggattggctttcactcccaggttatgaaattcccgactgtctgcagtggcattatatggatatattcctcctcctcctccagggcaagggtctggctccttagtgatgcccagtgacaggtttattgggctgggataacacctagctactcctacagtggtagggcatatgggattaaaatgagcaaatggctggaggtcaggggccatctggccacctcgcagacttctctggccagcaaaagttatgaatccttgaccacacttctgtggctctgatattaggatggtgtcactgttctgtctgctctgggccctctggtcactgtggctggcagtgacctccctcgcaccccatgcaggtggtgacaatgccagagtacctgaggaagcggtttggaggccagcggatccaggtctacctttcccttctgtccctgctgctctacattttcaccaagatctcggtgagtccactgccccagagggctgggctgtctcagaagctgccactctcattcctcatcacatgctgcccaccaagaggcggctctatacatttctattaacttggccccttaagccttcttgcgccttggagtagagtcctatttctgcatcgaggagccaatggaattcaatggaaatctgtcctccactgtggtgcaggctgaaaacacaaacaggtttgtgaaggttcagggaaagcagttcttaatagaagattaaaagggagttagggatggaattccctatgatccagcaatctcactactgggtatatatgtaaaagaattgaaataaatatatcgaagaggtatctgcactcccatgttcattgtagcactattcacaatagtgaagatatagaatcaatataagtcccattaacggatgaatggatgaagaatacgtggcatatatacataatggaataccactcggccttaaaaaagaaggaaatgctgtcatttgttgtgaatatgctgtccatgtccataacatggatgaacctgaagaacattgtgttaagtgaaataggctaggcacagaaagacaaatacagcatagtggaatctaaaaaagttaactcagaagcagagagtagaatggtggttaccagggtctgggggtgagcgggtggggagttggggagatattggtcaaaggatacaaaatttcagttagataggaggagtaagttcaagagatctattgtacaacatggtgactatagctaataacaatgtgttttgaaaatcagagaaagattttagctgggcttagtagtgtgtgcctgtagtcccagcaactcaggaggctgagatgggaaccccaggtgtttgaggccaccctgggcaaaggtagtgagaacctgcctcttaaaaaaaaaaaaagatttttaagtgttttcaccacaaaaaagataagtatttgtttgaggtaatgtatatgttaattagctcaactgagccatcccataatatatagtttaaagtatcatgtagtacatgataaatatatacaatttttatttgtcaatttaaaaaaggggggagttagggatatctaagggttggccccaactttagaggcaggcatgggcctttgtgccctgccagggtaaaatctgactctatgtgacatttctcatgcactgaaacacaagcagccagtgccaactctggaaggcactgctgagattctgtcttctttcatggacagagaaatgaaaaccctgcagttggaacgaacttctcctgaatcaggagtagaatccaggtctccgattctcaattcactgtccttttccctgcacaaggctcctgctttttcttggaatcagctctgtgggcctttaattgctaactctctgggggatgtttactctttctgaacccagccactggggctgcccctctaccatctagcctgctgtccttgccaacctggagctgtaggtccaccttgcagagctgagatttctcaaggattggagggcgactggggtacctttgaaagctgagcagagctcttggctgacctactggagcaaacattgtgtttctcttctcttctcccctcccctcccctcccccctcccctccccctcccctcccctccccctcccctccccgtcccccctccctcccttcttcttcattcttcttcttccttcttccttctactttctttgtcttcctttttgtgagatagggtcttgctgtattacccagactgccagactggagtgcatggcatgatcatagctcagtgcagcctctacctcctgggctcaagcgatccttccacctcagcctcttgtgtagctggggctacaggtgtgttccaccatgcccagctaattaaaaaattcttttgtagagacagggcctcactatgttgcccaggctgatctcaaactcctggactcaagcaattcttctgcctcagccacctaaagtgttgggattataggcatgagccactgcacccggccttgtgttccttctttacttcactttttcttccttgtaagtgttcaggtcaattcctcttgattgtaaaacaaaacaaagcaacaataaaaaaacacaaaacaatcaggaaaccactaaacttctgagatatctttctgacagcccaaaagatggtaggaagagaaaagtttgcttgtagattttagtgtgcattttttttgtccccaaggtgactgtcagtctgataaaggttaaagcaatggtatgaaaagaaaagaaaagaaaagaaaatgtaaatgataaggaataagagaaagaaaataggactttagtaagaaaactaccttggagaataattgaaggagctggctcctagtctgttcccctgcccactagcaggtgacctggggcaaatgtcataaaagcttagcttctttatgagtaagatggggatagtaattcctgccttgcctagatcactgggtgttggtgagcatccagtgaatttatctgaaaacacaaagtgttcttgaaatgtaagatataatgataacgaggctgggtgcggtggctcatgcctgtaatcccagcactttgggaggctgaggcatgaggattgcgtgagaccaggagtttaagatcagcctggacaacatggcaagaccctatatctacaaaaaataaaaaatattagccaggcatggtggtgtgcacctgttgtcacagttactcaggaggctgaggcgggaggatcacttgatcccaggaattcaaggttgtgagctatgattgcaccactgcactccagcctgggtgacatagtgagatcctgtcactaaataaataaataaatgaatgaagatataatgataacgaacatggttaactgagagccttcagcactctctgcaagaagctctctgggttgcagtagggcagagagagaggtggtgttttctgagaccacatagggagtagctccagcttttccccttagccagcagttgcaaagtgctcattgctctatcaaaatggtgatctcgttgcctatgatcagtttttctctctcttgttgttctcccctatccagcaccaaaggcgagattggtccaatctcagtatcttgcaaaagatctgccctgggtgagatgtgagttggattggatctgaattgagccatctactctagctaggtagggttctgaaaatacagttgctagtgtttctattttcctgattacttaaagttgagacaacagcaacattaaataacatttgcattttttttattacggaaaatttcaaacatatataagcaaagatagaataggataacaagcactcacggacctaacactgatcacttagctttaacaattgtcaacattttgccatttttggttcatctatcctcttccaattttttccccagcagtattttattttattttattttttccaacttttattttaggattggggtacatgtacaggttatatggttaaattgcatgtcacgggagtttggtgtacagattattttgtcacccaggtaataagcataatacctgatagttttttgttcctcacccttctcccatcctccaccctcaagtacgccccagtgtctattgttcccttccttgtgtccatgtgtactcagtgtttaggtctcacttataagtgagaaaacatgcagtatttggttttctgttcctgcattaattcaattaggataatggcttccagctccatccatggtgctgcaaaggatgtaatctcattcttttttatggctgcatagtattacggtgtatatgtgccacattttctttattcagtccaccactgatgggcatttaggttgatttcatatctttactactgtgaataacgctcagcagtattttaaatcaaatctcagatcccatgtgatttcactgtaaattcttcagaatgtacctttgacttttaaaaaatataaccattgtgctattatcatatctaacaaaatttacagtaatttcttaatttaggtagtttaatacctggcccatatcaagattttcctaataaactcaaaaatgttttcttacagttagtttgtttgaatcaggatctgaacaaagtctagatcacatcacatttggttctttctttaaaggaaatatacatgtgtaggtcttcagcctactacagttatttttcccttttacattattaccttcctgtcctggcctacatgaataaacatttttttattgggttatgtgtctatttcttgatcagttgtaaaaattcttcatatattctggatgttagacccttatcagatatatgacttgcaaaaatttttttcccatcctgtaggttgttttttcactttcttgataatgtcctctgatgcacaaaggttttaaatcttggtgaagttcaatttgtctattttatctcttgttgcttatgcttttggtgtcatttctaagaatccactgccaaatccaaggtcatgaaaatgtacccccttgttttctccttagagtttcatagttttagtgcttatatttagggctttgatccattgtgagttaatttatgtatatggtatggccatgtgccaccatgcccaacttcattctttcgcatgtggatatccagttctcccagtaccattttttgaagaaatgattgttttcccactgaatggtcttgcacgtaagttttcactgaacttggtgaaaacaggctcttgccgataatgctgttaaggttttgtcttggagttggggccaacacctaggaatagtgctgcctccttgtgtagcttcctgactcacactgcttctgccctcgacccatgcctttgtgctttctccactaatgtcatgattcagcctcctttactttctcctcctctgcttcagggttggtgttttttttgtttgtttgttttgtttttttagatgtagtttcactctcgttgcccaggctggagtactgtggcgcgatcttggctcactgcaacctccacctcccgggttcaagtgattctcctgcctcagcctcctgagtagctgggattacagccacacgccaccatgcctggctaatttttgtatatttttagtagagacggggttttaccatgttggccaagctggtctcgaactcctgacctcagatgatccgcccgcttcggcctcccaaagtgctgggattacaggtgtgagccactgcgcccggcccccgggttggtttttagttataagatgaaaggcctgggctttcccattttatttgattagagaccagtgtgcaaagcctggactggaaaatgctgggagggctagagaaatcgggctttggcttcctgagaaagggcagtgtgtctgtctaagaagagaaaagggaatgtgagcaggagggtgaggaggtcacactgcaatgagcaggagggtggtacctgtctactgtgcacgtagagaagggtgctgggcctccccttctcccaggcaagtgtcctccaagtccacagttcaagcaggtgaaagtctgtggactgcagttgccatggtaagagcactctttgtcctcagagctggtgcaggggtggcaggggtggtcatataaataaattaggtgcccaacctctctccctgccttctctatcacctcacctatttttcaagttactgattaaaccttcttggacttgggagcccccagggagctgagggacagcctctttcagctcagatctggatggagcccatccccgaggagcccgctttttctaaatttggcttttgaattgtatgtgttgtgtgctgctccctctctgtgtgatttttgaggctccttaccctcgtcaccctcctgctcacgttccctttctcttcttggacagatgcactgccctccctcaggaagctgaagcctgatttctccagccttcccagcatttcccagtccagactctatacactggtctctaaccaaataagactgaaaagcccaggcttttatcttataattaaaaactaaccctgaaggaaaggaggagaaagtgaaggaggctgaatcatgatattagtggaggccatgaccaacattatacttactccatccattgcccaagaccagggatcccttgacaaatacataagaagtttgatagctgccctctacttagtgctggtctcgtcatttagtctccaacaggggttttacttacaccctctccagttctcagaagagtacagcatgggtagggatttctattatttatttgtttgtttactgagatagggtattgctctgttgcccaggctggagtgtagtggcatgatcatgggtcaatgcaaccttaaactcgtgggctcaagtgatcatcctgcctcagcctcctgagtagctgagactacatccatgtgccaccatgcccagctattttttacttttttttttttttttttttttttagagatagggtctcactatgttacccaggctggtcttgaactcctcacctcaagtgatcctcttgccttgacctcccaaagtgctgggattacaggtgtgagccaccacatctggctgggatttttattttattttccattttatgggagagaaaactgagtctcagagaagttaggtaatttccccaaattacacagctagtacgtggcaaagccagaactgggagcagggtctctccagtgccaaagtctgttctcagtgttctgccctgtgcttgggtgggatgaaggcatagaatgaggggatgggatagatcatgtggtcttatgttctgcgctttcattttacagatggagaaactgaggtccagacaggggaagggactatgaggggttaaacaggagcagaactgggatgagaagcagatttcctgacactgaatctaaaccttttgacattatatgccccctaccttctaagtctttcattcttccagtacagagtaggttagaattcaagaccctgggaaaaatgaagagagccagttaaatgaacctcacaatataaatgagttgccaagagtaggatttgagaggactatggggagagaacatcagctgcacactgggtatatgaaggatctgaaggagggacatctgggcagggggtagggtagggagggatgcagacaggcaaggctttgtcttcgtaaattcggctggttttaggttcaacatgggtcacagagcattgaaattttaaaaagaattacaccgatatcaactgtacctgctagaagctcacttcaagacacacaggaatgcagggctcatggacaaaagaaaataactgttcattaacaaaatacggtgataaggcatttatattccacacaaaccaagattcaccaattgtgtgtgtgtgtggaagggcacggatggtttgtgatgggtgagaagagaggagggttagtgtgagattcctgtccagagagcgaacaaccagggacctgccacgaaggcttggggagaatgtagggatccagtggggttgtaattaatgggagagaggagaaagtacagggcattgtaggtgcagagcccagatgtggcccaggccattggcagctgtgatgtggagcgttggctatggctaccatcttttggtcacgtatttttgggctctgagactcagaactgattgtccttccatgagctcctgaattttattggctccctcgagcacctgccttatcaagctctgagaagcattccattctgtaaaatttcccggcatgtgcatcttatgcaaatgtgcacaatccctggagataaagcctcagattttatgacttacatgtgatgactgaatgttcacgtccccatttgtgtttcctagggctgttatcacagatcacagctacagtaaatgtttacagcaattctgctgtccattttggatccttgggtgaaaagaagagcttttgcttttgcttaagatttgaatgctcattcccagggccactcactttcacaagtggaaagagaaatttgagtaatggggcttcaccatctgaaactgcgaggctaggcaggatttatcgaatgctcaaatacatcttggttacgaccagaatggacagcaaacacacacatataaaatcactggatctcaaaacatcagagccaaggcgaagcaacatgcccaagctcccaatcagagactcagttacttgcagatgctttccaacgggggtctgtatttttattccccatgaattccatggacatcgttcagccaaattttcaacgtgatgggaacaacacccctgggctaaatccaacacacgatctatttttgtaagtaaagttttactggagcccagccaagcccattgtttgtgttgtctgtggctgcttttatgctttaacaacagagtgtgacagagacagtaaatgcaaagcataaaacatttactcccgggccctttacagagaaagtttgcaaattcttgatctagaggaccataattttttatttcacttcaagttggttttgcttagcagcattggagaaattttcttctttcccttctgcctcccctttccctctttccttccttctttccttccttccttccctccctcccttccttcactccctccttctctcctttctttctctctccctctgttaccttccctttctttccttccttccctcccccttcctctctcccccttttttcactttcttcctttccccttcttccttcctttcgttctctctttccttctctcccttccctttcctttccctccctccatccttccccctactctcttttaagggctaacattaatttagggaaagagcaatctgggataagctgtgaaacaaatggtctcataggatgacaggacagttcttttatatcaaagctggtgctgcattccctatacagtcccctatttttatgataaaaaatttaatgaaatacttcaaatatacaggaatgcagaaagaatatagcaaacacccttatattcaccactcagattttatagatcttaacaatatattatttgtagaaaagaaataaaacattacagatatagccgaagacctatttatacccttttcttggtctcattttcctctttcctaaaaggtgaatgctgtcttgaacttggtgtggattcttctagactatgtttttatatttttactacatatatatatgggtacccgtatagccataaagaatatattctgttttaaaatttctgcttcctgcacttttgaaactgtaggaaaaatgtaacattggcatttaaaaatcttggggtgggagatgcacactttaactccaataccaatattttcatattttggccttgctcaaattgtgtgtattctttcacaaagttgcaattagaatatgcgcatcattttgttgtcttctccccacccctaccatcaaattgtaaatgttccagtttcagttttcataattattatttttaggggctgcagaacataactgttgacatataatttttagaaagccatttaaaaatcctctggtggacaaaaatctcttgacagtggtcacttctgggctacttttacttttcagtgtgtaacttctgcggttatttatttattcaatttttatttgtttttctttttttttgagcaaaactctatcacccaggctggagtacagtggcacaatctcggctcactgcaacctctgcctcccaggttcaagcaattctcctgcctcggcctcccagttagctgagattacaggcatgcgccaccacacctggctaatttttgtatttttagtagagacagggttttaccatgttggccaggctggtgtctcaaactcctgacctcaagtgatctgcttgcctcagcctcccaaagtgctgggattacaggcataagccactgtgcctggcctgtggtgtttattttaaccccccacacatacattattttatttgagattttattttaaaagtaaattaaaaactttttctttgttgctaaaaaagaccttgctggctgagcatggtggctcaggcctgtaatcccagtagtttgggaggctgaggtgggtggatcacaagatcaggagattgagaccattctggccaacagggtgaaaccctgtctctactaaaatacaaaaaaaattagccaggcatggtggcacgcaactgtagtcctagctactcaggaggctgaggcaggggaatcacttgaacctgggagatggaggttgcagtgagccgagattgtgccactgcactccagcctggcgaaagagcaagactctgtctccaaaaaaaaaaaaaaaaaaaaaaaaaaaaaagaccttgctctctgtagaaaatattccagaaagcagaaaggaggtcccttacttttcaatgttgttttgaggatcaaaataacgcatgtgcctaaatgtccttggtaaactgtaaaactctctgaacatgaagaaaagaaaacaaacaaacaaacaaacaaaaaaaaacaaccctagtgggtttgtttggcagctaggaaggaccaaagactaatgtcagagcacccagactagagtggccttgctcagctggagtcagctacataagcttagctaaggtattcccagcctggcctttggcatgccaaggcagaattcatctctgaagttagaatgactcatgcgaggaagaatttgtcctaggtttcttcaattcaccagggaggtttccttagaatcctttatctgtactgttagaaggaaatagaatatcataaaaacaagacttttattagcccaacacttttcagaagtctttatagaggtcatttatagcattatcttataacttatgtgttgcctctttgtgactaatgacagcaaggcacatattaatgagggtatcacagtctacgatggcatgttgtcataaagcattaaaaattaactactctggaaaatcaaccaagggcagtttaaaggcagtgtcagctttgtaatcttttcctatcttatttacacttattagctaatccaccaaatcaaacgtgtgtgcatttaacagaatttcactgcaatcagtgaatggggccccttgaatttaagtaactttatgtgactgtgtagaggcatgagaggagagggaccagcattataaatattcattacaatttcaaatggcccagtgtgcagagtcaggaagaagtggccatttcacttttggcaagacttatgcacagcagaggcgccttcctcctcttgggctactgcagagggcaaggcagaatggaagcggtccagaacccgggagaagaatgctttcctcactgcagacctttcccacttccaaccactgagaatcacaagtccctggagccaggacttcctgcataaacacgaggacactgagaattagagaggggaaatgttttgcccaaaggtttgcaggcctagagtggcggcactggggctaaaatgctggttcttctgactgctaactccagggagagaggagtttctttctaactcaccatctctcctcccacctcctggctctgcctcccctccttcaccagggaagatggtgacattgggtcccctgggtgagagaatcttcaggggagatctgggcagaggggaactatggcatcaggtcctcaaaaggcccaccttcgggaaggaggtcgaatcaccctccagggctcacgtgttagctcagaagcatggagttggtattagatgtgctctttgctaactgatggagggagggaataggagattctcataggagggacaggcaggtatggtgggaaacttaaacactggagggccctcaggagcagcaatgggatggggactgggaaacggaactagagaggagatgcaagatataagaggagatgtgagaagtaagagtccaaccctgctggcccatccccaaggctccgtctgggtgctgtttgcgtgccgtgaaatgttagggtttgtgcagtgaaaacagttcgtgcattcattccatctagggaagtccagtttcgtccacacctggagatttgaaaacaaaagactcagctgggcgcagtggctcacgcctgtaatcccagcactttgggagtccaaggcaggcagatcacgaggtcaggagttcgagaccagcctgaccaacatggtgaaatcctgtctctactaaaaatacaaaaattagctgggtgtggtggtgcacacatgtaatcccagctactcaggaggctgaggcaggagaatcgcttgaacccaggaggcagaggttgcagtgagttgagatcgcaccactgcactctagcccgggcgacagagtgagactctgtcaaaaaataaataaataaaaaagactcaccatgatcatcccttaatactaccctccctggtattgttttggagatgacatgaacatgcatttggggtgaccctggtgctctctgctggtttatatgagcaactgcaccatccagccaggtagaaggttcattaggagaaggctgaaagagacaggaaggaggagaaagggtgaagatggaagaactgcatcaagaattcaggagtgaggagggagcaattctcccagaaattacatgaaataatctaaataaaaccagcaagtaccaagcctgctatgtaagaggtgcttggtgatgttctggttgtgtctgagtcaagatggactgcatccgggttggggagttaaaattacaaacttgctaagtttctccccgctcctgggtgggggtggggtttctcacttatggactctccagcactcagacttgcttttggggacgagctctgataaacctgtgtacactgaggtgcaaaagatggacaatagctcagagcaacagtctacaggtgacttgcaaggaacctctaagtgttaatagctgttccttggcaaaaagagttcaatagttgagtgagtttgtgagatgtcatgtaccgtgttccctccctggggatgactgtacatggcatatattaaaggctcagaaaagttgtgtggcaaagaaactgccttaattctgtttagcattttatagacctttttgaccatggaattctttttctcatggaatacgtattatcatcttgaataaagcttgcttggaaaatcaggagtagagagactacaggccctgtaggcagctgaccactctccctcctaactccgcctctcctctccttccaggcagacatcttctcgggggccatattcatcaatctggccttaggcctgaatctgtatttagccatctttctcttattggcaatcactgccctttacacaattacaggtgagtccattcaaataaaccagcacctcaaacccagctcgggatcaggcactagtgaaggataaagggaagtaggagaggtggtttctcttcttgaggagagatacactcaggtaagagtttgggagtgaggtatttgcttagtaccaactcatagaccctccaagttatacaagtggtttcagaaagctgtggtgttggctgggatagtcagggcagcttctcacaggagtgcatgcagagctgggccctgtgggttgtggagatgacttagctaaggtgggagaatcagagcagtggcaggtgcagaaataagtgagcacaggggagtggaggcagggtgggcacgcagatgctcttggctggaggagggtggccactgaaggatcgtgggggtttgtggggaccatatagcttgatagttcagatgaggtcacagcatactgtgtgttttgaacacagtatactggggtttggaaagccaggcagaggccttggatttgatgtgtcagggactgggagcccctgtaaggagggagaaaggcagtgactcacacacagaggtttcagaagaggactcaagtggccacccaagaagctggtgcataaatagcaattggggctcctttgcagaggggtcactctgcctccttggtgggggtgggagggatcagctttagaacttgctgcttgactgcagccccacagctttggggactaagaaaaaggtagacatatgtcccaccatctccacagccagctctttgctcctccctgccttgtgtgtggaagacgcttcttcttaccacagaggagtcatctcctttgagccatcttctggctcaaaagggtcacaccagactctttcccctcaagtagggagaaacattcgccacttctatgacaggtggagctgtgggaacatgctgaatagcaaaatactgtaacaggacaagggagggaaggaaggagaggcaggcaaaccactgtggggatgttctcagaaggccagcaggaagtagagggtggagagtggggaaggaagcaagtagacaggtcaccctccacacgaggtcagatgtgttgtcttcttgcctgcttagggggcctggcggcggtgatttacacggacaccttgcagacggtgatcatgctggtggggtctttaatcctgactgggtttggtaagtggggccagggcaggctgaggaggtgggagcagaggtagagggcctcaggaagaggaaggcaagtccagcctctctacctgcttgccagactaggcagtgagctgaggcatgctctgcccttccaaacggagggtccagcccagatgggctgtcattgtgggtatgcagggtcagcttccttatccctggaagactgaagctggggctggtcctggattttctgctgccctctctcaccagtctgggctagtggttgtgctgtgagcctgtgataacatggtgttctgtttgcagagaaactggacaaaaaaggataaggctaaatatccatcaagctaaatctagtcaaatgttgcgtcttccatcttaggctatatcttatctacattttgatgtcaaatatcctttcttttatgaattgttgatagtgggtgataatgttccttttaatgcccctatttggcaaaattaaaaacttggctcctcagggttggccctccaattaattttttttttttttgcaattttacttgtctatgaaatcttaaagatgagactggagaacctaggtaagggtacttattatgggaggatagaaagtacattttatttctaggtgctcaaggcccactgtgtatcctgcaaaaacttgtatttgctctccactcttctgttttctaaggactttcatttggttctccccagcaggccttgggtgttagctaggcaggcagtggaatgacttattcaaggacacacaattgagaggtggcaggttctggattcctcacccattccctgtccatcccaccacatgctgggtccaggagtggtaggtgtgggtctgaggtcccaaaggccactgtgtgtgtctaggtctgtgtgtctctaggcctgagtccaaggctccaaaggccatggctgacagcagagggtgagggaaaaaacagagtctttgtatgtggtcccaaaccaaggtctttctttgattaataaaagtcccttcccttttacaaagaggtttacagttggagtacttttacaagtgattgctttggtccccataatagcccccaagggggctgggcagggctactaatctcattctatggatgacaaagctgaggcccagaatgggaaggtgatttgcccaaggccactcagtgagggctctgtctgtgggttgggtcctctcagtttctcaggcatctatggaaagaagctgctatgacgagttgaaggtttcagaatgttcatttctgtaccgatgttttccagcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtacccaagctggatgtgcgggatggacagagtcttctccagggccctacaggaactcctgtctgtctgtggtttgcagggttgggacagggaggggagagctcaggtggtttgtaagttgccacgccccagtgatacagcagtgccaggccaatgacccaagatggcgaagctaggaagtacaaaggtgtcacagggtctctggtctgcacacctcccttactgggctttttctggcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacaggtaataacttctgctggacccacaaaccactctccctttttctgtctccaagtcacttctaaagctctatagcttcccgcttcctcctctttttttttgagaccaggtctcactctgtcacccaggctggagtgcagtggtgtgatcattgctcactgcagtctccaactctaactcctgggccctagtgaccttcctgcttcagcctcctgagcagctgggactacaggtatgtaccaccatgcctgcctaatttttaatttttttttttgtagcgatgggattttgctatgttgctcaggctggtcttgaactcctggcctcaagtgatcctcctgccttggccttccaaagtgctgggattataggcataagccaccacgcctggccctcttctttatttgttatggtcatatccaagcattattgctcctgtgctagacagtgagcaacttgagggaacttttggagttgtcttccctggtttcttatgtcgacaattgtttcctccttttttttttttttttttttcaaatcttctaaagttatgacatgcctccaggtcacttctccctaataatatttgctcaattgttgcttaatctcttgctgtcatccttccaccctgaatgtttctttgatttctttcctccgttgcctagaaattgtctttcttccttagtcagagctcatcagtgtgtcagggccagcagggcggggcaggcaccaaagggttctgtggagagctgcactcctgaggaaccatttcagagccttggaaaggaatatcctgtttgaaaccttgttttaagaaggtgaattttggccgggcacggtggctcacgcctgtaatcccagcactttgggaggctgaggcgggtggatcacgaggtcaggagatcgagaccatcctggctaacacagtgaaaccctatctctactaaaaatacaaaaaattagccaggcatggtggtgggcgcctgtagtcccagctacttgggaggctgaggcaggagaatggcgtgaacccgggaggcagagcttgcagtgagccgagatcgtgccactgcactccagcctgggctacagagtgagactccgtctcaaaaaaaaaaaaagaaggtgaattttggaaatatttccccaatgtctgcttgctgacgtggctctccatctcttcccagaaaaaattgcctgtgtcgtcccttcagaatgtgagaaatattgcggtaccaaggttggctgtaccaacatcgcctatccaaccttagtggtggagctcatgcccaatggtgagattctttcttgggaggttggtagagtctttcttgggaggctgattgggtttaggcaccacctacattcctgtgaaccttctgggcaaagacatttcttagccggggggttagaagggaaagcatcattgtgggtgtcctcagtttttggacatgtcctctctcagtgggaaggagacatatgacttggttgggttctatgagttctgggacttgcccatcagtcaggcttggaaaggagatgatctgaaaacttgttagagaaaaacatgactttccatactcatacagaaggtctttcaaagctctccaacagtggatgtaaattagcacacccattatggaaaactggatggtggtccctcaaaaaattaaaaatagaactaccatatgatctagtaatcccatgactgggcatatagccaaaggaaatgaaatcagtgttttgaagagatatctgctctcccatgttcactgtagcattgttcacagtagtcaagatgtggaatcaatataaatgcctatcaatgaatgaatggatgaatggataaagaaaatgtaatatacagtatatacacaatgggatactattcaccctcaaaaagaaggaaattatgtcatttatgacaacataaatgaacctggagaacattatgtttagtgaaatactttagactcaaacaaataccacatattgtcacttacatgtagagccttaaaaagtcaaatttgtagaagcagagagtagaatggtggttactaggggttggggtggggatctgggaagatgttggtcaatggatacaaaatttcagttaagaggaataagttcaagagatctattgtacaacatagtgactatagttaatagcaacgtattgtatacttgaaaattgccaagagtagattttaactgttctcaccacaaaaaatgttaagtatttaaggtaatgcatatatttgctaattagctcaattgagctaatgtatagatatttcaagacatcatattatataccctcaatatacataacttttacttgccaattaaaaaatatttttaaaaagctctccaacagatgttaaaatgaaggcttgaactaggtccaaggggttttacctggagaatgaattgacttttatgctcttccaaggaaacacatggggaaagaggcaagatttcagctctagaatgagaaagtctgaggcaggagatggatggcattcaaggcggcttgtcaccataaagaatctgttttcctaggagactgagtacttagctgtgactcctgaatagctagagttttgtagttgacctgtgggattacagtcatgtttcagaaaaatctcctaattctggctcaagggatacaaatctggctagggggttaggttagggggtttcaggagaacaaaacttcaaagttattacctagaaaaatttagaataaacctataaaattgtattactgaaaagaaacttagagactagtcaaattctttcattttacagttggggaaacggaagccaatagaggggaggtgagttttccagggccaggcaggaacgtggtgtctggcatttggcatgcttaacgctgctcaaggctggaattgaggaattcgggagagtcttttaaaaaattaaaaaactacaaacttcatgcatgactttgggcaaaccatttgcattcaaattatataaaaatgggaataatacttaactagcctactgagctgggctgcttattcataaggttacaattagcaggagtcacagtgactcttctagaaaagttctggcatggattgcattggcctctgtggagtgtttatgttattcctttaggtgggcagaccctcctagtgaggactaaacattatgcgggagtggactgtgcacaacagaaagatgtgtggcatgcagaataaaatgccgtgcttccctgtgccattgctagtccctcctcttggctgtaatctggcttcagtaaatactgcattcctttttttttttttttttgagatggagtcttgctcttatcacccatgctggagtgcaatggcgtgatctcagctcactgcaacctccacctccccagttcaagcaattctcctgccttagcctctgtagtagctgggattacaggcacctgccaccacgcccagctaatttttttgtatttttagtacagacggggtttcaccacattggccacgctggtctcaaactcctgacctcaggtgatccactcgcctcagcctcccaaagtgctgggattacaggtgtgagtcaccatgcccagcctactgtattccttaatgacctccctgtgctagactaaatagatattttccattcctcaccttactggatccctcagtggcattcagcattatcgatcactcatccttcttgagttgttctcttctcttggattccatcatactgtattctcctgtttgtctttttaaattttccccatcctctctggctgctccttttcattccatttgcagattcagcctcctccactcagcaagtaggtgatcctcccaccaatccacaccaacttgtgtctattttgtctcctaatgtatgtctctctatttttacttttgttaccctagtctgatagaccattattttttgcctagaccactgtaaaattatgcactgtaaaattgtgttcagcaaatatttgttgagtaattaaatgaatggggtctgataagagtgtcatacagtggggaaagttctatcccagcttaccaatttcaaggcaaagtaatcctgaacgaatggcagagctagggctgaaagcccttcctactaactccttgaaatggacctttatcaactgaaaaatgagataattggacttgatgatctttataacttctatatctctgatagtttgtgatctataccacacaaactcagaaagagccattaaaaaaacctcgcaacaaatgacaaaataattagaataggcagcctttagaattcatcttgcaaggctgtaggtgagaccataaattatttaaagatataaaacctagaggaaagacagaattgtgttccaaaaagatctcaagaggcatgaatgctgactcagatctaaccagctgaagtttaatagaggtataagtaaagttctaaacatttgggtctcctaaatgcagttagataggaatatagagaagagagagttcaagggaacatgagttatctttgaatatatgaaagatggcaaaatggataaggagtaagacctgttctgttgggtaccatgaggactacatttgatgctatagagaggtagatttcagcctactcagaactgtctgagggcaggttccctgtagggtaggagatttcctgttgctatagagatgggcagaggaatgttgtggaagggattcatgtatcagatggatgataggtctaggtgatcctaaggttacttttactcctgaaactgtaaaactcttgttagtgggtcctcagcttggcctggccttctagcctcagcaggtgtccccctgtacactccttggtatgggaagaataatagagattatagccaaccaggcttgccataattgagaaaactttaataacaagagttccgtattcctatttgggaaggtgtagtattccgtatactgatttgggaaggtatccctgtttaacacatcaagaaatgaggcctagagcttgacgtaacttgcttaggatcagagttagaaatacagccttgtctttcaaaaaaaaaaaaaaaaacaaaaaaacttaattgagcttaaattcacctatcctacaattccctcatttaaaatgtacaattcagtggttttttaagtatattcacagagttgtgcaagcatcactgaaataaattttagaaaatttgtgtcatgccataaagaaatcctatacctgctaatgaaatgagcagtctctccctatttcaccccaacctcccagtccctggcaaccactaacatactttctgtattcctagatttgcctattctggatatttcatataaatagaatcatataatacgtgtttttttgtgacttgcttcttttacttaacataatgtttgcaaggttcatatgtgtcctagcatgtatttgtatgtcattcctttttattgatgaataatattccatcacatgtttacccatttgtcaattgcttatgcattttgtttatccacttatcatttggtggacatttgtattgctcctcctttttgggtattacaagtaataatattacaaacattaatgtatgagtttttgagtggacatatgttttcatttctcttgggtagagagaaatgaaattccacctaggaatggaatttcatttctcttgggtagagagaaatgaaattccacctaggaatggaattgatgggtaatatggtagctgaatgtttaaccatctgaaaaactgactgacccagactattttctgcagtggctgtaccattttacattcctgccagcaatatatgaaggtcctcatttctccatatctccactcacacttgttatttctgttttttaaaaatttattatcatagctatcctagtgggtacaaagttattatcccactatggctttgatttgaattcccctgatgtcaagcatcttttcatgtcattattggctatttgtatggctttggagaagtgtctattcagatcctttggcattttaaattgggttgtcattttattattgaattttaggagttctttatatgttcttatattagacccttatcagatacatgatttgcacgtattttctcccagtctgtggatggcttactttcttgagagccccatcttttgaataatagtttaaatctctttctgttatatcataaatatttcaggtgagagaccttataaaaatcccctcagatggaaacacacatacacaaacacacacacacacacacacacacacacacacacacacacacaccccaccaccttcatcatcgtccagttgcaaagtattcacctcaagtatgttgtgtctctggctctttgtggctgctgtgggcttataatgggctaataaatttaaagccataggactacttcttaaagcttctagtctttttggagacagaaattggataacatggcatggtttcagaaggcaaacaaatcttgagtcctcatatatttttcaagtacaaaagagctgaaggtgctgttatgtgccactcaaaaatccttctcttccaggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggtaaatgcagcttcccccaagccacaaaagcttgaatgatcagagaggttccatctgtgttacccctcaagctagggaaggttggcagatgcctgggtagaatgggaataatttctgtggctggttatatgtgccatttggtggcatttaactttatttacttattattttattttattatttttaaattttttatttccattcatgtttgggaaacaggtcgtatttggttacatgagtaagctctttagtggtgatttgtgagattttggtacacccatcacttgagcattatacactgaacccaatttgtaatcttttatccctcgcccccctcccacccgtttcccgtgagtccccaaaatccactgtatcattcttatgcctttgcaacctcatagcttagctcccacttataagtgagaacatatgatgtttggttttccattcctgaattgcttcacttagaataatagtctccagtttcatccagttgctgcgaatgccattaattcgttcctttttatggctgagtaggattccatcatatgtatatatacaccataatttctttatccacttgttgattgatgggcatttggtctggttccatatttttgcaattatgaattgtgctgctataaacctgcgtgtgcaaacatcttttttgtataacgacttcttttcctctgggtagatacccagtagtgggattgctggatcaaatggtagttctacttttagttctttaaggaatgtccatactgttttccatagtggttgtattagtttacattcccaccaacagtgtaaaagtgttcttttcaccacatccacaccaatatctattttttttatttctaaattacagtcattcttggagtaaggtgattattttttccttgttaatttgtttgaaattttttgtagattctggatattagtcctttgttggaagtatagattgtgaagattttctgccactgtgtgggttgcccgtttactctgctaactgttccttttgctgtgcagaagctctttagttaagtcccacctatttatctttgtttttgttgcatttgcctttgggttcttggtcgtgaactctttgcctaagccaatgcctaggagggtttttctgatgctatcttctagaatttttatagtttcaggtcttagatttaagtccttgaattatctcaagttgatttttgtataaggtgagagatgagtatccagttttattctcctgcatgtggcttgccaattatcccagcactatttgttgaatagggtgtcctttccccactttatatttttgtttggtttgtcaaagattagttggctctaagtatttgggtttatttctgggttctctcattctgtttcattagtctctgtgcctatttttatatcagtaccatgctgttttggtggctctggccttatagtatagtttgaagtcaggtaatgtgatgcctccagatttgttctttttgcttagtcttgctttggctatgtgggctctttttttggttccatatgaatgtgagtattgtttttcctagttctgtgaagaatgatggtggtattttgatgtgaattgcattgaatttgtagattgcttttggcagtatggtcattttcacaatattgattctacccatccatgagcatgggatgtgtttccatttgtttgtgtcatctgtgatttctttcagcagtgttttgtagttttccttgtagaggtctttcacgtccttggttaggtatattcctaagtcttttttcctttcttttcttttcttttctcttctctctctttcttttttttttgcagctattgtacaaggagttgagttcttgatttgattctcagcttggtcactgttgatgtagcagagctactgatttgtgtacattaattttgggtcctgaaactttgccaaattcatttatcagttctacaagcattttggaggagtctttagggttttctaagtatatgattgtatcatcagcaaccagtgacagtttgacttcccctttactgatttggatgccattcatttctttcttttgtctgattgctctggctaggacttccagtactatgttgaatacaagtgggtgagagtgggcatccttgtcttgttccaattctcagagggaatgctttcaacttttccccttttggtattatattggctgtgggtctgtcatagatggcttttattacattaaggtatgtccttttatgccaattttgctgagtattttaatcataaatggatgctggattttttcaaatgctttttctatgtctgttgagatgatcatgtgatttttgtttttaattctgtttatgtgatgtgtcacacttattgacttgcatatgttaaaccatccctgcatccctggtacgaaacccacttgatcatggtggattatctttttgatatgttttgagattcagttagctagtattttgttaaggatttttgcatctatgttcattagagatattggtctgtagttgtctttttttgttatgtcctttcctggttttggtattagggtgatactggcttcatagaatgatttagggaggattccttctttctctatcttgtggaatagtgtcaataggatcggtaccaattcttctttgaatgtctggtagaattcagctgtgaatccgtctggttctggactttttttggttggtaatttttaaattaccatttcaacttcgctgcttgctaatggtctgttcagggtatctaattcttcctgatttaagctaggagggttgtatctctccaggaatttatccatctcctctaggttttctggtttatgcacataaaggtgttcatagtagccttgaattatcttttgtatttctgtggtgtcagttgtaatatcttctgtttcatttctaattgtgcttatttggattttctctcatcttttcttggttaatcttgctaatggtctatcaattttatttatcttttcaaagaaccaactttttgtttcatttatcttttgtattttttttttggtttcactttcttttagttctgccctgatcttggttatttcctttcttctgctgggcttgggtttggtttgttcttgttcctctagttccttgaggtgtgaccttagattgtctattgtgctctttcagactttttgatgtaggcatttagggctatgaactttcctcttaacaccacctttgctgtatcccagaggttttgataggttgtgtcactattatctttcagttcaaaaaattttaaaatttccatcttgatttcattgttgacccaatgatcattcaggagcaggttatttaatttccatgtatttgcatggttttgaaggttccctttgaagttgatttccagttttattccactgtggtctgagagagtacttgatatgatttcaattttcttaaatttatttagacttgttttgtggcctatcatatagtctaccttggagaatgttccatgcactgatgaatacaatgtatattctgtggtcaatgggtacaatgttctgtaaatatctgttaagtccatttgttccagggtatagcttaaatccattgttcctttgttgactttctgtcttgatgacctgtctagtgctgtcagtggagtattgaagtcctccagtattattgtgttgctttctatcttatttcttaggcctagtagtaattgttttatacatttgggaggtccagtgttaggtggatatatatttaggattgtgacattttccccttggacaaggccttttatcattatataatgttcctctttgtcttttttaactgctgttgctttaaagtttcttttgaaacgttaaagaatataagaagagctacttgtgctcacttttggtatccacttgcatgggatgtctttttccacccttttaccttaaatttatgtgagtccttatgtgttaggtgagtttcttgaaggcagcagatacttgattgataaattcttatccattctgcaattccgtatcttttaagtggagcatttaggccatttatattcaacgttagtattgagatgtgaggtactattccattcatcacgctatttgttgaaatacttctcccgtgatctagaccttcaggttccccagtgagggtctgtgtttgggggcggatgatccccctttcccacattcacagtttgggctctcacagtatttgggctgtctcctgggtcctgcaggagcaatctgctaccttcagagggtctgtggatcctcttggctttcctggtatattcctgcagtagttcttggagcaaaagttcatgatgctagtctctgcatgatgctctgtccatctgagtgggagctacaatttagtcctgcctcctgtctgccatttttttctagatcctacagtggcgtttaactttaaattggagatcattgaacaatgcccctctggagttagaagggacataagaaacacctaatttacccctcaggctgtcatttgggttgaggctcatcctgcctaaatccaaacagtctggacagtggcagagacaggactggaatctgcagccaactgagcccttgtccaaggctccttatactgccccacactgtcctcctcagcccctcacactgcagctctccacactggccatctttgaggcccatgtgcctctgatgacttgaccccttgatgcaacattctgcagaacgattgtgaaggttcagttgtgcttgtgaatatactctgtaaagtcagtctaaaacaccaagcactgtgcacatttcttgttgtcaaatgggctaataaatgcaatagggtcctgaaagcattaaagtatcaacacctgggtcaggtgtgctcattatcatgattatccatggagcagatgctctggacagaggatcaacaggagccttgcttgtttttctatggggctaatgcaggtcaacctccttagggcaggtgggccaagtccctgggatgtcagtcaagggaaagtttcccagtgagtgcaggaggggtataggctgctacctcataggtctcattttcaagattggaatgaacgaagcaaagcaaacatggtaggccactttcaattgacaagatacctggcacccaaaggagatctgactgtgccagaggatctttactctgaaccatagaaagtagcactgttaccttgattgattttcccttagaaaggcacttactgacttttccagttatttaggtggatcaaatgcaaaatgctacagaaaatgttttgttgcctcgttagggatgaatcccatggccctgagactatgttggggctcacatttttgtgtatcctgtaattactgccctggggcttgtcccagtcctggatgagctcacagtgatgtgaaaccattccaaactctgctgtggggactgtaagatcaaccaggagctcagataagggagtgatgagtgtggcatgagtggctgggaaaggctcctggggaagggagaacctgagctaagtccataatggtgggtgggatatggaaaagggggacagtggaaaggcatttcagagggagaaatgtgtgagtgaaaacattgctttgtggaggtcaatttaagttgcaagtaagtgagaaaaggaatcacagtcatctttctaattcaatcaagagcacaaataagaagagcttgcaaggacatctccagtcttttcaggacttgaagtgaaactcagcaggaggagaggtagaaatacctggtagtgtttcttcctatctagaccattcctttataaaatcatcttgtgtagtgtttttattaataactccattattatgaagaagaagacaaaagggaagaaggaggagaagaagaaaacaataataatagtttttactatttattaagtgcctgctatttgcaaggttttactctcacttagttaactatcacttagattagttttactatcactaattctttttttatcggaatttaaaacttgtttatcaaagacaccattaatcaagtgaaaagggagaaaatatttgttaaacatatatctaacaaaggatttatatccagaatatgtaagcagctcaataataaaacaaccaaattaagaaacagccaaaagactaacaaagcacattaaaaaagtattcaatgccatcactaggcatcagggaaatggagatcaaaaccatacacactagagtgactaaaattcaaaagattgatatcaaatgttggtgagggtgtgggtcaaacagaattcttatacatagctgctagcaatgcaaaacagtagaggcaatttgaaaatcagtcaggcagtttctcataaagttggatgtccatctaccctataatccagcagtatcactccttgatatttacacaaaagaatgaaaaaatatgtttgtaaaaacacatgaatattcttgctcaagtatactgctgtagatcttagtttgtattgtacacatgatcatatatggtcttgtattgaggtcactggtgtgtatgtcatgtgactcccacagaatattctctcagtgcatgtgtgtgtttgtatcactactactatcactaattcttattcccaccttgcaaggtcagtcctattcccagtttacagatgaagaacttgagactcagagaggttaagaaatgtctcctatgtcacacagaaataataagaatttgaatccaggactatcaggctctaaaattcataccttgttcccatactctattgcctctcaaaatgagattctcttatggtggtgagtgggcctaggctactattgaaagtcaagtgtgtttcactaattcataggcatgaatgactttcctataggcaaaaaaagcttcaagcatacatttttaaattattttttcttgctgtggttatatttgctgctggtagtggtggtggtggtagtgtgtatatgtatgtatgcatatgtataatacatagcaatatatactcatgtagaggccgggtgcggtggctcacgcctgtaatcccagcactttgggaggccgaggcgggcggatcacgaggtcaggagatggagaccatcctggctaacatggtgaaaccgtctctactaaaaaaatacaaaaaattagccgggcgtggtggcgggcgcctgtagtcccagctactcaggaggctgaggcaggagaatggtgtgaatccgggtggcagagcttgcagtgagcggagatgcaccgctgcactccagcctgggtgacagagcaagactctgtctcaaaaaaaaaaaaaaaaaaaaaatatatatatatatatatatatatatactcatgtagagctatttattgacaccttgttgtgggggctttaatttcaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccagtaggtatcatctgggcatgtccagaaaagtcattctggcatagaagtttccatgtgggtttgcatattctctgtgggagggattctatttcccagagatcttgagcagacacggatgtgctgctgagggtttgtagggaaagcctccagggaccatggggctctctgttggagtgagctcctcgggagttggtatgggagggtccacgttctgtctcctctgtccaagattagattttcttaaaaattttttttaatagaggtgaggactcactatgttgcccaggctggtcttgaactcctgagctcaagtgatcctcccacctcagcctcccaaagtactaggattacaagccaagattagattttctatctaatcttggtgattttgacctgactgcatggcactccctaggcattctgtagcctctaggtgagtgggagaaagtcctagcacaaggtacctccagtgctctactgtgaactcggctttccagccagcacctctcagggcccagtgaagacaaagtcctggtgcacaagcagtttatacataaaacaaagtgcgtaagaagtaagggatacaatacagcacatgatatgagcaggaagggatttaagaaaggctttattagcagggactgaaactgtcagggaaggctccttggaccagctggagctggaagaatttgaagttggagagggaagacatggcattcaagtcagagaacagtactgcccagacctttcaggcagaagtaggacaggagtgagggtgaaggacttgtatggaatctcacctggctcaaggagagtttgtgaatgtgaaagatggaagatgtggctggaaaggtaggtcagggtttcattaacagtgatccctttggtggaatctttaggtttttctaaatatgagatcatatcatatgtaaatgaggccaatttgacttcttcttttccaatttggatgccctttttctcttgcctaactgcgctgtctaggacttccagtactatgttgaataaaagtggtgaaagggtatccttttctttttccagatcttaccggaaaggctttcaatttttccctgttcagtatgatgtcagctgtgagtttgtcatatatagcttataatctttattgtttttgaggtttgttacttctgtacctaatttgttgagtttttattatgaaaaaatttgaatttttaaaaaattatttcgtggcaaatttattgattttttttgagacaggaatctcactgtattgccaaggctagtctcaaactcctgaactcaagtgattcttctgcctcagcctccaaagtagcgaggactacaggcacaccccatgcccagctaagaaataatttttttgagtgaaatagtgcatgggggatgaatagggaacatatttttttctttttccttatttatttcttcatctagaagtcacttccagatgccagcatagggtgaggcactagcaacacaaagtgaatgaaacctgtttcctttcctgggcaatcccccggttcagattgggagacagagaactattgtgattccatggcagtgtggttggtgcttgcctggatctgtgtccacagtgctgtggccacagcaagaaagggtgcacccaccctgtgtagcttgtcctatttaagctagaatgaggttaccaggaagagaagagcctgtattctcccagatagaatgagctgtacaaagacctggagacaaaaacacatgccatgccatgtgtgggggatagctgataatttggaatagaaagtgcagggataccaatggctagcaaagaggctgaccagcacctgataaaactgtgaaagctcttttgggccacccttctaagagcacattctattttgccactggcctgccaaactcaaacctagtcctttaggtgaggacttacctaagggaaagatagaaaggaaaaaaggaaggagggaaggaaggaaggagtaaaaaaaaccctgaaaaatcatcccctcatgtttctggtctcttaaagtcttccatattctaatatgcagacccaaaatttaatgtaaaaacacagtataattttatgttctcaaactaaaaatagttcataaaataaactacaaagagggctaaaaaagtaagtgttatttatattttgatggaaaagtttctttctccttcatcttccaaagacccaatttcttttcccatgtctttgtgaaatacaaattacctcacaagtaattacttttcatctgaatatgcctaaatctggagattggtgttgacagtagctgcaggtggagaggctcaaattatttttcaagttaaagggaatttttggaatcaagtctgtaggttgacattctattccagttattagacactttaccccattatattatggctccttgtttaatgatcgaggtgaaatcatgttgctgaaacatgatagacagacacactgagtgtgtctgtctgagtgcatagcactcctagccatattctgaacttcagtgttctgggttcagacagcctggagctaccacttctcctacctctgttcctttgcctctgcctatgcctctccaaagaatgttagaaaggccatctgttttgtgtgttcagcatgagttaacccagggttttctttcacagggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatgtgagtatccatttaggggatctgtccttgtttcatgttcacactgcaatgttctttaattttttttaaatttttcattattatgggtacataatagttgtatataattatggggtacatgtaatgttttgatacaggcatacaatataaaataatcaaatcagggtaattggggtgtccattgcctcaagcatttatcatttctttgtgttaggaacattccaattccactcttagttattttaaaatacagattatggtggctcatgcctgtaatcccagcactttgggaggccaaggtgggaggatcacctgagtccaggagtttgggaccaccctgacaacatagtgagactctgtctttaaattatatgtatataataaattacgtatagctgccctattgtgctaccaactactagattttaattcattctaattgtatttttgtacccattaaccatctccattctgtcctccattccctgctacccttcctggcctcggtaaccatcaatctactctctatctccatgagtttggtttttaaaacttttagctcctatatatggtgagaacatgagaaatttgtctttttatgcctggcttattttacttaacataatggcctccagttccatccatgttgttgcaaatacaggatctcattctttttatggtggaataatactctactgtatatttgtacaatattttctttatccattcatttgtcagtggacacttagattgattccatatcttggctactgtgaatagtgctgcagtaaatataggaatacaggtatctctttgatatactggtttactttcttttgaatatatatccagtagtagaattgctggatcatatggtggctctatttttagttctttgaggaacttccatagtgttcttcattgtggctgtgataatttacattctcaccaacagtgtttgaggattcccctttctccccatcctcaccagcattcattattgcctttttgataaaagccattttaaatggggtgagatgatatctcattatagtttgatttgcatttctctgatgattagtgatgttgacatgccacaacattcttggtcagcctcagcaaaattatacatcttatattcacattcacatgacttgccattggtttcacgtggaaggatacatgccaggaaacatggtgtgccaacaggctgatatcaagcccatgtctttagtcagagtcctcacagttgtccaccctttattccagggcttattctctgaaacctgctccccaagtgacagctcaggtgcgtaagatcacatgggtggtacagggctacctggcttagaagcctatgttccaaatagaaactggtatttcttttgacagtcccatggtcaaagctttcaaaggtcccaacaaagcacatacctagttacaaaaatcagtctactcagggaaacccaaaatatagtttgcctcttgatttttttttccaaattagtccaccaaaaattgaccataggatgtaaaacatttctaacaatatcaaagtctaattgattcaagacttcaaaagttgcaattactcttctttaactctagatgcccccattggtttagaattcattcatggctctcccaatttagataaagatgaccaattatgagccatttttattagtagtctggtaacccaacacagatttccaggtttccaagggaacagagccagaaagttaacccaaggtcatatttattcctagaaaacagaaggattttgttaatcctttactttactcatgcatgcacagactatggaatccctaagagaccttcaacttcattgccaaatttttaagagctgtgacaaacctaacgtcaaacaaagactgcttttatggcagcagaactgaatcacatctatttgctggacctgtcacaggctttctttgtgttgtatcaactgcttcctcatgtctcaagtctttgaaagtattacaacccaaacacatttctagttgatgccctagaccgagttcatgctctagatcaagtatttggttcatgctcttgactatgtcaatagaaactgtgccttcagctctaccatattctattatggctcatgattctagcttcttatccacataatgtgacatagtgcaaaaatctgaacttacactcctaacctggacaaatggttgtcttgttgcttcctactgccagtgctaaaaggaacaaattatttatcacacacacacgtaaaagagttcattcaacaaacatttccatatgaggcaatcttttagctctgaatatgcatatatcatagaggctagtatatacatgtatattacttttatctaagttaccaatgtttttagagataatgttatggatgagaatcgttgtgtatgttcttcctggtactgagatgccacattcccttcccttccttgatgcatatctctttgcccccccaacttcttgtcccaagatgctatttggatctttctgttgacctgttctgccttctctgcagctctaccgtctgtgttggagcctgcgcaacagcaaagaggagcgtattgacctggatgcggaagaggagaacatccaagaaggccctaaggagaccattgaaataggtgacttatgacccagagcagatcctaaaccataaaagttactcctacaacaacaagactttactgaagttcttccctaaataattttatcagagctcagatgtctcccctccagggcagtgaggagtagggtggggatgagatggataagtgggtttggggaagttaactctgagttcaagggaaagaaagggtacagaatcattcaagctccctcacccctcatatttaaaaaatttttgtgagtacgtagtaggtgtatacatttatgaggtacgtgagatgttctgatgcaggcatgcaatcatgcctgcaagcaagcacatcatggagaatggggtgtccaccccctcaagcatttatcctttgagttgcaaacaatccagttgcactcttaatttttttttttttttttttttgagaccgagtttcactcttgttgcctaggctggagtgcaatggcgcaatctcggctcactgcaacctccacctcctgggttcaagcgattctcctgcctcagcctcctgagtagctgggaatacaggcatgcaccaccacgcccggctaattttgtatgtttttagtagagatggggtttctccatgttggttagcctggtctcaaactcctgaccttaggtgatctgcccgccttggcctcccaaagtattgggattacaggcataagccaccacacccggccttgcactcttaattttaaaatgtacaattaagttttcattgactatagccaccctgttgtgctatcaaatagtaggttagtcattctttctatttttttgttgtacccattaaccatccctaccccatccccagacccccactacccttcccagcctctggtaaccatctttctactttctatgtccatgagttcaattgttttgatttttagatctcacaaataagtgagaacatgagatgtttgtcttactgtgactggcctatttcacttaacataatgatctccagttccatccatgttgttgcaaatgacagggtctcattctttctttatggctgaatagtactccattgtgtatatgtacccattttctttatccattcatctgttgatggacacttaggttgcttccaaatcttagccattgtaaacagtgcagcaacaaacataggagtgcagatatctcttcaatatactaatttcctttcttttgggcatatacccagcagtgggattactgaattatatggtagctgtctttttagttttttgaggaacctccaaactgttctccatactggtcatactaactttcattcccaccaacagtgtacatcctcaccagcatttgttattgcctgtcttttggatataagccgttttaactgtgatgagatgatatatcattgtagttttgatttgcatttctatgattgatgatgttgagcacatttttatgtgcctattagccatttatatatcatattttgagaaacgtctattaaaatctttagaccatttttgattggattcttacccctcatatttgacagcactcagtgagtaagtgtgggtgaggaatttgccaccctgccttgatttgaggaatggccagggataagagaagagttggagctcttctgacatagcctgtgaactgagggcagatggaaccaaagctatggccagttctagtgacatcaagatgaggggatagaagcccttgggatcttatgtcatactggcttacaatatcaaatgcagaaaatcaaatttctctcgaagaccaatgaaataacgcttagtcagtgcccagagacttatcctgtaagttaatactttcttctacttcagtattgcaacttttcctctctatgtgggaaacgtgcacacgtggaggatggttgtggaggtgtgtggtgtgcagagctatgggggctcaaggtcatatgtgctttacctggtgctgggctggaggcctcatatcactccatctgaaggagagcacaggtgtagctcagaacagattctcaatctggccatcaggaacatcatagaatcctacctggggaaagagccctagagatcatttggtcttatcatctcattttatagacatgtaaattgaggcttagggagggagaggctgtgcctaaggtctcagctttgttacaatctgctcttgatcttcgagtacctttcaattctaaaacttgtgactgcaaatactggagagagcctggagccacagcagctggccatggtgctgaaaacagccccttcctgcctccctggggcaggcaggcaggaacatgccctctacttctcctacctccaaaaatgtctccacactgtgtaagaatatcatagattttaaagggacatggattaggagtattttgagtgtcaaaagatcttattgtggaagaagagattatttttatgccagaaggcagacttaacactggtgggtgaaaagaattcatccgattttaactcagagtaaggaggcaagatagtgcagagatagactgtgagatttggaatcaggaagaactgggatttaatcatcatcaattctcttcctaatactctgggaaagtgattccattgttctaaagctcagattcatcacataaaagtattctaaatgaaaacccatgcctcttatgctctgctgtaagaattgtctatatttaccaccatcatgattgctttgaaggaagagtttctaattgagttggtctggacagggatgagcagtatgtgtacatctgtcaaggattctgtagagggaacttccgtactggctagagatttgacttggtgacctctgaggttcatggcagcactcaaattctgttgtgtcttcatgaacttagggtgaaatcagactgaacatcctaccctattaaagcacaataaactaagctatctttagggattttacagaccatgaatgtcacattcaccattctctgagaaacagcaacacaaggaagctttgcaggtgcatcactgtcccagtatcatcatcctcaccaccaccaccaccaccaccatcatcgataatgatatgatcataacatgttttaattataaacactttagtgattcatttcagcaatgcatcatcctcttaaggcagataacgcaagtacaattcttccaattttccttcctttccagaacaggaaaatgtgacacagagaatttcctaaggccattcaattttttttttttttttgagacagagtctcactctgtcacccaggttggagtgcagtggcacaatatcggctcactgcaagcttcacctcccgggttcacgccattctcctgcctcagcctcccgagtagctgggactacatgccaccatgccctgctaatttttttgtatttttagtagagacggagcttcaccatgttagccaggatagtctcgatctcctgacctcgtgatccacccatgttggcctcccaaagtgttgggattacaggcatgagccaccacaccagctggccattcaactttttattggcccagaaagtcatgtatttctcacttgaggtcatcagtgatcctagcttattactccttctttcccactctgctattttggtggagtgagtcaaaggggagaggtgtgagtgtgtgagacaaaagagagaatagaaagagacctacactttttgacatctactgtgtcaagggacatggattaggagtattttgagtgtcaaaaggtctcattgtggtagaggctctaccacaataagagaggctctaccccaataagagctagaggctctctcattaaatcattaaattcttcattagtacaatgaagaaggtattatttatccaattcttctgatacatgaagataagggaggtgaattaacaagaccataaagccaggttttggtcccaattctgactcgtgtgaacttggtcactgagattctttccagttctaaaattctgtgatgttttaaagctaaaattctgtgatgctggccatggtgacctacatctgtaatcccaacattttgggaggccaaggtgggagtattgcttgagtccaggagttcaagacaagcctgggcaacatactcagatactctacaaaaaaaaatttaactggacatggtggcatgcacctttagtcccagcttagctactaaggagaccgaggtgggggggatcatttgagcccaggagttcacggctgcagtgagctatgattaccccactgcactccagcctgggcaacagagcaagactctgtctcttaaaaaataaagataaaattcagtgacttgtaaaaatgggaaagtgctttgcagggtctgtgactgtggtgctgaaaacacagtgggcttgatctcttatctagtgagtgccagagtgggcatttgaaaccaggtttgtctacctccagggccacgcctgggctcagaggagggaatcagttcccttggtgggtattcaatttgagcatcagggccaggtgtggacagtttgattaagcagtgctgatatgtgacattagatcctaagcctgggaagtattgctcattgctgcgccgcaacaggagctgttcagaccagttcttaccacctggctgggtctgttgtgaagccttagaatggacagatgtaaccaacgcactcctgaatcatgccagccagactgctttctggtgatgtagtgaacagatatgagattttgtgtttcagagttgagttttccttcctatggcacaattccccagcctattattaatgtgtctttattataaactattatttgatctgactgttccaaatcaaaatgaatttgcattgggcctgatagagataaaacttagactagctgatcctaaggatgcagatagtaagaccattttgtcattaagtttgttggaacattttctaccgttttcattccttaaaacaagaaaatatgggggaaatttggggaaatttctcatttttgggaaatttctgcagaatagcagatgcttcatggtgtggcttctcccctgaaaacttttctagtccatcctgcttctgtgtccaataattcttctatgcctttgcccagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagctgcagaagggaagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctcatcatatccctcttgagttttgcctggactttccctctcaagtgtgtcaatcaggtaaactgaggaatgcatggaagctgaggatggagcttgatgggctccctgtcctgggtgtttgctctctgaagtggaggcctgaggaaggtagtacttccacaaaagggagggacccgggccccagcctcaagctagtgggggaggcagatagcctgaatccaggggattttctgggcttcttaaaatgtccattgtgagttccccgtgtttgggattccactcattttggcattcacagtgcctggaatgtcttagattttcagcaatgcgtgttgaataaatgaatgacataggcatttatttttaaatctttgcttgctttttacatgagcctggcccttagttaaccttttcttgtggctacacaaagtatgctcactggttactaatgacttgggatgcatttgtcaaactgattatattagttttctagggatgccataacaaagtagcacagaccagatggctcaagcagcagacatttattttctcacagttctagaggctagaagttggaggccaagatgtcagcagggttggtttcttctgaggcctctctccttggttgcagatggtcatatctcactctgtcttccgtggccttccttttgtctgtgtcctaaatctactcttctgataaggacatcagtcatattggaataggacccaccctaatgtcttcattttaatcacctctttaaagcccctacctccaaatacagtcacactgtgagaaactgagggttaggaagtcagcaagtgagtcttgaagagatactaaacaaacccacaacacagataaagtatgcattttggagatttccaagccagagtctcccgtgaaaaaggtaaacggaagcagttattgtgcagcaaaaggaaaaagaattacaaactgaacgtatgtaggtgaggcaaggcagggtagggcagggcctttgggtaggctgatcagagggtttttcaacaataaatcaatgggaatgcatttgttgctcccaggaccctggcaccttgactctggtactatagcatgtcagcaaatacaagcaaagcccaacactctgatttgcatttatgccaatctaaactatccggtgtttagtttgattttttgagtgcaggttcattcaaggaccaggttcccttgtgctcagggtgaagtagaaccagaaaacatcgttatccattcccagaagttttggaagagccttggtagaaaagcagaagctgctttgaccgtgaaaatatttgactcctatcagtttttggtcaggagaagatatccacctagaccaacccgaggagaaggctcggagaacagatataccccgagcaatgtgatcaatgtccttgaaccttcattcttcatctgaaaacagagacataaatgcctggctcacagatttaaatgttatacattgatagcatttatcagtataacatttatttaaataagtaggtgctcaataggtgttggtcttctaacttgtctacatcccatccccattccagggtcttcagaattgaaggagagatgttgtatcactgttagaaggctgctttgggaaattctgcagcagggaggagggattgtcaacccctacaccatgaccaccaagttcctcaccttggttgagtccctaaatctctctgaacctcaggttcctccaagtataatgcagacttcacagagctgttgtaaagattaggtgaggtcaattgatactgcttaaaaggcccggtccgtagaagatgcccaataaacattactgctttccccctcaccctactgcctgaaaaaatattacacctgtgagactgactttgagaaccagtgtgggtggggagttgtgcatataaactatttaatgagtaccaaacacaaaagtcaagcttgtaaaatatcaggccttgccccagaaagacaaataccacatgat

SEQ ID NO: 16755 - DNA, 58361 bp, Human
agatggcatactctgtgaccactgtcaccctaaaaccaaaaaggcccctcttgacaaggagtctgaggattttagacccaggaagaatgagtgatgggcatatatatatcctattactgaggcatgagaagagtggaatgggtgggttgaggtggtgttttaaggcctcttgccagcttgtttaactcttctctggggaacgagggggacaactgtgtacattggctgctccagaatgatgttgagcaatcttgaagtgccaggagctgtgctttgtctattcatggcccctgtgcctgtgaaacagggttcggtgactgtcactgtgcctgtggcagtctgtagttacccagagagaacaaagctgcatacacagagcgcacaagggagtcttgtaacaaccttgtcctgctttctagggctgagtcaggtaccacagcttgatctcagctgtcctctttatttcaagaagttgacatctgagccataccaggagtattgtattttgtttgaggcctctctttttggaggaacatggaccgactctgtgcttttgtctatgctggtctctgagctcacacaacccttcaccctcctttctcagccagtgataggtaagtcttccctatcttgcaaggctcagctcaagtgtcagcttcctctacaaagactttcctggttcccctcattggagtgaacaagagttgacatggtagaatggaaagagcagaagctttagaatgagccagacctgagtatgaatgctagatccaccacttagctagtcaaccctgccccctgcctcaagttttaattttcctatccattaagtgaatataataatacctgtgtcacaggattattttgagaattaaatgagattaggtctatgaaagcacctagcagagttcttggcatataggaggcattcattaaatatttgttcttccccttttatacccattacttttctttttctgaactaaaataatacttggttctatctctgaaataacatccaagtgaaaaatcaacaacatgaaagagcagttcttttccagtggatttgcttcttaaggagcagagattatgtaatctaacagcctccaacatacaaagagctttgtatctagaacaggggtccccagcccctggaccgccaactggtacgggtctgtagcctgttaggaaccaggctgcacagcaggaggtgagcggcgggccagtgagcattgctgcctgagctctgcctcctgtcagatcagtggtggcattagattctcataggagtgtgaaccctattgtgaactgcacatgcaagggatctgggttgcatgctccttatgagaatctcactaatggctgatgatctgagttggaacagtttgataccaaaaccatccccccgccccccaacccccagcctagggtccgtggaaaaattggcccctggtgccaaaaaggttgaggactgctgatctagaggaccaatttattcaatgttggttgagtaaatgagctcttggattaggtgatggaaaaatctgaaaaaacagggcttttgaggaataggaaaaggcagtaacatgtttaacccagagagaagtttctggctgttggctgggaatagtcataggaagggctgacactgaaaagaaggagattgtgttcgtttcttcttctcagagctataagcaaaggctgaaagttctagaaaaaggcaagttttgtttcagtagaaaaaaggataatcagaaccatttttagaaaatggaatgagactacttttgaggccatgagttccttgtccctggagagatgagcagaggttggacaagtgcttaccagagatcttgtggaggcagaaactgtgcatctagcagagcattggcctaaccctttcaaatgagatgctgttaactcagtcttattctacatggtaggaatcctgtccctttgcctcctgctactttgggcctctcaacctcttggttttgtgtgcaggtgaagatgtctggaggtgtccaggctgtggggaccacattgctccaagccagatatggtacaggactgtcaacgaaacctggcacggctcttgcttccggtaggtgggcctatcctcccatctttaccagtgtactatgggccaagcactatttcatgttctgatggaaaacacagaaacaagcttctgagttgagaatttcaatcttagggtggggaaaggaatgtaccaaggaagagctcatgaccaaacctcaagtgtggcccccctgaacccaggttaaattggaagagccataaatgggccagctggaggcagggtggggggatgagaggagccctttccagggttgtcccatatccctcactttatgggtgaggaaactgaggcccaggaagagtgactttcctgtggctgcactacagattatgcaggtacttcaagagttgtttgtattcttattttattttattttattttattttattttattttattttatgagagggattcttgctgttgcccaggctggagtgcagtggtgcaatctcggctcactgcaatctctgcctgctgggttcaagtgatttttctgccttagcttcctgagtagctgagatgacaggcacctgccaccatgcgcagctaatttttgtattttagtggagacgggggtttcaacatgttggtcaggctggtcttgaactcctgacctcaaatgatgcacccacctcgacctcccaaagtgctggaattacaggcgtgaaccactgtgcccagccaagagttgtttttagtgtggttggcagagccagctcttcctcaccacaggttgcctccctaggttcctactttttgttactagctttattatagctacattattattattattgttattattattgagacagagtctcgctctgtcgcccaggctggtgtacagtgatgtgatcttggctcactgcaacctctgccccccgagttcaagcaattctcctgcttcagcccccctagtaggtgggactccaggcacctgccaccacgcccagctaatttttgtatttttagtagaggcggggtttcaccttgttggccaggctggtctcaaactcctgacctcaggtgatccgcctgcctcggcctcccaaaatgttgggattacaggcatgagccaccgcgccctgcctatagctacattatttttgtaggcagctcagtttcttaaaaattatacagacttcaaatcagatttgttcctgctgtctgaggctcagtttcttcatctggaaaatggatggtaataatcttgttgagattgaatgaaataatatatgcagtgtatccagtacatggtagacacccagtgaatggttattccttcctcccatcggattggaattctcaagggtgggaacttgtctttatattcttcacaacgtaaaatagttgaaatttgttggtggaaagaagagcagtccactccagaggctggatgggcatgcctggcccccaaggtctgaagtggtagggctgtgcctatatcctgagaatgagatagactaggcaggcaccttgtgctgtagattccagctcctgcacatagctcttgttgtaaaacatccctgtgcttataccaagtaattgagttgacctttaaacacttgcctcttccctgggaaccatataggggattggcctggagacgtctggcctctggaagagttggaaagcaaccatcattattatcctttcctttcagctataactcagagctctcaagtcttttctgtggatcttattgccttggttcttgccccttttactcccagggaagttgattctgtcttttctgttccatttagtatgacaggagcagagaatgtcagagctgtaagggaccttatagttaaagcctttggctggtcctttcattttatagctgggactaataagtaacgtcaaaacccaatgagttcacagattgggtctcgccttggcatgtaacccatatgttcatattcttgctgttttcctatgtgtatgaatattttctatccaaaataagcaggacagggtagagcaagttaatctttggaatttctggattctcttagagctaaaaaacttcagaactagaagaaaccacccactatatggtataacccattcatatcacagatgaggcctgaaaccaaaaagacttgctcaggccatggatgacaagagctggccctagcactgaactcttgggtcatttgtaggtctagtcagatgctagcttgttagctctgtgcgtgcgtgtgtgtgtgtgtgtgtgtgtgtgtgtgagatagagacagaaagataacatatgtacacaaatacataaagaggaagtagacacgttagcatggtagataagagtacaggcaggccaggcgtggtggctcacgcctgtaatcccagcactttgggaggccaaggcaggtggatcacctgaggtcaggaattcgagaccagcctgaccaacatggtgaaaccccatctctactaaatacagaaaaaaattagcttggcatggtggcacatgcctgtaatcccagctacttgggaagctgaagcaggagaatcgcttgaatccgggaagcagaagttgcagtgagccgagattgtgccattacagtctagcctgggcaacaagagggaaactccatcgcaaaaaaacaaccaccaccaagagtacaggctatggaatgagactatggttttaaatcctggctttgcaatttattaactagccttaagtgacttccctgagcttcaggcaccaatctgtaaaatgaggataagaatattactcatgccacatggttgttagggaggattaaatgtgataacctatataaagtggctagcatagcatctgacatatagaaaactcttaatagggccggacgtggtggcttatgcctgtaatcctagcactctgggaggccgaggcagaaggatcgcttgagcccatgagcccaggagtttgagaccagcctggccaacatggcaaaactccacctctacaaaaaatacaaaaatattagccaggcgtgatggcacacacctgtagtcccagctacttgggaagctgaggagcgatgattacctgagcccagggatatcaaggctgtagtgagctgtgatcatgccactgtactccatccagctgggggacagagtgaaacccctgtctcaaaacaaaacaaatgaaaaaaaaaacccttaataatcagtaactgtcactttatattatgttgtgagtgtgtgtctatatacacctatatgtatacatttctcttattacacattcattggtgatctgatgtggagccccagggattaagggcaactttgaactaccctgacacaatcaagccaaatatcattcccgtggaggaagtagagtatctaggttctgtctcctagttgcagctttaccttgaggacagagactctaatccagctgtgctgaaggagcacatctcctgacttctgagctttcccctggtaaattcaaactggatgtcacggcgccctcagatagagcctggtaatttgccctggggagagtgactgtcttttggatctaatttgacttttgccccagttggaggaaaatcttcagggctaggaaggattgtatttgtctgaccccagagataacctgggttttgaggaacatggggcatcaacctgaatggtcttgtaagatctctcccacgccagcttgccagtgtttctctgatgaatttagagtacctgagtagtgcaggcctgctgggaggaggactctccctctgtgctactcagagaaattcattcttcaaggcccccttccagccttgctcttacccagctgggctacagttacaataaaggaaatgacttttcttctccccttcccccagtacctttgttttcctagtcacagggtggggctggatattgaatggagaaattgctggggtccatcctaaactcctcccctcatctctcccttacattaccccattcttctgtctgcagccacatccataatcctgcctctgttagccttccgacagaccctcaggtgcccaggacaacaggaagctacttaaagctggaacctcagactgtgcaatggaggccagtgacaaaactgaaagtagctctgtcagtaattgtgctggtgcgattaggcagctggccagaatcttttggatctcctggacatatggctgactagtcctcccaagccttcccaacaggcctcttttttttcctttttttcttttcttttttttctttctttctttctttcttttttttttttttttaggctagtgaagtgaaattgtgggagtggaaaaggaacaaagaaatcggtaactggtagtgatcaattacttgtaaacactattgtacttggaccagcccagtaggccttttttaaaactctgagttacctctctttcctttccttgagcagtgccattaattctgtatctggggcaatcctttctgatgttctctggacctggctctctctccttaggagaggccaggagagtagccagagagcatgtcatttgtagctgaggttaaagtgtggagctatcaatggtgacctggcctcttggcatgttagcaagccagaggaccttgacaacttttttgatgattgtccgttcaccctgatcaaaggtgtttggcttaggaggagggaagaaaagctacccctattagtcttgatggccccagcgtgggtctctattgcttgacctggttcctagcagcattatcagaaggaaaatccaccgctcttaaggctcctgggaactttcaggacttcctttctcaggattgcaaacataagactatttgagctttcacttttgaaaagcggttactaatacctatactctgggaaagggctaatgcagatagaagactgtggtcactgcatcaggcaacagaccatttccgctaaatttagtgactccaggaaggccagtgaagaaataacacacgtagcaaccagagactgtgttgtaatatgttggctgacagcagggtactttctgtgatgctgaaagccacattcattttctctcccctcatccccatctaagcaagcctggtagaatcataattacagtaataggtaccacttattgagtactctgtgccagacaccctcctgagcatacgacatgcatagcacatttaatccttacaatgacttaataaaatgtagtactagtcttacctacttcgagaatagggaaatggaggttacttgtttaaagtcacagagctaataggtagcatagctgagatttgaactcaggcattcttactccttgcctgcaagagtctcttggcattcttgaatgcaagcatatttcttaacctcactgaggctcagtttcctcttatataatatggggtaaagagccctcaccctgcctgccacacactggtagtgtcagataacattgaagggtgttagtttaaaggcttcatggactctataatgtcaacaaaagtgctgttaactttcttctgggtctcaggctcctgatgtagagtcagtggagcaaccctgccatctgctgttatgctgttgatgttgctgccacacttactaacctaaacctttgattctggctgtggccttctccagaaggtgtttactcatttgtccagtttatcttttaggaaacagccagcccgtagatcattaaggctggctattggacagggggctggggcctgcctgacagaggaaggaagggcagacatctggttcttcctctgcccctacaagagactccagcctgaccacagagtggtactcctaggatgtagcagcagcatatgagcttgaatgtgccttaatcctgctctttactttgagaagagagaactaaggacccacagatgtttcacagcttctataggaggcagaggtagaaaaatggagagagatgaggccagagatagataactgatattaattaaacgttgtattaagaacctcacttagattatctgattcaatcttcataataaccctgcaacccccacctttttttgagacagggtcttgctctgttgtccaggctacagtgcactggtacaatcatagttcactgcagtgtcaacctcctgagctcaagcaatcctcccacctcagccttgcaagcagcttggactacaggcgtgccaccacaccttgccatttttttttattttaagtagaaacaaggtcttattaatactatgttgcccaggctggtcttgaactccagcgatcctcctgccccagcctcccaaagtgcttgggattacggaagtaagccactgtgcctggccagtgcaacccccattttatactaaaacaggaaggcccagaaaggtttggagtaacttgtccagggtcacacagatgatatttgaactcaggtctccctggctcccaagagagtctgctttccactaggactcccaggagaaaaaaaaaaaaaaaacagtagacttggagacagaaaatctgatttgagtcttagttgagctaggctaactgtgtaactgtgggcaagttccttagcccctgtgagcctcagtttcttatctgtaaaatgtcataaaagaaatccatctcatggagtagttgtgatgatcaaggactctgaaaacattagaatggtttaatgtgaaggattagcagcagcacatggcaacattgtgcatcttatattaactatccaaatatatcaagcgtcatttgctatatataaaagtcatcaaattaggcactgtgggggatacggagttggcatactagcctggcctcttaattaattcattaattagcttatttatttttgagataggtcttgctctattgcccaggctggagtgcagtggcatgatgatagcttactatagcctcaatctcccaggcttaaacaatcctcctgagtagctgggactacaggcacacactaccatgcccagctaatttttttttaattttttgtagagacagggtcttgctctgttgcccaggctggtctcaaactcctgggctcgagatcctcccacctgggcctcacaaagtgttgggattacaggtatgagccacggcacctggcctggtctcttaactggttccctaagacagctggaaatagagaatgtcatggagcattcctaaccatgggctccagcctggctttcattctgtttctcccctgaaacaacattcctttagtaatattccgaataacagcttcatcagtctgtctaccgaccactcttcaggcttcatcttatatgacctcccaaactgcactaagggttgtattagagaaaagtggataaagttcggagtcaggctgcttgagcttaaatgccagcttcacttaccagccacctgaccatgagtcagctgcttaaccattctttgccacagtttccttgtctatgaaaagggaaatggctcccacctcaaaaagttgttaacattaaattcaatcatgtattcaaagtcctgagcagaatgtctggccatgactgggacttaacagatgttagcatttattattagtatctgtcagtcttgaaatgttctcttcccttggctttcatgacattccacactctcctggttttctcttacctctctggtaatacctgtttgcttatccttctttgtccagctctgggatgttaccattccttcaggcgtgctgttttctccttaggcagtcttacacacactcatgacttccttccattgtcctccacacactgatgaccctaaaatcagtatctccagcctaaacctttccactgagttctagacccatatgttgtactatcaacctggcttgtccatttgaatgtcttccaggcacttcagactctcttctctagactttgctggactttcactcttccccctaaaactggctcctcttccactgaaacatgtatgtcattgagaggcaccaccatccacccagtgcctaagccagaaacctaggaatccttgatacctgttctctctcatcctgcatatccaagcctatcagttttatctctaaattatattttggtaggtttacttctttccttttctcccaccaccaccctgctccaagctaccatcatctcacctggatgtctgcaatagcctcatctcccacagccactctgcaccccctaatctgttctctatagagcagttggaaggagtgatttttgttgtttgttttgttttgttttagacagagtctcactctgttccccaggctggagtgcagtggcacaatttcggctcactgcaacttctgcctcccgggtttaagcaattctcctgcctcagcctcccaagtagctgggattaaggcaccggcccccatacccagctaatttttatatttttagtagagatggggttttgccatgttggccaagctagtctcgaactcctgacctcaagtgatccacctgcctcggcctcccaaagtgctgggattacaggtgtgagccactgcacctggctggaaggagtgatcttaaaaaaaaaaaaaacaaaaaaaaacttgactgtgtcactctgtgttgtctctcctaccttgtatacttccacaacttcccagtgttcttggataaagaccaaaatccttaacttggccaggcgcggtggctcacacctatcatctcagcactttgggaggccgaggcaggcagatcatgaagtcaagagattgagaccatcctggccaacatggtgaaaccccatctctactaaaaatacaaaaattagctggtcgtggtggcgtgtgcctgtagtcccagctacttgggaggctgaggcaggagaatcacttgaacctgggaggcagaggttgcagtgagcccagatcacgccactgcactccagcctggtgacagagtaagactccatctcaaaaaaaaaaaaaaaaaaaaaaattccttaatttggcctacagtagagccctccgtaatgtggcctctctccacatctccacaacctcctgctccctgcacttcagcctcacctctcttctggacaggccctccttctgacaagggctttgttcattctgctccctctgcctagaatgcccccttactctgttcacttaactcctgcttatcgtttagatctttacctggatggctcagagaaatatagaagtaattcctcaccctgaaaaataggttaggtccctgttttatgttttcatagacctttcctttgaggctttttttaaaaaagtagttttaatctcacatttattcatgtgatcatctccttaatgatatcttaagacctctaatagaacaatttggtcatggactgtggggtttttgcccctcattgtgtcagcactgagcatattgttggcataggagggatatttgttgaatgaattgctagaggtggccaagagatatgatgtaagtcaggcttttccctgcccttccccttccccttccccacatccttcctatagcagccaccgtggctgcagttactgtaaatggcaagacggaatcagttccggacattgggttgttttagaaaattgcctgcaagtgtcagggtgataagttaaagctttgtcttttgccctcagaggagctatcccatagtgagtagaagccagagaagctgaccccaggagtccttctttccagcagcaggtcttgagctgcacttctctgtagctacaatccaggcaggaacaagccctaggtacctccggagaggagggcaagagaggaagaatgagttcagctactctagccaccaaactgattatgaattgccctgaaatctgaaaaatttcaattccaatcgtaagtttgttttgtttcattttgttttcttaaattgtatatttgaaagatggcattaactaaagatatatattcaatatagagtggaaaaaatggaatacttgcatagtatcttttacttataggtgatttatgatggggagtggggtggataggttggcagttcccccaagaagttggaaatgaagtttgtcctctgtgagttgaactaattagatccacaagtaatgaaagcagtattgtgttgtagttaagagcacactctagaaccagattgcttagtttcaaatcctggttctgccttttattatctgtgtactttgggcaagttacttgccctttgtgtgcttcatttttctcatctagaaaatggagaggccaggcgtagtggctcatgcctataatcccagcactttgggaggccgaggcgggcagatcacctgaggtgagaagttcaagaccagcctggccaacatggtgaaaccctgtctctacaaaaatacaaaaattagccaggcatgatggcgggtgcctgtaatcccagctacccaggagcctgaggcgggagaaacacttgaacctggaaggcagaggttgtagtgagccaggattgcaccactgcactccagcctgggtgacaagagctagactcagtctaaaaaaaaaaaaaaaaaacaaactggagatacaggctgggtgcagggcttacacttataatatcagcactttgggaggcctaggcgggaggattgcttgaactcaggagtttcaagatcagtctgggtaacagagcaagacctcatccccacaaaaaatcaaaaatttagccaggcatggtggctcatgcctgtggtcccagctactcaggaggctgaggcgagaggattgcttgagcccaggaggttgaggctgcagtgaaccatgactgcaccactacatgccagcctggatgacagagcaagaccctatctcaaaaaaaaaaaaaaaaagaaacgagccaggcgcgtttgctcacgccagtaatcccagcactttgggaggccaaggcaggtggatcacttgaggtcaggagatcgagactagcctggccaacatggtgaaaccccatctcaactgaaaatacaaaaattagccaggcatggtggcatgctcctgtagtcccagctactcacttggaggctgaggcacgagaatcgcttgaacccaggaggcggaggttgcagtgggccaacatcatgtcactgcactccagcctgggagacagagcgagactctgtctcaataaataaataaacataaaataaaataaaataaaataaaataaaataaaaaaatatggaggccagcaggcacggtggctcacgcatgtaatcccagcactttgggaggccgaggggggcggatcacaaggtcaggagatcgagaccatcctggctaacacagtgaaaccgcgtctctactaaaaatacacaaaattagccaggcatggtggcaggcacctgtagtccctgctactcaggaggctgaggcaggagaatggcgtgaacccgggaggcggagcttgcagtgagctgagatcgcgccactgcagtccagcctgggcgacagagcaagactctgtctcaaaaaaaaaaaaaaaaatggaggttgggcgcggtggctcgcgcctgtaatcccagcactttgggaggtcgaggcgggcggatcacctgaggtcaggagttccagaccagcctggccaacatggtgaaaccttgtctctactaaaattacaaaaattagccaggcacgatggcaggcacctgtaatcccagctacttaggagactaaggcaggagaatagcttgaacctgggagatggaggttgcagtgtgctgagatcgcgccactgccctccagtagagtgagattccgtctcaaaaaaaaaaaaaaagaagaaatggagatacaaacttactacctacctccttacaacctaccctcacagtattactgtgaataaaagtgtgtgtagcactgggaacactattcacagagcactcatgaatgtttgttctttgttattagttactagagaggcaaatgtctgccagggctgaataatatgtgtgaattggtgattgtcgcacatatctaaagaagtagttatttttttcaattaaaacttagtttaaaaaccaatataaggccgagcgcagtggctcacacctgtaatcccagcactttgggaggccgaggtgggcagatcatttgaggtcaggagttcgagactagcctggccaacatggtgaaaccctgtctctgctaaaaaaaaaaaaaagtacaaaaattagccaggcatgatggcaggtccctgtaatcccagctacttgggaggccgaggcaggagaattgcttgaacccaggaggtggaggttgtagtgagccgagtttgtgccactgcacttcagcctgggtgacagagggagacactgtctcaaaaaaaaaaaaaaaaaaccaaaaccaatataataaataagtggccagcaatgaaacagaaagtgaaaagttagtgaagcaaaactagtactgtattcagataaagatgctgaatctagatttggtcaccagaatagggtcctttgtggcaacctgggctagtttggctgactcaccactgccaggatgaaatttctttcagtggctactcatttccctttattttaagtccatgctcacagagcaaccttctgatgcctaattcagcttcctgggatacttaataacaggaagggtctggaagtagtacctgtataggggatatgagtgttctgattttaatagtcaattcataagtgtacagagggtttgataaatggttaggtcagaaccatcacagaatgtctacacctctttggacattaggaaggtcaaaaacctgaaaggccaaaagctaggcctagattagggtcattcaccaagaaaacatcagccttgaagagttctctgggtggtccaccagtcaaccttcctttgatcacacctccttcctcgttgcttctttaagcattgacctgtaatgggtatggaattttttgctcacctaactccttccttttacagaggaagaagttgaagcccagagagatttaatggcttgcctaagatcacacgcagattttctgttaaccagggtgatttttcaggtgttccctgccagacgagggcttttttccttgaattgcctagagatttcttgagatatccgaagcatttttcccagtgcagcctggagaaggatgtccctgtcaacacagcatttgttactcaatgttagacattcaattttctaattagtatcatggagcaacagtggatgattatctataaggggttgcaattccatgcttatgtgcttacagcccatatagacaaatatcagctgttaaaatgacaaggcagtagagatgtggccccaggacaaaggcatactctgctgttagtgaacactagttggccagcaaatttcacatgggcatatacacggccaactgtagactttaggcatttatacccattcagagagccaaactggcaactaaagatcagcattctctttggcatttcagctttgcgttctgttaaaaatcactgcttgcttaaatacctctgatagctcttcactgcctgtaggcaactctttagcctagcagacttggtctttagtgctctgcccctactctcttccaccattctggcctcctgtctaattgctgcccatatgtgccatgcactagagcttacagacctgctcagcgttatatgagcataccatactctttatgcctcagtgcatttgcacatgttgttccttcaggccagaatgcctgttactgcctggcaatcagcctattagagtctgccaataccatcccatcttctgtggaggagccccccgccaaatccacccatacctctccccaccaatcagagacttcttctctctttgttattctcttcgttattctcttcatacctcagttatatccatttcagtatttgtttacacatctagcatcactcttagagtgtgaaattctccaagtgtggagccgtatctagtttgtctttgtatcccagagcttagcaaagtgcctagaatgtagtgggtgctcagagtgtttgctgggtgaatgatgtatttgttgaacgactctttggacacttgaataaagtccatccagtatgcaccattaccatctcttcgctctacaatattcttttaggcaagagcttatcttttgaggtgataagataagctcaaacttatgtagactaagacctcagtctgtaaatgtcatccctaagtcttaaaccatcaaaaccagggcctcaaggaatggcatgccttctgcaactgtagcaacctgctgtgcttattttgccgtgtttttcatttttcccccaaaagctagagtcccttctcccatgggcagtgctggaagtgtgctaacaaattctttctccatactgcttacgattacaaaaaaaaccctcagcatctcatgccagacttgagttaaggttgttttcttttgtgtgtcagctgtattctggtcatgacttcctgatgatgccctatagagattttgctgagatcagagggtgctccactgccatcagtagcactgactcttgcagaagcaccgtttctgaagttggctaatgtcatccctcacgtttgtttgtttgaaatttgttttagttccagagatagcactttcatggaatgacgctatcttctagaatcactttttttttttttttgagttggagtctcgctgtgtcgccaggctggagtgcagtggcacaatctcagctcactgcaatctccaccttccgggttcaagtgattcccctgcctcagcctcccgaggagctgttactacaggcgcacacccccactcctggctaattttatgtgttttagtagagacggggtttcaccgtgttggccaggatggtctcgatctcctgactttgtgatctgcctgcttcagcctcccaaagtgctgggattacaggtgtgagtcaccgcgcctggcctagaatcacctttttataccataacgtgagcaccactgccgcgtcaccaaggaaagagagaggcagctactgtggggttacaaatgggtaagagtggcaccaggaaggtgaaagtctctacttagccaaggcttaacaaaatgtcaatcaccaaacatttatttattaagctacgttcaggataagaagatgaacaagctatctgtacattcattttctcgtttgtaacaaggtaatgatagtgatctatcctgcctgcctctgagggttattgtgagaataaaatgaaatcaagtggaaaagcacttaggaaaaagaaaagcattggttttcaattgttagtgtggatcagaaacactggggcttgtttaaaatgcagattcttagccccagtctcagcgattctgattctgtatatctgaagtgggactcaggaatcttgattttcaacaagctgaccagagggtccaatgctgctattcctttagttacactttcagaaatattactgtaaatcaaatggcaagaataaaatagttatttgaggcagttttagtatgttggacctggagtccaaagacttgggtcaaactccagctttgtcagttcctagacctgtgaccttaaacagcaaccttctctgtgaaccttagttccctcaggaacggctctggtcacctcctgctgtactccattgatgactcaccacataaggctccctgggagtcccccaaacctttgctctcttaactccttttacagcctcctacatctcctgcaggtgctgtcttctcctcctttttccaggccctgctctgacacagcattcattctcctctgggaagggttccttcaatgtgtctccaagcacatcacacccaggaaggaccctgtggccatatctgtctatcaccagatcaaactacgtgaaggcaggcactaggtactgtcagtgcccagcataggcctggcccataccaggtgtccacagatgcctagtaaagaaacctatgattcaggacccccatgatgagcaactatagcactagaacagtgataataactaatgtttataatgcatcttcagtttacagagggcttttgtactcatcatctagtttagttcctgcaacaacctcttgaggaatatagcacaagcaggacaagggaagcccagagatgttaaataatttatccaagtttatgctgctgggaagggcagcactgaaattaaaagaaaagttttctgagctcaaatcccatgccctttcctcaatgtgagctctagcaaggtattcaggaatcctgcctctacagttcagagcctcaaattgctgggtatgttgagttcttgtatctgatttttctagatttcctgcccacattcttactgtctggatatcaggaaagagtttatcaaatgcctgtggaaatccaagataaggtctcatgatgagtaacccagtgaaaacatgaagtcaagtctaactagtcactactatttcactactgctgactcctgatgatcagctccttttctaagtgcttactgtccacttattccatcatctgcctagaatttatgtgaaggaatcaaagcaaaaggatcataaggcttcctttttccagtatgtttttcctcctttttgaaaactgggccagttagctatctccatttttatttcatgaatacatccccagcgcctggtatatagtagatatggaacattacactttggagatattgcacccattctccagtttctccaaagttactaacaatggttccatcactgtgccaacatattttcttttttcaatatattgggaaataattctcccagtctgaaaatctgaacacatttcatgtgacttggtatcctcatatgtcttgggcttccaattctccattcctagtttcaagttcatgaactgtaaaacaaaggattagactaaatctctaaagttctatccagatgccaaattcttttctctttccatgatacctaagatagatgccaaatattgtcttttacctggtgtttgtgaacatgacatcacattacaggagtagcagatactaaactctcactctgtaaaacactgactgagttccatgagccagatactgaagtgagcttgttcacatatgttctcatttaatgctcataaccctgtgaagctgggaattgctgggacattttatttatttatttattgagacggagtctggctctgtcacctaggctggtgtgcaatggcatgatcttggctcaccgcaacctccgcctcccgggttcaagcgattctcttgcctcagcctccgcagtagctgggattacgggcacacaccaccacatccagctaattttgtatttttagcagagatggagtttctccatgttggccaggttggtcacgaacacttgacctcaagtgatctgcctgcctcagcctcccaaagtgctgggattacaggcatgagccaccatgcctgcccgggacccttgttttagaaggatgactgctgctataatgtagaaagtgatttggaagaggggaggagtggggcacgaaagatggttagtagatgggggtggtaatgcttacctttcagtatttggaggcttcggagtcctcaaaaattctcttccttgattggagtcctcccagccaatagagggcttcacacaaacagtttcttgggttttgaattgtttgaccagagctttcttccgacaaaaggttggggtgattcattcacttaccacaccttgcctgaacattcacttggggctgccggttatgaaggctattgttctccagcctgtcacagacgctttgaagacctgtgcctcagctggttctaaggagtcagtttgttcagctccgtgccaggtttccaacttatgaaatgtgctggagattaacacctctcctgccattttatccctactataattgccagtcaaaggattcctgcagttgcctctggcagccataactgatgaatgttctgccagctgctctgaggacctagaagagcagttttctatccaggaccagtttccaagggtgggagggtgaaatatatcctccagtgtgacatttcatctcccagtgatgggtggcttgggccctttgaagttggctctgaggaaccacacacttgggtctgagcagccagcagcttatcacatctggtgatcaatccttcaaaggttcctcctgaagtctgaatttttggaggtcaaatggattccacctgggaggggcttctgcttcaactcaggacatggggagaaggctgttcctcttccagggggaggcagttttcatggcattgagatgtcctctcacttattccccacccacccaccaagtcctttgtaagaggagtagggggagaggagagcgcctgcagcctcctgctcacattcctagacaccgactcactgagcccgtcgccgctggaacagcagagctgtgtgaaatgtcaagaggagttatgctcataggctccctggcctcagtctctttgtggcttgcatattcttccattagtactgtgttcatcacatggaaatcagagggtacaattaaaagataatttgctagtcccagacttaatttggggcccccttcttgcctgattgaattacaggggaacataatagatttttggtgagaaatagttgtctgtgtggctgggagaaagattgctcccagctctccagctgggcagccctttcagtatcccgtatgttatttccccacttccagcccacctcacctcctctgtggcccttgtgtgtcccctcggctaggatcctgacctcctgctcaagagtttaaactcaacttgagacccaaggaaaatagagagccctctgcaacctcataggggtgaaaaatgttgatgctgggagctatttagagacctaaccaaggcccagacagagagagtgacttgctaaaggccacatagctagcccacagtagttgtaacaatagtcttaatgatattaatggctaacatttatcaacctttaatgtgtcccagactttgtgccaagggcttacatgcagtgcattgtcgcattcaaacccagacagtctggctctgggcccaggctgagctttggtatagcatggtagaacgttgtctataatgtctagtctgggttcaaatcctggcttcacttctcacatttacagctgagtgacctcaggcaagtgatttaacctccctgtacctcagttgctttatctgtaaagagaaaaatcacagcactgtggaatagtgggggttaaaattcattcatacaagtagtgctgcaagcaatgtttaatacagggtgagcacctgttcagtgcttccttcttctggctgcctctggggctagagtgtggtgtcttcgtggtatagatagatagatatggctgagctctgcacaaacaccaagagctgttcttcactattagaggtagtaaacagagtggttgagctctgtggttctagaacagaggccggcaagctatggcccattgcctattttaatacggcctgtgattgattgattttttttttctttttgagacagagtttcactcttgttgcccaggctggaatgcaatggcacgaactcagctcaccgcaacctctgcctcctgggttcaagcgattctcctgtctcagcctctcgagtagctgggattacaggcatgtgccaccacgcctggctaatttttgtatttttagtagagacagggtttctccatgttggtcaggctagtctcgaacttccaacctcaggtgatctgcccgcctcagccttccaaagtgctgggattacaggcgtgagccaccatgactggcctgattgactgatttttttagtagagatagggtcttggtttgttacccaggctggtctcaaacttctggcttcaagcagtcctccctccttggcctctcgaatgctgggattataggcatgagccactatgcctggcctatatgacctgtgatttttaatggttaggggaaaaaaagcaaaagaatgctttgtgacatgtggaaattacatgaaactcaaatatcagtgtcccagcctgggcaacaaagtgagaccctgtctctacaaaaaataaaaaaaaataagccagggccgggcgcagtggctcacacctataatctcagcactttgggaggccgaggcaagtggatcacctgaggtcaggagttcaagaccagcctgaccaatatggtgaaaccctgtctgtactaaaaacacaaaaattagccgagcatggtggcatgcgcctgtagtcccagctacttgggaggctgagacaagagaattgcttgaacctgggaggcggaggttgcagtgagccaagatcgcgacactacactgcagcctgggcaacagagcgagactccgacacacgcacgcacgcacacacacacacacacacacacacacacacgctgggtatggtggccagcacgtgtggtcccaggatgcactggaggcttaggtaggaggatcacttgagcttaggtggttgagactacaatgaaccatgtttataccactgcactttagccagggcaacagtgtgagactgaatctcaaaagaaaaaaaaaaaaaagaaaaaaatctttccataagtaaatatctgttggaacatagccatgtcccttagtttatgttttatatatggctgcttttgccctataatgacacaattgagtggccacgacagtctgtatggcctgcagagcctaagatatttgctctctggccctttacagaaaaagtgccttgacctgtgctctagagccatatgtaccaggtttgaaactcagcctcacagctgggtgtgatggcacgcatctgtagtcccagctactctggaggctgaggtgagaggatcacttgagtccagaaggtcgaggtcaagattgtagtgagccatgatggcatcaccgcactccagcctgagtgacagagagagaccctgactcaaaaaaaaaaaaacaaaaaaaaaaaacaccctcaccacttatcagctatttgtcttgagaatagtgacataacccctcagaacctatttcctaatctgttaaatgaggctgatgacgtttcctccttttactggcaatttaaacatgatggataataaatgctaagcacttaacacagggcctagaagatattaactgctcaataaatggtagcttcttaacagtattcaaacccatgtgctcttatcacatgcattgttgtccctgtgtccagttggtggaatgggaaaaggctcccttgtaaccccatctaccatctttatcagactttcctgccatggttcacagtaagagatagaagctgcacggtgacttctggctctttacaatggtgagcggtgtgtgcctggtaagggagagctgatgtcactgccccaaatccagtagtgagatctgagtgttctggtttcctccagcagccttgctttttcctttacaatcctgcaggcagggagacaagggctttctacatggtaggctctggtttggtcatcgtcacaactgggggctgttcaggtgggctcccattccagatacctaggcttatcaatcccttttggcaccccaggcctttttctccctcatgccccatttttcagtttgaaaagcatggttatcacaggacaagtagaagaagctccactgtccactgaggccaatggatggtgttctgcatgtgaacactcagtgaatagtgagtgaatgagagtaacctgggctccatcctatttgcagagagctttggaaaagatttttctccttaaagagccagaatgaagcctggtagtgggagagctccagctctagagtcacatgagcctacatttaaattccagccctgccactgactccctttttgaccttgagtgagttacctaatctctctgtacctcacttttcttgtctgtagagtgggaataattcctgtctcagagaaataaaagagtgcatatagtgtttgccacatggagacacatcaggtgtaggttaatactctgggccttgtttccttatttgcaacacagccctgccctggagtggaagtggcacctcccattggtcagctcttgaggctgtccccaggacaggcagagggagggaatgaatgggagccctagtgccaggacagaacagatggcagctcagagctaggatggctctctggacctgtctctcctaccagaggtccccccgtctggtgtggctcttcctggacctggcatcctctgctttttttttttttccacctccaagcagaattactgtcctgtaggcagctcctctgcttgaggacatctggggccagatatgttcacactctatcctgccttgcccttccctgagctcaggatggacgctcaattggtcccagttattgtctgcagcgcctgcctgcagcctcgatccagcccagctccaccccttgcctgcaaggtctgtttcctaacagctgctccaaccacacacctcggttctgcgggagcccctcctcttcctccctccctccctcattcaggggtgggactgaagaagaaggctaacttgacagcagcgcttctttcttagctagtcaccggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgagttggtctccgagttcccctctccatctctcctggcccctggtcctgagaggagggtggtctccctaaatctccttctcacttagtcctttaccatcggttctgccgggcagaagccagcggaggttatacccaaggagaatcggccttgtgaggtacccccattatgtcctggaagtggtgaggggagggatatacccagaaggaacttcttagggagctccagctccccttctatcccagacaaacctgaaggagcctccaaaagatgccactgacctgcccattgtagatgttactgcttccggggggaatagcccaaatagagtgctgtttccagctctcacatgtcttacctgcgggccatgctgcctgcccaggaatttgtcccaacaagcaggatgggcaggttttgccaaactgtggaaactggcaagtcctgggtgtgggtagcctggtacacagtaggcaccttataaacgtttgttctcttaatggcaggcacatttgcctctggccttgaagggcttctgagctcccaggtgaatgtagttgctggggaaagacctgggcgagtgcttctaagactggagcaatgggctttagagtgttcctgagctgctgggccagcccccacacctcctcagtccctaggcctaagtacctccacgagcctctctctgtggggcttctcagagggagatgtggaaactctacctctaacctggctttctttgctcattgccccactccacctcccatagaaactccccagggggtttctggccctctgggtcccttctgaatggagccattccaggctagggtggggtttgttttcattctttgggagcagcctgttgttccaaaaaggctgcctccccctcaccagtggtcctggtcgacttttcccttctggcttctctaagctaggtccagtgcccagatcttgctgccgggatactagtcaggtggccaggccctgggcagaaaagcagtgtaccatgtggttttgtggaatgaccggaccctggtagattgctgggaagtgtctggacagggggaagggggaagggaactggtcctcaatgctgactctaccaagcgccctgctagacactttatcctttaatctctcaacagcctaaagagattatatatccccattttacagatgaggcaaccagtttcaacagagttaacatatggagcctcactgggcagctttttctgtcttcctgactttctctcatccttcagggggctgcaggtttgttttcttctcctagtggagaggaaattctcaggtttgttttcctctcctagcagagagtaaaaaaagggatagtttgcctgacttgttgaaggtgtggctgagattgttttctaaagagccaatggaaattgatcttgagtttaggagaaagcttttacatgtggaattaagatgccaagtgttgaagtagccacatttcaggtcctcattaatttctcttaatcctgggaaggcagcttaggagaagggttgttcctttaggagccaggaactataccccttttacccttggagaggcagggaagccagggaggacacaacttctcaggaagaggagaagctagagcagatagtgaactctcaacctgaacctttaagggccagaccactaatgccacccaagtccacctgccgtttgtcttgttctgtcccaggctttctggagaacctgatcttcttgcccctacccccaagctccgtttgcccagctagagtctggggggtactgactgactttcgtagacattcttcccttccccaaataagaggccacattcctgaagtcacttctgaagagatagctgccacacagggctctttccccccagggagggaccacccagaccctctgctctcccaggtatccgttaccacatcactacctggtcagaaagctgtttctgccattagcccctccctcttttattataggatatcctcaagggctcctctttgggcctcagtttcatccttggcagaaagtagaagctagacttcttgggctcctgaacagggtccttgctggattctgtgaaacaaattaagttcttgaccctaggcctctgggggagtacaaagtctatgggagttctggggctgtggttgcaaggaaagtgacgcaaccagattccatggggacatgatcaggcgtgacatgtgagggaggaagagggagcaagggaatgaagaatacaacttctgtgtcccatacacccctgcctgacaggccatacatactcagcagagaatgcactgtctttcctaccacactagcgtgaggagtgagctgcaattaccactgtgcttccaagtaagaaaatacctcaaattggaatttacaaaagaggtaaattagggagtggcttttgtcggacatctttaaagcatttttctttttatagaatttcacttaatgtccaatactgatttaatgagcttgggtttacacattatctcttgaagaaaacaaatgaacctttgtgttccaaagcaatccatgtttaaagggaaaaaattatgcataactctgcccagcttcacagtaacctttggcaggtgccttaggtcctctgggactcttttccttatctgaaaaatgaaggacttggatcaggtgaatggttcccagctctgcaacttatgtggctcctcagaggcacacaagctcttttccattatttgccaaataatggaggccctgtctttaactgcagtacaactacacaaaatacttgaaactacagtcttcctggtttttggttggaactgaatcagtgcactctagcaacacttatttcttgctgttcgtaggcttcattatgtgtttggttaattttttaaaacaacaataacatattccataataattacagcttaattggcagactgtttcagtctataggatctgcaggaaggaggagtaataaagggatttttgactgagctcttatggaacagagtctctctaggcccctgtcatatctgcccttctgggccctggggaaaagttggcatccccagttgtggtgctctccaggtgccctcaggctgtggtggagggagcttcccattctctccttcagcccactcaattcagaggctaggggctgaaagaagcttctctacaactggctgttcactgggaggttaagggatgaccatccagccaggccttcctcaggacatgggagggcttatgctttaacatgtgtaaatccactgcaataatgactggttcttttaccccataaggttgagaatttacctgtaaacatttttgtctgaagaatttggatgtaagtgagggctgggcctctatcttatctcacttggcttctctcagcacagcaccttgcctgcttgttcttacacatcctagatgcacagtaactatttcctaattattagaaatctattagaatcaattgatttcagctgggcttggtggctccttcctgtaatcccagcactttgggaggccaaggctggaggatcacctgagtccaggagtttaagaccagcctgggcaacatagggagaccctgtctctacaaaaaataaaaaattagccaggcatggtggtgtgcacctgtagtcccagctactcaggaggctgaggcaggaggatctcttgagcctgggaggtcagactacagtgagcaatgattgtgccactgcactccagcctgggtgacagagtaagactctgtctcttaaaaaaaaaaaaaaaaaagttgatttctatttggatagataaataattcattttaggacctttctttttcacttacagaaatctgtttcattctgggctgagaagcaggtccatattgctaggcataggagaaaaaggggtctgtctgcatttgcccttggtggtctcaaattggggagggaaagaaatgaacacttactggctaccttctgtgagccaggcatcatgcaagacatctgtacataatttaattctcataaccccataagatattattagcaatgtacaagtgaggaaactgaggctcagagtcatgaagtaactggccttgggtgacacagatggtaaatggcagagaaggaatatggatccaggtcttgaaagagaaaatctcaactgattatcttttttaaaaaactcatatgttctctgctgactcaaaaggtctctgtgtggatctgggttgacccactgaactgaccatcagggttccatgcactttgtatctgcccaagccctcagaacccctcagtaatgttttggaagatgagttttggaggttgtccttaggcatagcctcagcgtatgtaggcctctaggtgatctcccctaacctgaggatttcagctcaattcactctggctcctcaggacagtgggatgactggttcagacctcagctttaccacctcccagctgggtactcttctacctacagccagggcagattttgactttcacttgaaacttccaaaaattgaaaggtagaaaaacagccttggctttgggaagaacgtatgatgtccatggcctctaagcatctgaggtgggacatgttcgagtagcaccttacagttccaaagtgtgttctgggttctttgtttaaaagaacagagactgctggggaattgaacactgtgaagtatatgaaggaggagaattgtgctatttaacattcagtacttgggctaaaggagaagcatcacgaagtgttaacactcaaagggtcttgagctgtcagggctccagcttccttattttcacaggtgagaatcctgaggctcagctgttgagatgtgctgtctcactccggtgacatagtacagtggatgtggctttgcagccaagcacacatagcttcacattccagctccatcaattatgtattgggcagctttgcagaatgatttgactttaactctgcttttcagtcttctgtaaaacagggataatcctgctaccgtagggttgtcaggattagagataatataaataaggtacctcatataggacctggattatggctggcattcaataaatagtagctgttaattgatagctaagctagaactctgaagtctaccatggcaacttcttaagtggtctgagaacccagttgtgttctgtggcaaaacacagcttagggatccatacccagccctcctgtcagctgttcaccttccagttcttcagagacatgtgtggcagtgactttggccacatagctggctgtgccctttaaaggcattccttgacacagatatgtggactggtgacgttgctctccagccaggtgttcttcccagcaggctggcctggctgtctcctgcatgcctgtacttgtttgtctccctgctccctctcctgggcctggccagagctacttgcagcaaacaaaagcaggatattggcaatggaaaggagggtgtgttctggtgctcccatgccctgcggcgcacataccattgcaagggcgtaacagagcccaggcctgcatttgggtgcaaataagtctgcacacagaagaaaagaaggacctggtgaccaggagccatggaacccttgtgctcccctacctgggctactggttcttgccactcctaccattttcagtttggaaatatttgttaaggctttgctcttccaggtcctttgcttggtgctgagtctaccaagagtaagtgggatgctgtttttgtcctcagggagctaacagtctagtgaagaagaaagatggttgcccaggaacttctaagtcagaaggcaggaggcaagaaggaagcccctgctcctactgccagccctctgttgggcaccccatagttcttcagaaccacatttaatcctcactgcaggccaggcatagtggctcacacctgtaatcgcagcacttcgggaggccaaggcgggcagatcacttgaggtcgggagttcgagaccagcctcaccaacatggggaaaccccgtctctactaaaaatagaaaaattagccgggtgtggtggcatgcgccagtaatcccagctactcaggaggctgaggtgggaaaatcacttgaactcgggaagcagaggttgcagtgagccgagattgtgccactgcactccagcctgggcgataagagcaaaattccatctcaaaaaaaaaaagaaaaaagaaaaaatcctcactgctaccttgaaagtaggtgatgacattgccatttcacaaatgagaagtgaaggggctagcccaagatcacttaggtggtaaatggtggtgctaagattagaacctcagatcatctagggaaaaacacagatatgcacagagttaaggggacccagggtattgtttgtcctcttgtttcacaggtggggaaacaacccagagagggaaaggggcttgtccaaggcaatttagcacccaagaacttgaacccatatctctctcctcctcatttagagctcatcccacatgtatcttatattgagaggagtgtgagccacataccaagaacagtcttcccctctgcctccaacctcactgtgcagttttgagacacttcacagccatactcttcatgccatacccagcccttaagaccctgaagttccccttccataagacaagtaggaaaagctatagggtaaaaatagccatcagtgtttgttgagcacccaggaggaattgggcactccagaaagataaagggattctcagggacttgcttctctagacttccctagctcagctgcttcaactcattcctgcccctcttctctacctcccgcagtgctcagaagtagtagaactcactgtggcctctcaccttgcattgttgagttttatttagactttctcttcctcaactcttcataagctcatgaaaggtgaagtagggtgccctgtgtatttatcttttatatctgcagtgcttagcaagttataataatgcacttgcctggcaaaaggctttctctcatacattagcttatttcctcttcacattggctctttgtagtaataggatgctattagttattttcaatgagagaaagctactaagagaagttgtccagctagtgacagtaagtggctgataaagtgagctgccattacattgtcatcatctttaatagaagttaacacatactgagtttctactatattgggtcttttttttttttttttttttttttttttttttttttttgagacggaatcttgctctgttgtccaggctggagtgcagtggtgcaattttgggtcaccacaacctccgcttcccaggttcaagcgattctcctgcctcagcctcctgagtagctgggactaccagtgcacgccaccacgcccggctaatttttgtatttttagtagagacagggtttcaccatgttggccaggctggtcttgaactcctgaccttgtgatctgcccgcctcagcctcccaaagtgctgggattacaggtgtgagccaccgcgccctgcctatattaggacttttatataagctatctctagctagctagctagctagctataatgttttttgagacagagtctgactctgtcacccaggctggagtgcagtggcgtgatctcgactcactgcaacctccacctcctgggttccagtgattctcctgcctcagcctcccgagtagctgggattataggtgcatgccaccacgcccagctaattttttgtatttttagtagaccaggtttcaccatgttggccaggctggtctcgaactcctgacttcaagtgatccacccgcctcggcctcccaaagtgctgggattataagcataagccactgtgcccagctgctctctatatttttaatacatattatttccattaattttcacagcagttcattttatagatgaggaaactaggccagagaagtaaaatatcttgcccaagatgatgtaactagtaagtggcaggatcaagattcaaaccaagcaatgttcaaacctcttggaagcaagaatgtggccactgtggaaggtgcaaggccttgacaacaagaatagggaaaagaaggagctagaaggaaagagatggcatgggctcagcaggccagggagctcttagctgtgtgtgttgggaagctcagaagggaggaagaggttgtctgtgcaggtaagtcctgagaacacaccagacttttgagaggtggagcttcatagccaggtcattaggggagaagggagctatagattttttttttttttttttttttttttttttttttagagacggggtcttactatgttgcccaggctggtcttgaactcctgggctcaagtgatcctcccacctcagcctcccaaagtgctgggattagaggcatcagccaccccgcccagcgagctatggatctaacatgtacatcttacacagtgctaatagaatgttgggtttcttccccaatattttattttgaaaaaaaattcaaatatatagaaaagttgaaaatgtagttcaaagaacacctacatacctttcacatagattcatgatttgttaatgttatgccactttgtatatatctctctccctctatctgtatacttttatttatttatttttgctgaactatttcagagtaacttaaaggcatcttgattttacccttgaacagttcaatatgtttctgctaagaattctcctatataagtcagatatcattacatctaagaaaattcacggcaattttacaatataatattatagtccaaatccatatttcctcagttgttccaaaaaatgttcatggctgtttccttttttaatctaaatttgaatccaagtttgaggcattgtatttggttgctgtgtctctagggtttttaaaatctgtgccttttcttctccccatgactttttagaagagtcaagaccggttattcttatagaataacccacattctagatttgcctgattagtttttttatacttaacgtatttttggcaagaacattacattggtaacgctgttggtgatgggtcagttttgaagagtggagatgattaaactgcttttgttcattgaagtatctgtcaagaccagagatccttaactggtgccataaataggtttcagagaatcctttatatatacaccctgtcccccacctaaattatatacacatcttctttatatattcatttttctaggggaggcttcttggcttttatcaaattctcagagggccccaagacccaaagaggttatgaaacactagtctgtccactgaggcaggcaacacagagctggtttctggggccttgttcagtctgaaccagcttcccttggggagatagcacaaggctgtaactttgccccatcttggctttggatcaaagaggactgtccattttgttgtcatacctaggaaccagggacagcttatgtggcctggttccagggatccaggagaatttcagttcttgtcttgcctttcaggtgttcagaatgccaggattccctcaccaactggtactatgagaaggatgggaagctctactgccccaaggactactgggggaagtttggggagttctgtcatgggtgctccctgctgatgacagggccttttatggtgagtgaatcccttcatatctgcccctcttggtcttcagagtccattgacagtgcttccagttccctgtggcctgttaatcttttagtctttccatcagccagggcatctccctttatttattcattcattcaactagcaggtatcaattgagcacctactaagtgaaaggtaagatccttccctcaaagacttaatagttgaacgttgggagtgggaggagaggcaggcagagaggagacacaatatagttggataaggacctccaaggagagtgttacaggctgagaggaggatatacttaggttgtctttagggaatcagaaaaggagactctggaataggctggcagagagaggggctacctcctatacctgctctggacaaacgactttaagcatagtgacagacttgccaaccctgtattggaagaactgatcttttttagtggggatgattacttctggggatttcttctcataactgagaccaaaacagttttgtgcagtctcagaaatgacaggaggtaccaatctgacacttcctttggaagctctagggcagagagtgaaagagtggattttgacgggggccttgcttggaggtcattcacccacccctgtcctcactccagcaacagtgataactcacttccttcctccctttgtacacccttctccccacctgctcacaggtggctggggagttcaagtaccacccagagtgctttgcctgtatgagctgcaaggtgatcattgaggatggggatgcatatgcactggtgcagcatgccaccctctactggtaagatagtggtcctttgtctatcctctcccatataagagtggctggcggggagggacagtggcagggtgagttgggcagaaggagtgttagggtagtcagagcattggattcttaccacagcagtgctcttaaccagctctttaacttgtaagcagaatgatttacacatgtctctaccctttttccttaccaaccttgaaaatgtcttcactctgccctgcaatcctcccagtgggaggcactcttcaaggacgatcccagaacattaaagtcaaagaccccttagagctcaccctgtccaaccaccttggttgataaaagaagtcagcctggggcccatggaatagaatagtacaagggcaaggttctcattgtgagtcaaaggtagagtgaagagaacccagaccatctcaccccaacccaggccagtgtttttccaaatataccacttgctgcagatctagctcagcacccccagtcccagcccaccctgagaacccaggctcctcattctgagcagccagctagaatcatgacaaagagggtggtagtgagactatgggtactgttgcttaaagccacatggtgcagtggttgctggggggcttctgtgtgggactctagcatcttattcccccctgtgccctctccccagtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagagtaagtattttgagaacccttcagcaggggttcttgagcagagtctgtaaatgggcctcagagggcttagacctccaaagtctcatgcagaactccctttattctcatctcatatctttctcctggaccccactatgctgtaaccgtacctgggccttggcacttactgttctctctgcccaggctacttcctacccgatacttaaggcaagaatcactcacctttcaggtgtcaggtttcaggtcatgtttgctctttgaaatcatctggcttgattatgtgtattagttgtttatcttctatcccctccactagaatgtaaattccagaagaaacttgctgtcttattcagtgctgcatgcccagggcttggaagagtacctggcatatagtaggagttgattgattattattttgtcagtcgagagaatgaatggagaaaatgtggtccatggcccaaaagaagttaagaccctatcctagattcaggccagagaccagatggagaaagagtctgtgtctatctaataccagtaatgtcgtacctctggccgcttaccatgtaaatattgattgtgtatctaccatgtgttggacactaggctagtgcttgcacagcaggtgaaagatactagagtttgggaagtcaggaggagctaaggtctgttctacaaccttattagatgaagaggagagggaattgtgttcagggcagagggagaagcatttctccaaaagtaggagtcttaatcatgtctgatgtaggttgagtgtggccagaaaaggggctgttaagtatagagggcctggattatgaaaatccagcagatccattgagagtttaagcagcaaggtgttgtgaccaagttaacattttagaaggatcactggtatggaggttggattggagaggggaaagcctaaaggtatagagactagttaggaagctattgtaggctgggcatggtggttcatgcctgtaatctcagcactttgggaggctgaggtgggaggattgcttgaggccaggagttgaagaccaacctggccaacatagcaagaccccgtctctgtttttcttaattaaaagaaaagtccagacgtagacatagtggctcacgcctgtaatgccagcactttgggaggccaaggtgggcagattgcttgaggtcaagagtttgggattaggccaggcgcagtggctcacgcctgtaatcccagcactttgggaggccgaggtgggcggatcacaaggtcaggagatcaagaccatcctggctaacacaatgaaaccccgtctctactaaaagtacaaaaattagccgggcatggtggcggacgcctgtagtcccagctactcgggaggctgaggcaggagaatggcgtgaacctaggaggcggagcttgctgtgagcagagatcacgccactgcactccagcctgagcgacagagcgagactccatctcaaaaaaaaaaaagagtttgggattagcctggccaacatggcaaaaccccatctctacaaaaagtacaaaaaaattagctgggtatggtggtgcgcgcctgtaatcccagttactcaggaggctgaggcatgagaattgcttgagcctgggaggtggaggttgcagtgagcccagatcatgccactgcactccagcctggatgacagagtaagatgccatctcaaataaaaattaaaaacaaagtttaaaaaaaaaatagaagctattaccgtgatccaggtaagagatgtgaataactacaatgatggaaagaaggcagagttcttagagatgggagtaggagagatgagggaactccagattgggaagatgatgttcaagtttctggcttaggccacagggtgagtggcaattcccttcactgagatggggcatcctggaaaaggtgttgcctttctgtgtgggtatcctgggccccttaggggccactggtggcctgggacctggtaaaccttccctgcacaagcagaattggtcaagcaggtttttaggacatctttaccctgcctcaactcttgtctggcccagggtcaaccggatgcacatcagtcccaacaatcgaaacgccatccaccctggggaccgcatcctggagatcaatgggacccccgtccgcacacttcgagtggaggaggtagagtgtgtgtctaatctgtcttgtgagggtgggacatggaacagatcctctgagaaatcaggctgtagcctttaccttttcctacccccagcccatctctttgtcttagcattgagcctgtgaccactggtgacctatttcagcgtaacaggttcccagggtagcagggatggttgatggacgggagagctgacaggatgccaggcagagggcactgtgaggccactggcagctaaaggccaccattagacaagttgagcactggccacactgtgcctgagtcatctgggttggccatgggtggcctgggatggggcagcctgtgggagctttatactgctcttggccacaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggtgccacctcccaccctggctctgttctgtcctatgtctgtctctcggatgaagctgagctggctttcagaagcctgcagagttaggaaaggaaccagctggccagggacagactatgaggattgtgctgacccagctgcccctgtggggatcacagtttacagccagagcctgtgcggacccagctgtctgccaggtttccttagaaacctgagagtcagtctctgtccactgaactcctaagctggacaggaggcagtgatgctaaaccctgaagggcaacatggcctatggagaaagcatggagctcagagcctggagtacgggcacagataggattgaataaattgtgtagaaagactttgaaaacaataaagcaaaagatgaatgaacgttttttttagacttgagggaccaacaacccccaaaccccagattctgccaggtccatggggaaggagaagttgccttgagtggaagccccaagtagggagacttacagaaaagaagtcaagagcactggctcccaggcagaaatactgataccctactggggcttcaggctgagctcctcccttcacaaatcacttcatctctctgagcctgtttctgcatctgtgacataagatggtaagataaaggtggctgtctcaccaattatgtaaggattaaatgtggaaaaggacataaagttgtatagtgctgccatagggacagtgttcagtaaacgtgacacattcttagtatcactaagaatcaggttcttggccaggcaccgtggctcatgcctgtaatcccaacactctgggaggcctaggtcggaggatggcttgaacacaggagtttgagaccagcctgagcaacatagtgagacactgtctctacaaaaaaaaaataataataataattgtttttaattagatgggcagggcactgtggctcacacctgtaatcccagcactttgggaggccaaggccggaggattgcttgaggccaggagttcaggagcagcctgggccacattcctgtctctacaaagaataaaaaagttaactgggcatggtggcacatgcctgtaatcccagctactcaagaggctgaggaggaggattgcctgagcccaggagttcaagactgcagtgagccttgatcacaccactgtactacagcttgggcaacagagtgagaccttgtctccaaaaaaaaaagtttgtttttttttatccactctcctcaccaaacaaactgagtaagttagagccctctcagctggcatgtgttggaaacagtgccctctcattaaagtgctgccctcactcccattgcctcttggccttggtcagtatgatgaaattagtgggaggcagggcaacagagggcagggaagagctagaaatccatggcctggaaaagggaagatttgggagtggccaggtatctgtagagccaccatgcagaggaggggggcagctagccttgtgtgctctggtgggcatggtcagcaggaggcagagcaaaaggacaagggtaagtaaacctgtaggtcgggacaagccaagagccatccagcgtcagtcctctctgggtagcccaagtaaagcaggagcataccccagagagaaagttcgcagggctgttcacctgcagtgctgtggacttcaaccttcttgttccttcttcagtaagtgaaaataacagtcattgaccatgactattatcgaccgcttttgaaaatgtaaacatagtgactttattgctgtaaaaatcatacgtgtttatcatcttaaaattcaggaaacatggacaggtacaaagatgtgcaaaatatcatccaaaatcccatttgctggccaggcacggtggctcacgcctgtaatcccagcacattgggaggccgaggcgggcaaatcacttgaggtcaggagtttgagaccagcctggccaacatggtgaaaccctatctctactaaaaatacaataattaggctgggcgcagtggctcacgcctataatcccagcactttgggaggccgaggtgggcgaatcacaaggtcaggagtttgagactagcctggccaatatggtgaaaccccatctctactaaaaatacaaaaattagggccgggtgtggtggctcacgcctgtaatcccagcacttagggaggccgagacagatggatcgcgagatcaggagttcgagaccaacctagccaacatggtgaaaccccatctctactaaaaaaatacaaaaattattcggttgtggtggcacacgcctgtaatcccagctacttgggaggctgaggcaggagaatctcttgaacctgggaggcagaggttgcagtgagtggagatcccgccgttgcactccagcctgggcgacagagtgagactccatcaaaaaaaaaaaaaaaaaaaaaaaaaattagccgggcgtggtggcgtgcacctatactcccagctacttgggaggctgaggcaggagaatcgcttgaacctggaaggcggaggtcgcagtgagccgagatcgtgccattgcacttcagcctgggcgacagagcgagactctgtctcaaaaataataataataacaataactagccgggcctggtggcacatgcctgtagtcccagttactcaggaggcggaggcatgagactcaggtgaactagggagacagaggttgcagtgagccaagatcacaccactgcactccagcctggttgacagagcgagactctgtctcaaaaaaaaaaaatcccatttgctcattttttggatactagtataactatcactctaaaccagttagtacttaaatcaagcagatatgggagatggtgaattaccatctacagtgttgtcatatatgtcacatactgagcattatcagctagtagaatctagttaattgttctatgtgtgatgtatgcagagttcccattttgaatgtgtttttactatgcttaaataaatgactgatgtcagcaaccccaaaatgatacatctgatgtaagagcccctgttccccaataataacatctaaactatagacattggaatgaacaggtgcccctaagtttcctccctccagggtttcttggccggtctctgaggactacacatccctactcccgtctttcctcatcttcaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgagcgcaggcaacaattgctttgctcttctgcccccagtccctctgtcactgtctttcggggatttctcatcacttggccccaccccacaccatgcaggatgccaggcctccttcctggctttgggtgttggtgtgagaggtatccttcacccccacccaggccacctaaggtcaatgttgctgttacagtgagcttgtggacctggagatccaggttgggttgagctgtgcctgtggccctcctgcctccagtcagtgggtgtttgttaggtgcctgcagacctcagtaccgggcatgctacaaggagcacacaggggaatggctcctgcctccctggtgaacagtctcagggactaacctctctctttctctcctcctcctcctcttctgctgagaactgggagggggggtcaggtaagacgtgtgtctcagcttgggggcagcagggctggagagctcacccccgatccacccagctccctggtgcatgtctttggcactgaccttcctgcccccagacttctgttcactcaggagactcacttctatgccaaatgaccagagcccctgcttggcttggcagcatcccctcctgccttcttccccacttcccttttctgggttcttgcctgtcctctgtgcatgcccagctctccaggaaagagggtttgcttccgtgtgagtcccatgttgctccacgctgcatcttccacacatgaactctgtcattctgacccggctcagtgtgccctccaagggatgggatggccagctgcatagattttctcaaacagttctccagaacttcctctggtctcagcaccattaacagtcaccctccctgtaggtgacacacaaagccacgggcaaagtgatggtcatgaaagagttaattcgatgtgatgaggagacccagaaaacttttctgactgaggtaagaagatggagggggcccgggaggttggtgtcaccattggaagagagaagaccttacaaataatggcttcaagagaaaatacagtttggaattactgtcttaaagactaagcagaaaagagccctagaggaatatcccactccctctaaattacagcgtaattatttgttcaatgaacacttactaaaagcaacacaaacagggtacaagggatgcagtaacaaaagatacagggttcagaagagctctcaggttatgaggatgatggacatgaaaacactccaatttagtacaactcaatgttataatcctcacctgaacgccctgctaagggagcctggaggggagctccctgagcactcacactccttgggcatttacagttttcactacccctcccaagttacttcatggagtaacttaagttggggacacctgtggtctgggtattgccctccaagccacttggccactcccaccccagttctcccaatgcagttccaagggtaaggcctatgaagccatctccatctatatggtggtggtcttccctcatcctgatcttagtgccctgtcatatcacaagataggaggtaggagatacaggtggtaacacttgtcaagctgattccttggagggaagaggtaaggaagacagtgagaagttaaccaccagctttccttggcttcccccacccccaggtgaaagtgatgcgcagcctggaccaccccaatgtgctcaagttcattggtgtgctgtacaaggataagaagctgaacctcctgacagagtacattgaggggggcacactgaaggactttctgcgcagtatggtgagcacaccaccccatagtctccaggagccttggtgggttgtcagacacctatgctatcactaccctaggagcttaaagggcagaggggccctgctttgcctccaaaggaccatgctgggtgggactgagcatacacagggaggcttcactgggagaccacattgacccatggggcctggaccacgagtgggacagggctcaacagcctctgaaaatcattccccattctgcaggatccgttcccctggcagcagaaggtcaggtttgccaaaggaatcgcctccggaatggtgagtcccaccaacaaacctgccagcagggcgagagtagggagaggtgtgagaattgtgggcttcactggaaggtagagaccccttcctatgcaacttgtgtgggctgggtcagcagctattcattgagtttgtctgtgtcactgaaactgaccccagccaactgttctcagttcacagccctgttttcaaagaattacacatctctaaaggcaaacagggcacggacaaggcaaactggagaggcaaactgtagcctgagatggcctgggcttgccatcacaggtattcaggtgctgagggcccttagaccaactagagcacctcactgcctaggaaatcaatgaaggggaaatgagttctagcggagccctgaaggatcagaattggataaagttcttattggcagagaggcaccaggattgaagtgacaggagcaaagacctgggaggaaagaggagaaaatcatctatttcacctggaaacaaatgattccaagcatagaaataataacagctgacaagtactgagtgccctctatatgctaggcactgggctgagggattaacatgcatgtgcatgtttattcctcatgacaaccttggtttccagataagctggactggaaagggacagagctgggatcctgggctaatcagtctggtcgccaagcctgagactttagccactgcccttcacatgggggtccatgaaaatagtagtagtctggaacagtttgggggtacatcaaggtcgctgtgttttaagctatggagtctggactataggagacaaatgtaaaagagttttttggttgactggctttttggtttttttgtttgtttgtttgtttgtttttttgtttttttttcctgtttctggggcttgaatcaggaaggaggtttttttgttgttgttgttttgagaaaggatattgctctgttgcccagactggagtgcagtggcacgatcatggctcactacagcttcgacctcctgggctcaagcaatcctcctgccttagcctcccaagtagctggactacaggtgtgtaccaccacacctaattttttgaatttttttttctttttttttttttttttttttggtagagacaggttctcactttgttgcccaggctgatctcaaactcctgggctcaagcattcctcctgcctcgccctcccaaagtgttgggattacagttgtgagccaccatgcccggcaggaaaagatttttaagcaagaaagcttaagagctgtggtttttccaaaatgagtctgggctggcacagtggctcatgcctgtaatcccagcacttttttgggaggccgaggtgagtggatcacttgaggtcaggagtttgagaccagcctggccaactggtgaaaccctgtttctactaaagaaaaaaatgcaaaaattagctgggcgtggtggtgcacgcctgtagtcccagctactcaggaggccgaggcaggagaatagcttgaacctgggaggcagaagttgcagtgagccaagatcacaccactgcattccagcctgggtgacagagtgagacttcatctcaaaaaaaaaaaaaaagagagactgatatggttagtacattggggtggaatgcggagggtccagggaatggagccctgcatagggggctaatgaaacatttcagatttctgaattaaggtagtggctgtggggacaggagcctgggaggccgggtggagtcagaatggagagactggttggcaatgagggaacaggaggaggaggaggaggagttacgagtggcttgaggtgtcacttaccagacatttgggggatgggggatagccatgattgttgagcaactggtttgggaagagctagcattgatccctgctgttctgtgctagcagaacctatcagcatcttctgggcaggaaactggctccatgagactggcttagggagaggctgctagtcacctaatctgcagagaaggggcagctggagctgtgggacagaagaggcatccatgtagctggtgggggtgtctcagcttgtgaagaggagatggctttgagcagggctgacactgaaaaggctggaagaaaaaaacagacacacaagagtctcaggatcaggtagcataggaaagttgtggacagtctttgaggagcactccctcaggcaggcaggcaggcaggtcatgagctatagcgattcaggaagagctccctgggtgtgtgagcagctccaggagcctaagggatgaaagtagtattgcagggggctggagagcaaggagtggctccttctacatttgcaagggaaggagaaaggaagttgctcctgagagtggtaagagtcagtggtggaggcctggagaggagacataacaaacaaatttgttgacaaacattttggtaggaagggggagagcttaaagtttagacagtggggaaggtggagtcttagaggaggtgaatgtctgaaagacagagctagctggagcaagaagtcacttctctgttgcaggcaggaaggatccaaagtggctcaagccagagattgggagagtggggaggagggagcagcctggatctaagtaaaatgggtagaggtggagggggtgctgcaacggccagggttttctgaagttggggacattaggagagagctgtgagggctttggccagccactgtgctagtgattggtgaaccaaaggatgggcaggagatggcagcagggaagcagaggaagtccaggcttcctgttggtattgggacaagggagaggccataggaggccctggccctgttgtccaggttgggttctgaagctgggtgggcatggcctggtaggagagcatctatggcgcccaattccagattcagggtctagttgatttgctggccctgtagcctcagctcatgcttctgttccaggcctatttgcactctatgtgcatcatccaccgggatctgaactcgcacaactgcctcatcaagttggtatgtcccactgctctgggcctggcctccagggtcctatccttcctggcttccttgtcacaaaggaggctgacttgtcccctctggctagagggcagaggtgttgcctaggagctcctatctttcccttcctgcttcttccaatgcccttctctgtcctctgggagctccgagacacacacagacataatttcaccttctctcattagcaacctttgaaataatttgattagaagggacttcagaagtttgttgactatatgtagaaaaccctgtcattttacctgcttttgccccatagtagtcttgtaaaacagttcattgctgaccccattttacagtggtggcacctgaagcctcagcctgaggccaccgagctagtaaatttacagggaccagtttgagaccagcattcctcccactgcccctcagctgtggtggttacaatgttgtttgtcttactgacttgctatctggcttcctgggtgtctaccggctggccctggctctgccctctagacccacaccacgcaatcttcattcctttcccacatgactgccctgtagctattcaaagagcttgtctcccccaagtctccccatctactgcctccaccttgcctttttctgtcttatcctggttctagccactgcctgaaatcattttaggaataagacaggacagggaaaaacaaaagcaaccccctgtcccacctctgagttccactctccaagtccctgagcctcacctccagggctccagtggctctgccatgaacccactgtgggctgggagtctgctgtgcacagataccagaccctcagaaacacaaatgccaagtgtgtctgtttttttgttttgttttgttttgttttttagatggagtctcattctgtttcccaggctggagtgcagtggtgcaatcttggcttactgcagcctctacctcccgggttctagtgattcttctgcttcagcctcccaagtagctaggactacaggcgtgtgccaccacgcccagctaatttttttttttttttttttgtatttttagtagagacggggttttgccatgttggccaggctggtcttgaactcctgacctcaggtgattcacccgccttggcctcccaaagttctgggattacaggtggaagccaccgtgcctggcctgagtgtgtctatttgatagagctttctgctctgattctcccttgctatacaccttttctccccttctcagtggcttctcttgcctatgcttcctccccagggccaggtttgagaacatccccatgaagtcctgacctgtcttttatcctaccaggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggtgagtcctgaagccctggaggggacacccgcagagggaggacagatgctgcccttgcatcagagccctgggaattccaggggaggcctgtgaagcgtaggaccggatacccagagctgaggatatttttcccttgccaggtggggcctcacgatttagctcctgagctcagggggctgggaactgatcagtgtcccatcatgggggataaggtgagttctgactgtggcatttgtgcctcagggatcgctaagagctcaggctattgtcccagctttagccttctctctccatggtgagaactgaagtgtggtgccctctggtggataatgctcaaaccaaccagagatgctggttgggattcttgaaatcagggttgtgaggcctcagaaatggtctgaatacaatccattttggagtctgaggcccagagaagttcagtgaattgcctaggagcatacagctgcctaatggcagaggctagatgaaccctagtctggttcttttccactttaacgtgcagtttcatcctaggcagtgttatgttataagggctctccaaggcagttcacctacggctgaggaaggactattttcaggtggtgtctgcgcaggacagcctgtggggtgtccctacagaacctgttctagccctagttcttagctgtggcttagattgaccctagacccagtgcagagcaggtaagggatgtaaacttaacagtgtgctctcctgtgttccccaaggaaagagctatgatgagacggtggatatcttctcctttgggatcgttctctgtgaggtgagctctggcaccaaggccatgcccgaggcagcaggcctagcagctctgccttccctcggaactggggcatctcctcctagggatgactagcttgactaaaatcaacatgggtgtagggttttatggtttataacgcatctgcacatctttgccacgttcgtgtttcattggtcttaagagaaggactggcagggtttttttgttttagatggagcctcacttcgttgcccaggctggagtgcagtggcacaatctgggctcactgcaacctctgccttctgggttcaagtgattctcctgcctcagcctcccaagtagctgggactaccggcacacaccaccatgcccggctaatttttgtatttttagtagagacagggtttcaccatgttggccaggctggtcttgaactccggacctcaggtgatccgcctgcctcagcctctaaaagtgctggaattaataggcgtgagctacctcgcccggccaggtttttttttttttttttttagttgaggaaactgaggcttggaagagggcagtggcttgcacatggtcgataaggggcagatgagactcagaattccagaaggaagggcaagagactgttcatgtggctgtctagctagctcttgggccaaatgtagcccttctcagttcccttcaagtagaagtagccactctaggaagtgtcagccctgtgccaggtaccacgtggacagagtgaggaatcttggaaagattcctacctttaggagtttagtcaggtgacagcatatctcagcgactcaaacacacacacattcaaagccttctgtaattcctacaaagttgtgaggggtagaggagaggagagacaagggatggttaggataatgaaggaatgttttgtttttgtttttgtttttgagatggagtttcactctgtcacccaggctggagtgcagaggtgcaatcttggctcactgcagcctccgcctcccaggttcaagcaatcctcctgcctcagcctcccaagtagctgggactacaggtgtgcgccaccacgcctggctaatttttgtattttcagtagagacagggtttcgccatattggccaggctggtctcaaatgcctgacctcaggtgatccacccgcttcagcctcccaaagtgctgagattacaggcatgagctaccgtgcctggccatgaaggaagatttgttttaaaaaattgttttctttaatattaattgaacacctctgttcagagcactgggctggtgccagagggtttcagacatgaatcagatccagcacctcatagagccttaactctggcacacacacacagccacaaggagacacagacaaggcagggtaggatgagtggaagctaggagcagatgctgatttggaacacttggcttctgcagtgaagccccttcttagtcctcttcagtaacccagctctcagtggatacaggtctggattagtaagatttggagagatgattggggattggggagagctctctaacctattttaccacctcctcttctgccattcttcctgtccacatcccagcatccctttcccttgccaagtatctgtggcctctgtagtcctttgtaaacagctgtcttcttaccctacagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcaggttggtatcctgcctttttctcccagctcacagggtcctgggacgtttgcctctgtctaaggccacccctgagccctctgcaagcacaggggtgagagaagccttgaggtcaagaatgtggctgtcaacccctgagccatctgacaacacatatgtacaggttggagaagagagaggtaaagacatagcagcaagtaatctggataggacacagaaacacagccattaaaagaaagtttaaaagaaggaaattcacccaaaccatttgaatacagtaagtgtattcatctttcgatattcccctgtccatatctacacatatacttttttttatagtaaatagttctgtattttgccctgcatttcccttgtgtttactatccagtcttcctgtttatcatttttgtcgacaacatgaaattctattgagagactgtctgaacatattgtaatgtagatgttcaggtttttccagtttctctttacaataggtatttaactacagtgagcagttttatgcatttagctaatttctcctttgaggaagtattttcaaaattacctttattcttctcaggtaataatttcattattaccaaagttaccctaggtcttttcaagtgtgtggttaaaaaacgagaatctggctgggcgcgatggctcacacctgtaatcccagcactttgggaggctgaggctggtggatcacctgaggtctggagttcgagaccagcctggccaacatggtgaaaccccatctctactaaaaatacaaaacttagccaggcatggtggcaggtgcctgtaaccccagctacttgggaggctgaggcaggagaattgcttgaacccaggggcggaggttgcagtgagccgatatcacgccattgcactccagcctcggcaacaagagtgaaactctgtctcaaaaatggggttcttttcctgccatcaaaaatcatgtttcttttaaaaacaagttcaaacattaccaaagtttatagcacaggaaatacgtcttctgtaatctcccttaaccaatatatccctcaacattctcctcacccccaactccaccctcccaggataaccagttgggacataatctttatttaaaaatggtttccggatagagaaagcgcttcggcggcggcagccccggcggcggccgcaggggacaaagggcgggcggatcggcggggagggggcggggcgcgaccaggccaggcccgggggctccgcatgctgcagctgcccctcgggcgcccccgccgccggcctcgccgcggagccggcgagctaacctgagccagccggcgggcgtcacggaggcggcggcacaaggaggggccccacgcgcgcacgtggccccggaggccgccgtggcggacagcggcaccgcggggggcgcggcgttggcggccccggccccggcccccaggccaggcagtggcggccaaggaccacgcatctactttcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagtattgaatgcctactgtgtgctaggtacagttctaaacacttgggttacagcagcgaacaaaataaaggtgcttaccctcatagaacatagattctagcatggtatctactgtatcatacagtagatacaataagtaaactatattgaatattagaatgtggcagatgctatggaaaaagagtcaagacaagtaaagacgattgttcagggtaccagttgcaattttaaatatggtcgtcagagcaggcctcactgaggtgacatgacatttaagcataaacatggaggaggaggagtaagcctgagctgtcttaggcttccggggcagccaagccatttccgtggcactaggagcctggtgtttccgattccacctttgataactgcattttctctaagatatgggagggaagtttttctcctattgtttttaagtattaactccagctagtccagccttgttatagtgttacctaatctttatagcaaatatatgaggtaccggtaacattatgcccatttctcacagaggcactactaggtgaaggagtttgcctgacgttatacaaccaggaagtagctgagcctagatcccttccacccaccccatggccctgctcatgttccacctgcctctaatttacctcttttccttctagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggcaatatggagagtgaaaacatgattggctcagggacataaatgtagagggtctgctagccaccttctggcctagcccacacaaactccccatagcagagagttttcatgcacccaagtctaaaaccctcaagcagacacccatctgctctagagaatatgtacatcccacctgaggcagccccttccttgcagcaggtgtgactgactatgaccttttcctggcctggctctcacatgccagctgagtcattccttaggagccctaccctttcatcctctctatatgaatacttccatagcctgggtatcctggcttgctttcctcagtgctgggtgccacctttgcaatgggaagaaatgaatgcaagtcaccccaccccttgtgtttccttacaagtgcttgagaggagaagaccagtttcttcttgcttctgcatgtgggggatgtcgtagaagagtgaccattgggaaggacaatgctatctggttagtggggccttgggcacaatataaatctgtaaacccaaaggtgttttctcccaggcactctcaaagcttgaagaatccaacttaaggacagaatatggttcccgaaaaaaactgatgatctggagtacgcattgctggcagaaccacagagcaatggctgggcatgggcagaggtcatctgggtgttcctgaggctgataacctgtggctgaaatcccttgctaaaagtccaggagacactcctgttggtatcttttcttctggagtcatagtagtcaccttgcagggaacttcctcagcccagggctgctgcaggcagcccagtgacccttcctcctctgcagttattccccctttggctgctgcagcaccacccccgtcacccaccacccaacccctgccgcactccagcctttaacaagggctgtctagatattcattttaactacctccaccttggaaacaattgctgaaggggagaggatttgcaatgaccaaccaccttgttgggacgcctgcacacctgtctttcctgcttcaacctgaaagattcctgatgatgataatctggacacacaagccgggcacggtggctctagcctgtaatctcagcactttgggaggcctcagcaggtggatcacctgagatcaagagtttgagaacagcctgaccaacatggtgaaaccccgtctctactaaaaatacaaaaattagccaggtgtggtggcacatacctgtaatcccagctactctggaggctgaggcaggagaatcgcttgaacccacaaggcagaggttgcagtgaggcgagatcatgccattgcactccagcctgtgcaacaagagccaaactccatctcaaaaaaaaaaatctggacacaggctgcagttgtcactttccagtaacagggcgaggatgaatgaagaaaaggcccagagcttgccacataggtgttgacaaggtaacccaaagcttctcaacttacacggagggttcctgttacccctcaaaaacttggcaatgtggagtctttttttttttttaattaagtcaaatgcagagcaatttcccacactatatgcaggtgtcagaatgaggtatataaaacatgtatatagagaaatgcctttatagaaaagtagaaaccagtaatattctcttctccagcatcactaacaccaagagaccacctgaggtctaggtccccaaagcagatggctccatagaaagccccactaacccgtctccacattgggcagtggaagggttctggaaaggaagctctatggctaggagctgccaaggcctcttgagtgtgacatcacaggttagaggccctgctgagctgctagcacagtgcagtggagaaatgttgcgctccgtcaggaagctgggctcttgccatgccagtagcttgcttacgaccttgggcaagtcactttttcctctctggggtcctgtgtccaaaaggcttaatgagccctttctaatggttctttgattgcttta

SEQ ID NO: 16756 - DNA, 58361 bp, Human; identical to SEQ ID NO: 16755

SEQ ID NO: 16757 - DNA, 35678 bp, Human; identical to SEQ ID NO: 12786

SEQ ID NO: 16758 - DNA, 35678 bp, Human; identical to SEQ ID NO: 12786

SEQ ID NO: 16759 - DNA, 22712 bp, Human
cgcacaccgcttctcttaatggaagcgctcagtttggaaccgtggaaagtttggaacacatacttcgctgcctctttgcaactgtgggaacttcccgcccgcacacgcggcgcctgcagcctggggctccgcgccaggcggcccaaaggcagccgccagcgcttcctgggaagacaaaccttggtgtacaactctagcgtggtagcatccccgggcgggccggggacaaagcgccgaggcctggcggcagggcccattaccagagcacccggcgtctcacagggctgcgggcgctggggatgctccgggcttggagaggcctgagggtgtccccgactcctccggcacccccacttccctgaggattgctggggcttccgggggtccctgccccgtccatcgccctcatattgtcgcctcccggagctggtgacttcacgctccccggggacaaagctcggcgtgctgtggtttgggggagaagctggacgctggcttcatctctccagctcttccgggcgcgcagcccatcagatcgatcaatgtaccgggtgcagaagcagctccggaggttcggcctgtctccggccaggaccccgggccctctctggtgtttgaagcagggaggcggtcgcaggcgacttctgggaatttcacgcatgaaagcggggctccgaagggtggacgacgcccgctcgacctgcgagtgcgcttcgcaggctggggggcccggatccgcacccctcagttcctgcccccccaccctgctagccgccactctcagcgggcaggggaggggcagtgggagctggtttgctggctcggcgcttcgtttgcattggtccgggggggctgagactgcagcccccggccccgcgggcggggtggggaggcgggggccggacgggggctcaggctgctctagcattggcggatctggggaatggggagggggggcaggaagcggggggagcggagctgcggggggggggtgtataaatagggaaggggggacgtgcatcctcgtcttggtgaggggggggcgctcggcacaaagaaagtgtaaagattgcagcgcctgacggccccggctaggcatccgggcgcgcacgtgcaaggccggggaccgccgggggcccccactctgagctcgccgtttcttttttttctgcaagcgagagggggggtgttgttggtatcgccccctccttctcctccccccaggggtgaaagtgcaagaggaagtgcagccgctgccatctttcctccgctccgaacacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgcacgccttcgccttcgccttttgtttcctccgctccggcgcccccgcaccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggtgaggaaaggccccctcttcctcccctgccacacgttatcttagtcctgaaaaggctcctgccaagatctgggggtgtgggatttgtgggggtcatttgaccttatagaaccatgccaggtttgggtagagtgtttttaagggcccttattttgagatggtatgcctgagacctgctttccattccctcagggaagtttttttgacgctaagtgtgccctactgtctctcctcctggggccggattcctcaggccagagccaccggacctcaccattcttcccccagggctccctttgtgtttccggcaccaggcgtggggccccctctgggggcgggagactgggctcctccagcgacttccccgcttgaatggctgccgagggaggtactggaacaagtgcatctgggactccctacactcttgaggcaccagattccccaacacagaacactggccatcctgatcagtagactccagctgtgcctctcacaccaccctgggatcatgggacacagagctggtcacccagagctgctgcttaacaccaaaagctttgatctgctctgacctggtagctctagagcctaatgggacccacgagcccctttatgttttcaggacagaaaggaatggggacaggatctctatgtaggttcactttctagttagcctgttggggaactgaggacttgtctgggagcagagggtgattttgtttttctcctaaaaggccggttttaacctggattgtaggaccttgtgtgtgtgaacacagggatggagaactccctcagagggccccgaccaggaaccagtcttaccggtcaggcagcccctgcccacctgctcaggcgggcatctggcttaccagcccagctggggacttaaggctccactgctggcctctggggactgaattccatccgggtggcattcattggctgcccgtggcgggagaggctgggggaggggattgctgagtttctaaggggctttagtctggacaatgaatcacatatcccctcctggaaaggctgcagtgaggcagctctgtttcattctactgccaccgcctctggtcctagaaaacactgagtttctggtggggagaattgagggagtggggaggcaaaatcagagacaaatgcccatttctcttcccccctccagagaaaaccagggcagagaggcctgggcctgtggagccagaactgggtggtgactttgtctttgtcatgctggggttggggagagggagtcctttccagcagtgagtgtgtgtgtgtgtgtacacacgtatgcatatgtgcctgtgtggtggggtctggccaagtttctaaagtccctcttggttctctcttttccaggcctgatcacttgaacggacatatcaagcaggtgcacacttctgagcggcctcacaagtgtcaggtaggggctgggtcagggcagagatgggctgaaggagatgatgctgttctcacggtcgcagccttgagccagccgctgcgtgtgccgggggcccggctgaccgcccaccgctttgcacacctcccctctgttcctccaccctccctctgctctcctcctttgttcttcccccaggcccccttcccccacagctgacgttcctccttcctggttgcttggtcctggttcccaccctgtctttgccttcactctgttgcttggctttcctctcctggtgtttgccggctccttggatggtgggccgtatcacacagatgttgtgttgggagacccggcactgcgctgggcctgactgttggtttccagcagtttgtagggactgcaggtttttttaaaagggctcctggtggtccagccaaccactcttccccttttctgacctcagttagagctcctcctgggtcccctcagcttagggcacaaggcagtgggggaggtaggaggtagggagtgggtggtcccctctcccacactggcatctgtttaacccatcctaagccagggtttctggaggactggagagcaaagtgggctcttcttcttttagctctttgcaaagtagcaggtaggaaacgctggaccagatagattctcacccttggtttacctgcttgaacaatatctgggggccctgctggtacccaaaagattgagtttcctctcctggccactgagccttcctgtgtggatagcgaacacacctctgtcttctccttggttatctcccctctcccatgccaagttcccatcaagtgagggcgagccatgattgtggggtgtgcactgcagtctctgataggataacctgcttctccttatcctgttggtggcaaggggagagggttcagggagaccagcagggagggatgaatgtgccgtaagtagggcagagcccctgggggtcaggcgtggacggtgttcacaggtgctgggctaggcagtctccctggaggatgacccagggtgggcctgctgggatctgtctttgccttgctgccttctctctctctgtctctgattctctcatcacagagcacattctgactcaggtagtgtgctgattagcccgggcagagtaggaggagcccagagggcagtgggggcaagcccggtggcctgggggggtaacctgcactctctgccctttttccaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacatttgaggctttgtgtgttttgtccttggtctgtgtcataacactgacatcactgtcccttggtgtacaaatgcgctcctgccctgcccctcccaacatacactctcacagacctgctggcccctcctccagccctacagccacaactcccctaacggacccagcaggtgaagacatgctggctctcttgctctgggctggccagccaggtgtgcctggacttggttaaacagcaggggcacctgttggcatagtgtggggatgctgaaaacataagaggtgaagagacggctctctgggagttcattccttgagttccccactggctaggcacagtccgtatcgctcatcccctcctgatgccagagagaatgaaagaggccagttacagagactagtgccatagcttaagtagaaaggccatctgaatgtaggggcaggaagcctcaggcttgacagtggcatgtctctttgggacttggcctgagtgtccttaactggcccagatgccccaggtactgctggatttatgagcttagtgggctgggacatttcccccacatggagttcaacctgaagctgagaggctggagcagctcagacctccctagcttccacgggctccacttcttgggggctggttagagaaggaatgcgttgagatgggcatatgctcgagaagaagggggccaaagagcccagggagctgaaccttcatgcattgcccttagagttttccagggctgtgggagaaagctgcttgagactacccctgaggctgcctgagttcaagggctactaagggtgggggtgtgcactagtgcccttggtaccacttgggccccattcccaagctgctcaatccttaggaagaaaagctttaggaagtctgggaagggagcaggactggggctcagtgttgagtggtgatgacctgcactcagggtgcctgggccaggacctggcaggcatggcccttaattacagcaggctgtctaactaagcacagggctgtgggccgggcagctcttccgagtgccacaggcagtcaaagcattctgcctctggctcactctcttcccatcagcgtccctctgtcttctccctgtctctaggacaaagaatgctcttctcctgacaccccagcatggaagttctggatgttccctttgagatctgtctccctccgccccttctctcctgggttgtgtgaccaggctctttcatgttctgtgttgtctgaacttctgctgtgcctagactttggactttcacaggctccccagaaaacctggggactgcagcagcagagggtcaatcctggcacagagaagccaacaatcacttcagcttggctttgaacacagggaaagcgtttgtcatgtttgtgttttttcccccagcagcagatttacattcctaattctgtttgctcaggcgaaagttagctttcattccttgagagataatcaatggaggacagggtgggggaagccagcccagtctgggattttaattttgcttagctaatccccaaatggataagccacttgtgggtaactgaagtttggctatccatcatctttaggtagcaaagcatgacaggcaaagcctttagaggacagatcccaaaagaaggttggcaagagaaacaaggcatctctttcctatccctcttgtggctccctctcccagagactgtggaagacaaaatcctgaatatgctttcagcccccgagtagctgggactacaggcgcccaccaccatgcccagctaatttttttgtatttttagtagagacggggtttcaccatattggccaggctggtctcaaacttctgacattgtgatccacccgcctcggcctcccaaagtgttgggattacaggtgtgagccactgcgcctggcctcagccctgttttcttacacctgatccatgttggttcctttgagttctgaggcttagaacacaccctctctcaccattggaggggtggtctttgggtcgctgcctggcaaagctagctcttgtccccaaataaatcaacaggtgtacctctctttcccgggggtgtttatgcagcccctgctctggtttagagactgctgggctgtgtagaggttaggagtttttttctcctactgtggcctgtcactgggtcatgaggtccctggctgacgtggggcccacatgtggccatgagagcaagcatccatggtgctttctgacttcctacatgctggaatttccttgcacaaatctgttcacctttcccttttgggagtcctggctgccaagtactgtacactgtgttataaagtatgagcacctttcactcagcagaagctccctctcctgaatctggagatggtaagagcacaggctctgggactggttcttagtccagctgtctcatatcctctcacggcctccactggcccagctgtaaactgggagagatcagaatcccccagggtgtccaggaggattggtaaagtactggcctgggtgtggtgggggtgggtgtgctagactttctttagtagctgagtcttgtgttttaagcaagttcaccttctgaaggtttcctcatttatgatatgaatacactgaatatataaaacagataaaagcagtatgtcattgctacaaattcagttcaaatgtataatgtttacttaaaaagacaatgacagaagagctaggtaggctgtgctaacgtacacagatatttgggactggggtagtaaacagtggtgtcttctaccttgacagcattgcatgcgtttgtttcttgctatggctgtacagtaaggagacagttagatgtctgtatgtgttgacagtgttcagccacttaccttgagctctcaggttctcaggatgtgcttctgttaaagagagatggcagaggcagttccgttctagcacaaggtaatggggtggtcttcagtgggttaccatttgatctgtgacacaaaggtgaatgttgctttctcttacagttctaaaacagtaaacacacacacacacaaaagaaatgagtcaaaattgactagaacccatgaaacacctccctggaaccaaaatagcttgaaagccaacggattcagctcttctcagggctttcccaatattctatgacccccacagctggaatgcctttgtaagctccagctgaggaagggatgttgtgaggagactgatcactggtactaagtcaggtgctcaggtacaggaagtgcctgccaacctgagtcctccttccagggtgctggttctgaccttcagctcctgactcatccaaccccgggggcctggctgtgagttggtgctcagctcacaccacagctttccaaagccacgctgtcttggagggtgatcacacagcttgcctcggagggctgctgtcaggatgggttgcatgagataagtgcctctaaaaggctgagcaccgtgcctgcctggcacacaatgaatgcttaatcaatacagggtagtatcatcatccttgctgtcaccagcacttccccagcttaacgtttcacaaatgctttttttttttgagacggagtcttgctctgttgcccaggctggagtgcagtggtgtgatctcggctcactgcaagctctgcctcccgggtttatgccattctcccgcctcagcctcccgagtagctgggactacaggcacctgccaccatgcctggttaatttttttgtgtttttagtagagaccgagtttcaccgtgttagccaggatggtcttgatctcctgacttcgtgatccgcccgcctcagcctcccaaagtgctgggattacaggtgtgagccaccgcgcccggatttttttttttttttttttttttgagaggaagtcttgacttgttgcccaggctggagtgcagtgacacgatcttggctcactgcaacctctacctcccaggttcaagtgattctcctgcctcagcctcccaagtagctgggattacgggagtctgccaccacacccggctaattttttatatttttaatagagatggggtttcaccatgttggccaggctggtcttgaactcctgacctcaggtgatccacccatctcggcctcccaaagcgctgggattacaagcatgagccaccgcacccggcccacagacacttttgaagcctctggcccttgctgtctgctaattctcatgtcgtcagaattgccactatcatttaatgggctgctttttcaattcaaactcgtgaaaatattacgaataattatctctgcactttgtcctgcctttcctttccatttccctggccaagactaatgtcacttttgaataaaatgaacaaatataattctttgtataaaactaggggaaacccagggatacagaacaggaaggctggtttatatgccaataactcatctgtaaattcatgtaaatgtaattctgtgcattatagctaatgcacctaaagtcaattcttaatgtctaaggatgagcaaatgtgtaactcttcattgtgtagaggggtatagagcttagcttgccatgtcctgggtacatttccagtagtcatttagttagtaccagtgattcccactcaagtgtcccgtaaggaggtaccatgggaaataagagcagcctcttggcattctgggtagggagcctgagccaaactctaaagctgtctttataaagggaggtcatgtgatggccagaaattgcctttgcttcatggtgcacttggtggggagtcaggtgtggggtgctgggtttcacatcatcccattttcttttctgccttcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtaatctgcccactgtttcctcacttccagaggatgggcctgagcgtgtatgggaggcctaggggtgtctcaatcaccctgcctcagactccactctttgcacagccaccccctacttcccactgaatgataaacaccttcatcacccaactagctatttgctacctcttccttcccaagaagcttggggtgcttagaatgggaagtcccaggagaccagcaggtcaaaacagaaggagagaggttcttcccaagcttgggcccataactctcacctgctactcagatggcaggatggatgcattttgcagacaccactgaaccactgaggttggtgggggagttagtaggtcccaaagtgagagaaaaagaggttggtccggcttgagagcttttgctggttgattcactggcatatgaaattcagcagccagggaaggaggttgagtctggagataaacaaggagcagacactttgtagcacaagtagtcagaagagagcccaaactcaggtagattgtggccttgagagaggaaagtggaaggtgctctgagcagggcagcatgcttgaggacaaggtgggcctaagtagtgtctaactctgtggcagtggtgttgtgttgggtgaagtcaagcctgtccccaaggttctgccgggtctagttggctgttggaagtgctagatgtttgtgttttgcaagcacagcatcagtggaggcttgcactgtgtctgtgctaaaggaggttggagcagctatctgtgaacgtgaggatgcttctgcatggtgtgctttgctttggccagtggggagcactgggatgtccttatctcctggggcattcttgcttgtcccaatgcttccgaaagcctgcttagtgggtgcagcactgaaccaggagtcaagagacccagggtttagtcccagcctctcactaggtggcctcgagttctcccattccctctctaagcttgagtttcttcatctctcaaatggggttaagaatagccccctttcccacctcacagggctgttatgaggatcccaggagacaaggtaggtgaaaggagccgcacacttgggagactctatccttgcactttgtaacaatgttgggaaagacatgcttgttgacactctgggttggaccaggcacaacactcctgcaggccttggcggaatcgttgggtgcctgtgctgtgttcatgtgccgaggtccacggtggaaggagattgctgagtagctgggtgttcttggtgtcctggaactgggtccctccttgcagcttcatacctggggtttgtaccaccaggacacctgctgtgaaagcagggaagtagtagtgaaggtctcttaagctgtctgttctgttttctgacatgtcattagagcccattgctgacaggagcttcctccaggttgcaagcggtgggcttgcgcatgcagggagagttatcaggctgtggctgactgtcttgactggggctgccccagccctagaaataatatcgtttcttgtcttgcttcatcctaacctggcttcctgacagctcccccggataactcaaaacctgctgtaacaagctgttagcaggcattttgtcaagttttcaatatggaagttcccagtctgagaactggggtcagagaccagaggttgaaaactgctgagtggagaagggtgctcatgataaaactcagaaagcccagaccagatggtggagtagggcagaaactggacaggagacccagggctacagcccttgaagcccagctcaggaggagagaaaaactgagagcagcagggacagtgggaaagttggcccagtaaggaagcagctgatgtggcaaagccaacaactattgtacatcaggatttattttccaagggctagtaaagagaacttgggcaacagccataagctacatgaccggaatggagaatccagaagagtaaaccagagtctactttttctcagaaaagccaagactgggtctggatcacaggccaaacatctctgggttccagagccagagcgggaagtccctttcctgcaagaagactaaagaaggtgctggtccaacccatgctgggtactcagaaagaagagaaaacaattgcagtttttatcagaagagaaggagcaggattctactcctggactcattccttgggcagaaataggaagagacaaaaaaaaaaaaaaaaaaaaaggaagaggataaagttctttctgagcaccaaaaacattgagacattggaatcaaaatgcagagagctctgtgtcctcctttgccctgctgccaccaagcctgtacctacaggaggggttgcacgaataaacgaatgttcttatctctgcatgtgttcaaacaaaggctgaatgtcagaacagttaagattgaatcaggtgaacttccaggtgccctcagatccttcaatcccaacaattcttaaatagttgacttaagtatctacctatagatctgtctttttcaatttttgccacaaaaatgactcctggctgtgaagaatggcaaagaggaaaggcagcctgactcctgcagcctcacacgtgagtcagatgcaagttgaagagacagatgactctggctttgtcatacagacatatcaggatgtgtatgatactatttgtacaggaagatcatttgcagtggagggagtattatggctagaaaagcttgttcccacatttttgagttgaggaaatcagttgagttgaacagtggaaaagggagaaggccctggctgatcaccatgattttcttcctttaaagtttctgtagcaggatctttgtatatatgcctatgtgctggtatggtgaagaggaacagattatcaggaatccgcctttgacagagacatttgaatgcaaacatcattgcttgaaaggtagaggaagccttctccccagtcagaggtaagcacacaagtggatggatgcagggaacctgctgttcccctggactcacatcaagctatgtaggcccactccaacacagtgcagttgggaatggccccttcagggtttggacaaggagaaagcagtccccaacccctgcattgatgtggaacctgccaaaggatgatttgcttctggagtgccaagtgcaggcacaccaggcaagaaaatgcaactgaggagcagtggccttttgctaataagaccatcgtctctggagtgaaagggccggtggcttgttggttgtagtggcagtcatatgtgtgctcagcatctccattgcgtggatggctggatcaagctgcctctttggatcttggttaatcagtggtgaatgggtgggtaagtttagaattccggctaaatatgtctggcttcaaagacgtattctgctcagaagctcagcttctgtttcatcctaacacttggctgctgagttgctctgtgtttaaattctaggctttaagtggcagctgtggatccactcctaccaccccgccatgtggttttgctatagatagtacagtctgcagctggggtaaagtcaagaggactcagccacgtgtttctaagactgtttttcaggaaaactcagcaagacagtttcgctgttgttgcccagactggagtgcaatggcgcgatctcagctcatcacaacctccacctccttggttcaagcgattctccttcctcagcctccctagttagctgggattacaggcatgcaccaccacgcccggctaattttgtatttttagtagagacagggtttctccatgttggtcaggctggtccggaactcccaacctcaggtgatctgcctgcctcggcctcccaaagtgcatgagccactgcgcccagccaaactcagcaagtttttattgagcatctgctgtgttctcttggtatagctctcccagtaaggagtaaacataataattcctggtgctctcccgctcctttctgtccccttttgattgcagtggacctgctctggttcatcacagggagagagcttcatgctattttagagaccccacaagggattaaaaaactaaggaaaggccgggcacggtggctcacgcctgtaatcccagcactttgggaggccgaggcgggtggatcgcgaagtcaggagatccgagaccatcctggctaacatggtgaaaccccgtctctactaaaaatacaaaaaaaattagccaggtatggtggcgggcgcctgtagtcccagctaccagggaggctgaggcaggagaatggcatgaaccctggaggcggagcttgcagtgagccgagatggtgccactgcactccagcctgagcgagagtgagactctgtctcaaaaaaaaaaaaaaaggaaaaaattaccttctaaagtggtatcatcatattatcagaaagttctaatatcttgtactgattggtgggagccaatgtctcctggttctgctttgttttaggggactctacagtaccaccccaaggggcagggctaacagcctctttcccattagccttgtctcctcactcctgactacagcctccctcttagggatgtctacatgggaccctcttacaccaatctatacccatgatcagcctcaggcagaccactgcggtcatagcacaggacaacttgctctaccaggcagggcaggacaccagcacctggtctagacagatctttgaagtagctgtattgggaaaggaaggaaaattggcccaatcccacatttcccttcagaaccactaactgctgctgtcagaggagaacttgttaaataaagttcccacaggccagccctgtttttccagcagcttccattctaacataccattatggtcgaaaaatacatgagtgtaaatggtaataatgaaacctattgtaaaagtccactggatatttctagggctcagggctaagacacaggaaccaattaacccatttatgctggaggttacaaacttttttgtgaaaaatcagactttaatgatgatcttgagcagtaggatacaaataattcctaaaaggttagcgtcccaataatggaacatgaggcataagtgggttaaagcatctgcccagtagctaagggccaagttctggtggcacatgatcctggggttggagtccaggctctgccactcagtagctgtacgtgtgaccaggttacttaacctcaccaagcctcttttttttttgagacggagtctcgctctgttgcccaggctggagcgcagtggcatgatctcagcttacaggtgcctgctaccacgcccagctaattttttatatttttagtagagacggggtttcactgtgttagccaggatggtctcgatctcctgacctcgtgatctgcccacctcagcctccctaacctcacaaagcctcttatttctttatctgtaaaatgggtataatagtaatctgtagcacaaagggtgttgggcaaattctatagaatagtgcatgcggtgtgctgggccctggtgtgccatcagcacttcctaaaggtgaacctttattacagttccagcagcattcaaaataccatgccaattcagacttttttaaaacaaatctcatgcagacattacacagtactcttcagcctctgaccctttaccctttagcagtggatctcactgttatcctgtgactgtgtaattttgaaagtgaatggaaacacctgatgatgagtcaaccagatctgaagtggattaaagggacactgtcagggtgctggcaccctaagtgggccttatactaaaaagcttcagttcctgctaaaagcaccttctgatccttgactacagtggggtttgatggcatacctccttcctgtgaaacccaagtcaaaatccttttatcggcctgcctgattctgtatccttggacgcatggctgctgtggaagttggcccaagatgtgttcttcccagcctgagatatctcgtggatcagactgaccgaagcatctgggaggtgggctggaacagtcccaagaaggccggattgtcctcccccaaaataaagacagagatcatccgtgtttcttctcctgtacgcgaacctggtggatgctccaaaatcgaaccaaaacactaccatgaataagagatgactgcactcctctgacacaacttcctatttttgtctttgttcttcaaaaggtctaaacagttactaaatcctgttatgctgaaggtggggaagttagaaaaatagaacatctcctgacaggtagaagacgggatccttggaggcgttcctttgggatttcattttacctccatctcgtttgttgtccagtttccttttacgaggattaagcaggcatcctgctggctagaatcctgtggcttccctggagcctcaaattcttgtctaaccacatttctagtcatggttcctgcaggagacatccactcaaaccacctgttactgaggcaccaagcaaccctagaggcagttggcctctggccctagcaggagcaggatctcaggccatcccaccaggcagccagcctcagcccctcaccgcagccttgcagagtgggctctgcagagaagccgatttgtggacagtgccaccctccatcctgagtcacatggctcatgtggttgcagccatttttgagccaggagggggccccttctaggtgcagctgacctgggaatgctagccagagcggccagaggagaggagtgggggaaggagagaggtatctcttgctggccgcgggatctcatctccttttgtcttgtttaggtttctcctctgcctcctacttaaaggtccatgttaaaacccaccacggtgttccccttccccaggtctccaggcaccaggagcccatcctgaatgggggagcagcgttccactgcgccaggacctatggcaacaaaggcaagcgaccccttgctctgcactttgcttctctgcgcagactgtgttgtgggggcgctgggctgggcgtggggaggcgggaaggctgccggctttctggctgccttgaggagactcagagatctgagtggcagtggcctccaggacaaaagtcacagtgggtatctcactccagggcagtgagtgaggctttagggcactgccgagatccagcctccgcctcctcttccccagccctcctcctttcctcctggccagcccccactgtctggagccctgcagggatgccccgggccctgggcagaagaagagccctgcatgatgagtcactatgggcctgtcactgcctgctgccctttaggatggtgtggagctgcggctgaatgctttctcctcttttgacccagtgggccggtgggagccaatgtctggcttctctcacagtaggagtggttggttactgtgagtggccctttctggagagcctctggctatggttgtgagatgcatggcaataatgagctatctgactcctctgacttgggagttggtttgcagaaagctccccaggcccaccttcacttgttgattcaggttgttttgtggtatgtcacgttgtcgttgccttggggatgaggccaggggcttggcagatggtagaaacagcagagatggcatgctccatgctcccatcacagacctcccttcccggcatggctctctggacccaggcaggaagctgctgattggtggaggactccagtgtgggccgggcaaggcagagcagccagggttgtctcttggcccagcttgtctggggcctagggtggggacacccagccgactgagtagtacagagttgctttcaatctctgtgcttgggctgcttggccctgaaaaggttttggcagaaggaaggcggtaaggacagggctatgtttgcagcattaggaaaaggattggcttctgtctgagccattgatggggtctacccaggttgaggacctaatggctctggttctgcctgtcttgctagggtgcagctagtctggtgcaggaggcgaggctactattacactggctcggcatcatcagaataccaattttaccctcagaggcacccaaaagagcgcctaggagttgggggtctttgagttgttctgggcagctgtagcagagttgccctctctgtatcccttccttgaagcaggctgagatgacggtgagcagtacatgtgcagctgcatgaagagtccacagcaagggaggctggcagccctagggccctgccgtttcacccctgtaggcactccaggctcccagactgaccagctgaccctccgtgggttctgccagggcagtggctggccaatggctgccctccacaggtctgtgagctggcccctcatgacccctccaggagggggcatctccagagcctggcctcatcgctctcctatattttgttttttcgtagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgctcccttgagtccagtttttcagctgtgggggtctttgggacccagaggtgggcagtccataccccagcacctggggtgggagtgggatcccaggagaccccttttccacttcattgcaccagttccactgggattgacaggtagatggtcccactgaagacttagaatgccagaattcacccatgtgttcaacaaatatccactgcttgtcttcactgcttgtgtgccaggcatggtttcatgctcttgagatatggtggtgaacaagacaccactgtgaggcttaatgggatagacagacaacttaaatatgagttcagataatgagaaatacaaggagaagaactgggcaaggtgaggggacagtgacagcaggagggtgagtagggtggaccagggaggtgtgaagtggggttggggctctgggagggaaggcttatagaggggatctgacacagcctacccagctagcacctgaggagggatgtgggcagggactcctcatggccaaggggctctaagaagctcagcaacttgtctcccccaccatgttatctacctgatgttaagtaaaaggttggtgcaccgttaatggtgaatgtatgaagaaaagagggaaagaacaacaaacaggaggcaagaagtaagcacgatggagaattaataggaataagaatgaggaacaagaagggacaggcagacttaaggcaccctgggcatcttgagaaatctcagggaagagggaaacccctaaaaggatagagacagcatttaacctccaagcaagaagaaaacaaaacaatggtaaaggagagaaaaacagacctaggggaacaaacagcacaaaaatttttagacccacattggtatcagaattacattattttttgtttttttgagacggagttt

SEQ ID NO: 16760 - DNA, 22712 bp, Human; identical to SEQ ID NO: 16759

SEQ ID NO: 16761 - DNA, 22712 bp, Human; identical to SEQ ID NO: 16759

SEQ ID NO: 16762 - DNA, 22712 bp, Human; identical to SEQ ID NO: 16759

SEQ ID NO: 16763 - DNA, 28366 bp, Human
agacacagggtttcaccatgttggccaggctggtcttgaactcccgcctcagcctcccaaaatgctgggattacaggtgtgagccacggcgcctggactgtcttttttttctttttagagatgagtctcgctctgtcgctcaggctgaagtgcagtggtgcaatcaaaactcactgcagtctcaaactcctgggctcaggccatcctcccaccttggcctcttgagtagctaggacaacaggtgtgctccaccatgcccagctaattaaaaaaaaatttcaagccgggcgcagtggctcatgcctgtaatcccagcatcttggaaggctcaggcgggtggatcacctgaggtcaggagttcaaggctggccaacatggtgaaaccctgtctctactaaaaatacaaaaaattagccaggcgtggtggcacacacctgtaattccagctacttgggaagctgaggcaggagaattgcttgaacccaggaggtggaagttgcagtgagccgagatcgtgacactgcactccagcctgggcaacagagtgagactctgtctcaaaacaaaaaaaattataaaaaaatttctagagaagcgggatcttgctatgttgcccaggctggcctcaactcctggactcaagggatcctctcatcttggtctcctgaagtgctaggattacaggcatgagccacagtgcctatagatcaaggttgaggcttagaagtgaagggagcccagaggaacctggctagagtttggtcaaggagagtctttgtcaccatactacagaaaattaagcagctgttaaacagaatgaggccggtctgggcatggtggctcacgcctgtaattccagcactttgggaggccgaagcgagtggatcacttgaggccagaagttcgagaccagtgtgggcaacatggtgaaaccctgtctccactaaaaatacaaaaattagctgagcatggtggcgcctgcctgtagtcccagctagttgggaggctgaggcaggagaatcgcttgaaccggggaggcagaagttgcagtgagccgagattgagccactgcactccatcctgggggacagagtgagactccctctcaacaaataaataaacaaataaaagcagtgtgttagggtgcgagaacccgggtcggggacgcgggtgagccgcgcggtaatcgccctgtcctgccaccagctggaggacaggggctcctcagagcctcaggcccagagaacgggccccacgaccgggaagcgaatactccacagggcacagtctcccaatgcaaaatgggcacctggacccaatcatttctgaacttctagttttttctccctatggctatgaaaagggtcattttttttcataggactttaaaagaaggcttaagaaaagcacgcaggcctggccgggtagctcacgccagtaatcccagtgctttgggacgtcaaggcaggcgggtcgcttgagagtagagtttcgagacctgggcaagatggtgagactccgtctttatgaaatattttaagaaaatcacgtacacctgtggtccccgctacaagggaggctgaggcggaaggattgcttgagcccaagaggttgaggctacagtaagccgtgatccagccactgcactccatccccggcaacacaacgagaccatgcgtcaggaaaaaaaaaaaaaaaccaagaaaataaaaaagaaaccacctaaaggcgtcctccgcgcgcccgcccctccgccatctttgcgtccgccccgtcctgcgccgccacttccttcccagccagaagtttcgcgccaaattgttccgcacacaaaatggagcccggaaggaggcgaggtcatgcactttgcagccaatcatcttcggcagacagtccgggcggcggggctggagggctcagaacggtccaatcgctggccgcgaggctccggcgaaccaatgggagcgcagcggctgcggcgtccgaacaccgcctcttgtttttcccgcgaaactcggcggctgagcgtggaggttcttgtctcccctggtttgtgaagtgcggaaaaccagaggtgaggctagtgggagtgggactgggactgggagccagcaggcatctggatttccgggtgtagttggagtgggacaggagtttctcgggaactggggttggagtccgggagcgcggccgggggtccccctgctccggactcagggcagggacccaggcgtcggaggggaggaggtgccaggcgctgcccccagcctgttctggccgtttgttcccaccccaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacaggtgcggctcctgcggggccgggggctcgagttccagtgtggccgctcacacgcctctaccagcctgctagagtcctggacagtcagggcacagatgggcccagacgggggaaagagccggtcctgggtcacagggctcatcccggcagcctcacgccttggtataaggctttgtgtattttgttttactttattttattttattttattattaacgtatttgtttattattttgagacggagtctcgctctgtcgccaggctggagtgcagtggcacgatctcggctcactgcaacctccgcttcccgggttcaagcgattcttgtgcctcagcctcccgagtaggtgggactacccccgccatcaccacgcccggataattttttgtaattttagtagagatggggtttcgccatgttcgccaggctgctctcgaactcctgacctcaagtgatccacccgcctcagtctcccaaagtgctgggattacaggcgtgagccaccgtgcccggcctgctttgtgtattttatctgtacctggagttaacttctgggtgagtcacctgttgagtgggccaccagcaaccagctagcgccacttggaccgtttagttctttatccagatcttgttcctgttcatctgcttcctatcatccttccatgtcatgtctgagaccttacaaactcaagttccctgtaggtgtaaaaggtgaagatggcagttaggattcacttcacttcgctcattcatttatttataccagtcttgcaccttcattgattgagcacctgctgcctgccagatactgttctgggtgctgggctgcagcactgaagctggacctggctcctgcttctaggtgattgtacgacctgtgacatcatgagaattctcataggcccggcctctatccctgaaatgttaaaatgcagagaacatgaggttgcaggttcagcactggcccattattagctgagtgacttccaggtgtcagtgtctctgggcctcaccaggccagaaatgggtaaagccattcctgctttcacttactcatgcagcagctgatattgcccacctgtgtgccaggcactgcgctacaaagatgaaaagacgtgcttcttgtcctagagaagctcctaagtcagaggagtgagtcgtgaagaccaacagataacttccacggtggtcatttcctccacagaggaaggtgaaaggacttagggaagttttccggggggctgaagtttgaggggacctttgagctaaggtcagagttgcaggtgtagaaagctttctgtctaggtaggagcaattgcttgtgtagaggtgtggggtgtcctcacagcaagtggctttcagtagcagtctggccattttactggctcctggacataagggagacggggctcaggcctgtgatactgcgaggctggggaacagcctgtgcgttggtcagtggtccccaaatatgttcttgccacagcagtcacatgggatgctctgctaagcatctgggctggacgcagtggctcatgcttgtaattccgacgctttgggaggctgatgccaatggatcatttgaccccaggagttcaagacctggctgggcaacatagtgaaacccaggctctatttaaaaaaaaacagtctgactagaggttgataaggcagatgtgttttctgctgccttggtgcctccagtttttttgttgttttgttttttgtttttttttttttgagatggagtctcgctctgtcacccaggtttgagtacagtggcgtgatcttggctcactgcaactgctgcctgccgggttcaagtgattctcctgcctcagtcccccaagtagctaggattacaggcatccgccaccacacccggctaggtttttttttttgtatttttagtagagatggggtttctccatgttggtgaggctggtacctttttggtttttttttttgagacagagtctcagtctgtcgcccaggctggagtgccctggcgagatctctggtcactgcagcctccacctctggggttcaggcattctcatgcctcagtagctgggactacaggcgtatgctaccatgcccggctaatcttcgtatttttagtagagactgggtgttgccatgtggcccaggctggtgttgaactcctggcctcaagtaatccaccctcctcagcttcctaaagtgttgggattacaggcatgagccacctcactgggccccaagtttgagctgtgtgcattgttcttttccaagagaagttaaaggctctgcggagtccttcagtgacagaactggtttgttgttttgtgcacgctggcctgggtgttgaaacatcctttgactgtcttgtggaccccttccatggagctttctttagggcatgcctgtgccagcagtgagtagcctctgcagggttaaataatggaatgatctggaattagatgtgtgtttgggaagaggaatggtgaggtcatggtggctgtggtgtgggcagattcaggggtgcaggcacacctcagccagtgttggtttcctcttctttgcacccttcctgccccaccctgctatgtgcccactccagggatgaactcaagcggcattacaacctgggggagtactggattgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagaccctggctctccaaaaaacaaaacaaaaaaaaaaacaaaaaaaacaaagctaggtatgctggcatatgcctatagtccaggctacttggaaggctgaagtgggaggatcaaggggcctaggaatttgaggttacagtgagctctgattgtgcctctcagcactttagcctgggtgacagagcaagaccctgtctctaaaaataaaaaataaattacagacatgacactttatcccgaaaaaaaaaagttttcttacatagtctcattagcacctcaactgaaacatcaaagatctcttagtatcattgaatatacagtctagattcagattgaccaaattacctcacatgactcttacagctcgtgtgtctcagccaggaccaggcattgtactggattgttgtttaaatctcttttaatccaggacagcttcctttactctgggtgtaagttctttcacagatacattattgatttgctaaagaagcaggagccattatcctgtagaatgtgctgccttttagatttatctgaaggcctccttggggtggttacaacataccccttcccccccgtgatttttggaagctggaagttagatgcaaaggcctgactgtgtttcgatttcacataccgggcaagaacgcttatgggtggtattggatccctcattgcatccctccatccactatgctgagactgaccaggtgctaggttgaggtggtgatggtcactttattgtaatgatgcaggcatggagtcttgaattccgcctccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattatggataattcaaacattagaatataaagagaatcgtataacgaatcctcttgtactcatcacccagcttaataattagcaactagaggccaatttttttttttttttttttttgagatggagtttttgctcttgttgcccaggctggagtgcagtggcacgatctcagctcactgcaacttccgcctcatgggttcaagtgattctcctgcctcagccccccaagtggttggaattacaggcacacaccaccacgcccggctaatttttagtagagatggggtttcaccatgttggccaggctggtctcgaactcctgacctcaggtgatccatagatgccaaatcttgtttcatctgtggccctggagttcttttgaaacaagtcccatacatcatataatttgatctggaactatttctccatgtatctctaaaagatgaatctctttttttttgagacggagtttgactctgtcgcccaggatggagtgcagtggcatgatctcagctcactgtaacccctgcttccccggttcaagcaattctccggcctcagcctcccgagtagctgggattacaggcatatgccatcacacctggctaatttttgtatttttagtagagacggggattcaccatgttggccaggctggtctcgaactcccgatctcaagtgatccgtccgcctcggccttccaaagtgtcggtattacaggcgtgatccactgcacccagcctttgaagagtcatttttaaaggcatagctacaataacatcacacttaaaaattaacattacggccgggcgcggtggctcatgcctgtaatcccagcattttgggaggccgaggccagtgaattgcctgaggtcaagagttcgagaccagcctggccaacatagtgaaaccccgtctctactaaaaatacaaaaagttagctggacatggtggcagttacctgtaatcccagctacttgggaggctgaggcaggagaatcgcttgaacccgggaggcggaggttgcagtaagccgagatcctgccattgcactccagccttggcgacacagcaagactctgtctcaaaaaaaaaaaaagaaaaaagaaaaaatattactgccttattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcgtcctggctccccttaaccaacaagcttcccgatggctctattacagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacgtgagtctgtggcccagagggactgtgggaggtgacctgagtgaagatcagaaaggatgagaacaagtagcaagcactgcctgcagctgcttctagagatccactgggatgggctgggcaggggtgtgcccttaggattggcacagatctgatgccctgtggctctgagacaccatgaacagggtccctctacattggtgacttctgtctcaccaggatacccagacagcgttgtagggaacccagggttgggagggaaaagcagtccagggtaatgagtctacttggaatcttctgaagcaaactatggtttgctcactaggccagatctagcctgctgaccctatggcccaggaacacgttcgttcatttaagtattgcccacagctggtttcgcactacaaaggcagggtatgtggcctcttggctggcagaacctggaatgcacatcctccggccctttctagaaaatgtttgctgcccccagtctgaaggaaccccaccctcttcactggctgctctttcttggctccttcgctggtgcctcctcagcttcccatccacctgtggcacagctgcctcattccatgctgttgacatctctcacttggagaggcacgctacctcctccctgatcccccgcgtccaccctccaccccctcagtctgttttccacccagcagccaggtgtcccttgacactcaggtggtccagtcatttacttcttagtcaagtcctgcacagcccaccacgatctgctcctggcttccccaggcctcgctgcccctcctctctccaggcccggcctcactgcctccttcctgtttctggaatacactgactacccccagtctcactgcctttgaccttgctgtttcctctactgggagtgctgttcctcaagctaccatagtctgtgtcctcacttcttcaggcttctcttcacatgtccccttaccaggggcatcttgcccaacccttcatcttcagtttggtgtgcatgtacctcgtctctcccacacctgcctacttttttacttttcttcacagcatgtagctgtcactctttaatatgattgtttgcttgtatgtcttttcagcctcccttgataggaacttaggctccacaagagcagggacctttttgttcagtgctgtgccccctgcacctggaatagtgtcagacacatagtaggttttgctatgatgtttacttctttatgttgctataatatctattgaataatgacataattacctagggatacgtagaggcttagaccctcagaatggtctagaactgcctagaatcccactggaaaagatcttgggatttgagtggggctttagtaagagaattgatgaactagctcttcacccatgaggacaccatgatcctgcaagaagaccgagtgtgacctgtctgcctcctctcagcaagttaatggaaggacccagcctcaagcagttcccttgactcttaatccagtgctaggtccgtcagtgttgccttcctttcttacctccaggcagcgttgcctgcctggcttatctccagcttattctggagacccccataaattgccgctggcaacgtctccttgctggctcctgggatgaatgagccctgcctttggattctccaggtagctttggtgactcttttcccttaccttgtacagagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtgaggcagacgggctgggaggtgggcatctacgacggtggatgtcccagctgtggccctaacccgagtgttgggagtgggtcatctggagcagggtgagtagggtggagaaggtggccagttgcagagcacctgctctgtgcctaatgcttccataagttcctctcatctcgtctttccataatctgcaggggcatgtcagccccattttgcagatgaggaaatgtaacttggagagattaaatgacttcctgtgtggaggagagccgggctttcagcctatgtgcattgctttccaaagtctgtgttcttcttaggataagaggcccaggatgcacagctagataaccaatagctggcaaagcctcttcccagcctgacaccccacctcctaccccaggctttcttttttttttgagacggagtctggctctgtagcccaggctggagtgcagtggcgcgatctcggctcactgcaagctccacctcctgggttaatgccattctccggcctcagcctcccgagtagctgggactacaggcgccctccaccatgcccagctaattttttgtattttttagtagagatgaggtttcaccttgttagccaggatggtctcgatctcctgacctcatgatccgcccgccttggcctcccagagtgcggggattacaggcgtgagctactgcgcccagcgtaccccaggctttctgttaagatcctgctgaacagccacggtggctcatgcctgtaatcccagcacttggagcggctgagacaggaggattgcttgaggccaggagttcaagaccagcctgggcaacatactgagaccctgtatctaaaaaaaaaaaatttattagctgggtgttggggcagacacctataatcccagctacttgggaggctgaggtgggagaatcacttgaccccagaaggttgaggttgcagtgagctgtgattacaccactccactctagcctgggtgacagagcgagaccctgtctcaaaaaggaaaacaaaaaagattctactgagggggagagggtactgagcttgggcccctcatagtaacctgggtggaaggttttgagatctttgattagggttctaacctgggcttgcatatcctgaaattgcatgcagatgttctgaggagagcggatctgtagcttctgttaacttcattagtggcaacagagtatgtaggggtcaggctcttgctccctgggcaagttatgtgactttgtcaagcttcagtttcctcatcagtaaaatggggataaggacagtccttaatctctcagagggctgcttgaaaatgcatgtggtgtttagcacaattccttcatgcagattacgtaatcaggatgtatgattttccaagcagttcatgaatcctgaaaacttacgaagtgggtatgggaagaggggagttggaggctcatggagtgacggtgatggtcttttctggagctgtgatgcctgatggtataaagcacttctatgtctgctgcctcacctgactccacaacatgagaggcaggccacttcgtcatccccctaggctcagaggtgcaatgacttcgttgaggtcacacagcgactaagtgtccctccacaccaccctgtctctgactgggggacttggagacttccctgtttcaacatctcattttgaaaacaggaaatgaaaacccagaggcaaaatgagctcacagagccatgaagaggcaaaaagggcgagtggcccctcaaggaggctggggggcgtgaagaggaagtcttgccctgagaggctaaagggcaccacacagcgagctgacagcagacacgtggagatggggcttttggagggctctgtgggctggcactaagcctcctaaaccagcgtacaaatgagttagcgagttcagcgagagtcaggccaccacctgcctttctgtttggctgtcactgtgggcaacaccatcctccaagcagctgagcatgggctgagtgacgtggggagagaggccgttctctgggctccgtggggctggagccagctcagcatgtggtgcctgtggcaaaaatgctgcagtggaccctgcgtgtcctgggcatgggtggaatcagagacttgctgtccaagtcagaatctcagcttttctcctttctcctctaccctcctctcaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggtgagttggctttggggtcctggcttagccctgctaaaaggctgtgcttgcatacttctggtaacaggcagctcgttacttcatgaggtagcccaggatgtccttgtgttgctcatatcattagaacgttcatttttatattaagtgatccctggaacttccacacattggtcctagctgtggctcctgggctgagggtgtttgcctaagtgcaggattaaggcagaaggactgaggtcaaatcactggggaattactgaaagccaagtcttcacttctgtgacaggaaatacaagagaagtgaaacgcagggttccaggcaggcagccgcctagtgtctagttggagaaataagaaaactgtgagaccgctggggacatgtgggtaaagtggtggctgttgtgggtcacgcagttccaaggaggtgctaaaggaggtctgagaaggaggaggtcggggctgggccttggggaaggttttctgggaggaggttaatctgagctgggctttgaagagtggtggatgtggaagaacttccaggcgggaggggatggcaggagcaggtgaagaccccggcctgggcaaggtactgagtggctggagggccgagtgggagtctaggggatgaggggccaggtggtgtaagaggccttgagtgccgagatggggagctcctgcttacacctgagggcagcaggggccactgagggttttcaggtttgtttcagccctctggctgcagtgaattgattcagaggggtggcttccccagggctcagtccatggcccaccccacatttacacaaactacctagattattacaactttaaaaccactgacaggtaagtagctctcacatttccatttctagcctgggcttctccccacgttccagactttaataaccaactgctgatttgacatgttcacttacatatctgaaaggcatctcgaactttacatggctgaagctaagctcccctttccccaccctcagactggctcctctcagtcttcccatcttcaccctttcagttgctcagacaaaaacccccaagtcacccttggtgctcttttctctcatcccccacatctaatcactcaggaactctggccagctccacctttaaaacgtgtccaggatctgaccacttctcatcctccccacctgctctgagcccttgtcagccctccctggatcaccgttgatcctccccagtgttcgtctccaccttgccctaccttctctgttctgcagcagccagtgagcgatgctgtcatgaccaagacactatatcactcctcggctgaaaggggagaccttccagtggtttccaaggtcctatgccatctggccctctgtttgctcagaacccttctccccacttcccctcaccctttggaccctggaacacaccaggcccattcctgagggcttgagagctgggatctctgtttactcagataggttgtgctgtcctggccctaagggccctaagggctctgccttctgggaggtccctgagctggtgccaggatgggcagtgggctggaagagctcccttgtactcactcatgcgcctgctttgcctaccaaggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggtaggggcttgagttcccttgggtttggggaggcggctgatgatggggctcacagtaggataattactggataatcaggactgggcactcttttttgtatttcctgggcccctcagtctgccaggcacctttgccagcccccaagcttgccatcagctggctagtggctgatctgcgcacctgtctcagcgatgccctgaccctggcaagggggagactgggggcctggcaagtgcagtgggagagcactgagcttagggtcgtgtaggtaccaggacttaaatctcagcactgagcttggggtcagtagcagggatattattagcagctgccatttactgtgttcttcctatgcacagccattctttgttttttttttttgagacagtctcactctgttgcccaggctggagtgcagtggtgtgatctcggctcactgcaagctccgcctcttgggttcacaccattctcctgcctcagcctcccgagtagctgggactacaggcgcctgccaccatgcccagctaattttttttgtatttttagtagagacagggtttcaccgtgttagccaggatggtctcgatctcctgacctcgtgatccgcccgcctcggcctcccaaagtgctgggattacaggcgtgagccaccgcacccggccgcacaggcattcttctaagtgctttatgtgtctgaagcccagtcattcctcacagtaacctgttaacgcagctgttgtgcccattttatagatgagggaattgaggcatagagagttaaagggacttgctccccagcacatgcaggggagccaggagcctgctgtcatggtgcttgttctgccgcaccgtgcacagcccacaggcagctctctgtccttttctttcaagctgggaggaacgttgctcagatgctgggtgtacccgagcacagccataagagccatttcctttaaccctcctcttctgggaggcaagctctgtcctcattgctaggcaagacctaccatggtttgggaactacagagctgggtaggaacatgggtctcaggccacagccactaccttcttaccaactctgaggcccatgatagttgggggagtcaactgccagcccaccaatctggtgactggatgtcacatgcgatgccctcatggattctcaccttgtccatctacccttcgtcccccaggctccctgatggacttactcgccgaggagacatcaacctgctgatgctaggggaccctgggacagccaagtcccagcttctgaagtttgtggagaagtgttctcccattggggtgagtggcctgggatacctttgccaccttggcttgcagggaggaaggctgcagggcagggcctctgggtccccaggacacctgtggtgggctggctcacccggaatctcttcctcctttctcttggctgcggtcaggatggccgaggagatgggaggaagaagggagccaacaggtgtatgtaggtttggggcagggggcgagtacactgtactgagagtcaggatggggtttgggtctcaccctggccagaaattggctgtgggctttgagtaagtcacccaatctccctgagcgtcagtttatccatttgctaaataatgatattgttatcattaatagctaaaatctggctgggcatggtggttcatccctgtaataccagcgctttgggaggccgaggtgggcggattgcttgagctcaggagtttgagaccagcctggacaacatggtgaaaccctgtctttaccaaaaatacaaaataactagccaggcgtgatatgcacctgtggtcccagctgcttgggaggctgaggtgggaggatcacttaagcccagaacggggaggttgcagtgagccaagattgtgccactgcactccagcctgggtgacagagtgagaccatgtttcaaataataataataaataataataataataataatagctaaaatgaagggccagacactgcttgaagtactttgcatatatttacttagtcttcacctcaactgtgtggcaggtactattacccctgtgttaggggtgagaaaactcaggtacagaatgggtaagtgtcttggcccaggtctcactgctggtaagcattagagcaggatgtgattgaacccaagtgtctgatgagctgggtcctctgctgcgttgttgaatgggtctgcggggatcagagccagagaaggtctgacatgatccgagtggcggggttgtatagggcgagatggtggtctttggatagataggaagtgtgccaaatttgccacactggcactgtccagtagaaatagtgaactgcacatgcgacccatgtatgtcttctcagattgtctaacagccacattaaaaagtagctgggtgcggttgtgtgcatacctgtagtcccagctacttgggaggctgaggtgggaggatcacttgagcccaggagtttgagaccagcttgggcaacatagcaagaccccgtttcaatttaaaaggaagaaggggaaagaaaaaaggaaaaacaggtgaagttacttctgtttaactcgctatatctaaaatctcatttcaacatgttgtttgatatgtagattattgagatactttacattcttaggagctctgagtctttgaaatcgtgcgtattttgcacgattaaggacatctcagttaggactttcccaatttcaggggctctatggcagtatgtggcgtgtaggtctatatagagacgacaagggactcacgatgggggcaggctttccctgggagtcaggagtcctcatcctagccctgaggctaactcctcttctctgggcctcagtttgctcatctgtgagttgggcctcacaagactgtgtcacagggctgtggtgaggcttaggtgagccatggatgtgatgccctcagcggggagaacatctgggcacaccgaggcccagggcagcatccccttccagagggagacgcactgagttggagccttgagtcctattctgtaccctgcagccagctttgatgtgtgaccttgggcaaatcacaacctcagtgggtctttttgtcttatgggggtcaaagcatggagttgttattgggccctgacaccaccccactgccccaggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaaggtgagtctgatgaggtgggtagtagccaaaaggtgggtggcaccagggtatgtgacttcctgtgctcagccagcagaaatcacctctgacttgggagacatgttttcaatccctgggccggtcactctagtaactgtgggaagctgcttaacctcttcaagcctcagttcccatatctgaagagtggggagaagaaaggcaagcccacacagttgttcccatgattagaggtgacctggttgctgccattggccttgcgtggagctggtattcaggagtgagggctgctgttagttttcctgtttctactgctccctgctccctcacttcagtaggtctgatgatatttctctcttccccacttagatgcgagaagatgaccgtgtggcaatccacgaagccatggagcagcagaccatctctatcgccaaggtgagtggccctccatggagagcccagcctgcagcagcccagcgtggcccaaccgtcctcaggctgccctgattgggaccaagttctctttgcccaggcctagaatctgtgtgtgtgtgtgtgtgtgtgtgtgtgtgtgtgtgtgtgtgtgtgtgtgtgtgtgttgtaaacgtgtatataagaaggcatctttgccatctcctcccccttttcgtcgtctgtcgcctgttaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtggtacgtccaggggcagggctggtggccatgggacctgcctccaggcaggcttgtgattgtgtgggaaggagaatggagaacaagggccttggctggcaaagtcctgactgtcaggctgtgaaattggggagcacgtgagagggcggttgttgtggactgcagaggattgaagcagggtctggagtcctgtggcctgctctgcctctgccgtgagtgataagctgtgtgatttgggctaaatcagtttctccctgggcctcagtcccttatatatgaaacagaggagttgacattgggttatgagtaatagaacctcagttctggttagtaaatttttcaaagaaaaaaacatagtggtttatagaattggtaagtccggcggcttaaggcccaggtagatctggattctcaaacaactgtctctgcctttctgttctgcttcccttggtggaatctttgtacttgggcagctgttcctcttgtggtggcaaagacaaaataagattttgtcctgttagcttgtagcttaacagcccccaggaaagaggaggccccgtcttttccagtacttctatcaaaagtcccaggatagactcctattggcttgggtagatcctatgtccatgcccaagttggggtggacaagatacatgccccaagtcggggtggacaagctgaacccacccctttatggaccagggcagaggagcaaggagcattaagttctctctaaaggagaatccagatgctcccatcagaacgagggcctggtgctgagcaaacaggctgagcacgcctgagatctcagcaccctttccggctccttgatgccagggccccatcagctctttctggctgttccacctcagtgctgggactcaggcttgggacggcctgtgggatgacccattatcccctctgctctccagatgctggccaagcatgtcatcactctgcacgtgagcgcactgacacagacacaggctgtggagggcgagattgacctggccaagctgaagaagtttattgcctactgccgagtgtgagtcctggacgcaggcccacgggggtgaggttgcccagcttccctgggtgggagagaacccagtcccctggtcctgctcctcctcatgaagaacagcccagatgttgctgttctgaggttctcagctctactgaatctgctctgctcccttctaaccttgcgtagctcactggctcttggcttcagttttcccacctccacaccaaggaggtgggatttagatggtcttgaagacctcctcgagtctgacatgcagggaggcagtgaagtgtagacatggtagacatgggctctgggtcatacctgccttcactctatgactttgggcaagttggttggcctctctgagccttgatttccccaggcctatcgatgtttgctaggatttttgtaaggattgcacaagatgatgagtaagtgcttggcatagccctgccctgggtaaatactcagtgagtcgcagctgcaatttgattgttctcacagattttcaataataataattatatacatagtactggctggttgcagtggctcacgctgtaatcccagcactttgggaggcggaggcaggtggatcacttgaggtcaggagtgcgagaccagcctggccaacgtggcgaaaccccatgtctactaaaaatacaaaaattagccgggtgtggtggtgcacacctatagtcccagctactcaggaggctgaggcaggagaattgcttgaacccaggaggcagagattgcagtgagctgagatcgtgccattgcacttcagcctgggcaacagagtgagactctgtctcaaaaaaaaaaaatatatatatatgtgtacacacacacacacacacacacactcactcttacacactactttctttgtgccaggcattctgaattactattcagtattttctatatgaataaattataaccctcccccaaaacctaccaggtaaggtgtgctattattcccttccctttatggatggggaagctgaggcaaaggaagttaagtaacttgcccaaggtcacatgccagaggtagtggagccaggatgtgaacccagctgcttgcctccagaggctgtgctcttaaccacagtgcttcgattcttgtcgtacagcgctttggtgatcttttgaaggagctaaaacccaggggttgagggctctttgaatgcactaccagtggggggctggtgggtccctgattcagcacctctgccagggtgagtgggtagtccctgggtcttcatccaagtctgagctctgtgtggcccagtcttgagaggcttgggcccacagctgtgagtcagggagccctggattctaatcttccctctgcactaagtccccaggtagccttggggagttccctccctccctctgggtctcagtctccacatccttaggatggttgagctaaggctttccctacatcagtgactgtcagttggcctgggggctagaggggaggggatgggatagggtagatgctgatcagacttccccacacctaccgtcccaggagagtctgaggtgctcccagcccctggactgcagtcaccgccaagcctcctgtgggtgtcatcagcttgtcgtgtcttcagatgtgttgggtggaggagtttgagactgctgcaaagcccaccacccagtgggcctccatgccgctgtgattgtgccattgttcattacatgtatgggggaccttgtggcaagacaccacacagcgtctaacagtggggaagaggcggttttcaccctgcagacgtgcctggcttttcttcacctgttttttaagagaggcacccatatttctccccagtgttgatgtttgtggcagctgcccacagccagatttcacttaaatcttttccgattgttgtcccccagcccatatgagtgggcagctgtggtgtggtgggaaagtgcatgtctgtaagctggcagggggctgggggaaagggtaggtgccctaagagtccctcctggcctcacaccagcctctccccactgtcctgcaggaagtgtggcccccggctgtcagcagaggctgcagagaaactgaagaaccgctacatcatcatgcggagcggggcccgtcagcacgagagggacagtgaccgccgctccagcatccccatcactgtgcggtgagcaggcgggcagggctgggccatggcagatggggcttgctttacacagcagggtgtgcttggcaaccaggggcagtggtccaggcttttcacttggcacaggcccatagtagctctgggcaggaagagtccctttggagcataaactatggcctccttgatctcaatgatgatccatgtttcttgatttaaggccgggcaaacctagacccctcttgtctgaatttggcctggcttctcccattgtaggaagcccgaagggagggaaggacccaggcctgggagtcaagagtcttgggtcccagcctctagcccactgtgtgactgtagggaaattacattccttctctggccctcagtgcttttagctcctaactctgttcattcttgtgactttgtagacaatacagtgggtaagagttgggatttacctggtttgaatcctgtctccagcactgactggttggaaatggatttggctataagtaatggtaaatccagataaagtagcttaaagaaataggaagttcatttctcttttctgtagcactgtctggaggaagatggtatggggactggtgtgaggactcctcaagctcccccttactcttagtccgagatggccgctagaacttcagccatcacctccaggcagcaggacaggaaggaaagagagcttcccttttaaaggacacttcatgaagtcccacacaatgcttggacttacaacttactgccatagattggtcacacaaatacaacctggtacaaaagatgtctgggatgtgttttagtggatcgctgtgtgccagactaaaaactggggttccaagctaggtgcagtggcctacattgtgatcctagcactttgggaggctgaggcaggaggattacttgaggccaggagtttgagaccagcctgggcaacatagcaagactcccatttctacaaaaaataaaaaattagccaggcattgtggtgcatgcctgtagacccagctcctcaggtggctgaggtggaaggatcactggagcccaggagttcgaggctgcagtgagctatgatcatgccactacattccagcctggtccacagagcgagactttgtctcaaaaaaaaaaaaaaaaaaaaaaaattgcagttctatgactaagatcaaaagggagatggattatggggacacctagcagtctccaccacagtcttaccactttgggcaagcacctccctggtaacgggctggctggggaggaagggaatagcggaccgaggctaccctgagcacgctgttgcccccacaggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggtgagcagatgcaggggccatggtctcaattgatctgggttccctggctcggagctctgtgggcagggctctggcctgctgggggcctgcagtgtgtgtcttgcttctctgagtttgctgagcttctctgagtttctttttgccataagacccctctcctcctttctccccaccgctgtttcctccaagatgggaagaagcagcttctctccagacccttgaacacaatcctcttgacccaggtcattgatgataacccttctcactggctaggaacaacagttgatgctctgcttcctagagcttgtcagcattttcagtgcttccagagttatttcttgcattttgccttacagctgccccctggaagccaggtgagcagtcagtcctgcccatgttagaaatgagacagctgacactcgaaggggcctttccctggtgcccaagatcacagtcgcttggctggaatgcaagtctcctggcccctaggccagcgttttccacaccataagccatactgtctggtttcggtcagcctttcaacagactgtcccaggcaccgatcatgagccaggctacctacgctggggaaaatctgttccttcacccagcagatacttcattagtgttactgtttgccaggcactgttctaggtgctgggagtataagagcaatcaatcacagggtcccggccctcctgggttctcattctcgttctagttggggagagatagacagtagagaaacaaatgcaggtagtgtaggtagtgaaaaaggcagtgagggagatgatggcagggccaggtgtgttggaaaaggaggacgtgctctttcccatggagtgagtgggcatggcctctgcaaggaggtgatgccaagcagggagctgcatgaaggggacagtgtggctccttgggggaagagctgctcaggtggaggcagcgctaagtgtcagtttccccaggagggagcaggtttggtgcatttgaatggggaggcacttgggtgaggaatggggtgggtggggcctgttcctcctgtcccccttggtgaagactcagcctctaccctggagacacttgctgtcacatgagacattgcaggtggaggcctctgggatgctgcaggcacagagggcaggggtgatatggagtggtgataatttgagttgggtcttatgggctatgtaggagtttgcctcacagactcccctctcaatgacttcttgaccatgagcccaccatctccttagctgaaacaccaaggcctctgtggcagtaattggaagtcacgagcctcctggttgccgagggctcctcagggcacctcgtagatgtgtccagggcaggctggcttccctcctgggtcactgatgggccccttccaactctctctctaatctatctgctccagcaacaaaaggagtcctgctgtggcctccaagggcccgcaggacttggtccctagtgacactctggccatgtctctgctgcgctgggccccgggctgctttttgaatgagacaggtgtgttcctgcctctgtgactttgtgcttggcctggagtgtccccacatgtgccatatcctgtctcctcaatcaggcctgcaccaccctggcacactcggtgcccttttctgacttactcttcggggcctggctcaggctgttcttccttgggctagaggctgtctctgtccaagaactcccattgtcccagctccccggctgcctcacttctccatgcccacaggggtggagggcttcaccagccaggaggaccaggagatgctgagccgcatcgagaagcagctcaagcgccgctttgccattggctcccaggtgtctgagcacagcatcatcaaggacttcaccaagcaggtgagcctgccttggagtgggggtgtgagccggcacggggtgcaggtcttctgctggttcccacccactcagcactggcatcttactcagcagacaggccctgaacgggggtaggatggacaactgtccctttctcagaccttttctagccatcattccttccctagggacatcttcatcaggagcagggatgggggtattttttctgtcccacgaaggggaggggagagcagaggtggttggattctggtgaaaccccatacaagttccccgcagcccttcccgtctgtgcctttccccgttggcgggcgtttcatggagtgggaaggggcagagccatgagagtgagctttctggctcactgaggagggtactgttggccccatagagagaagatgggatttcccagatgctctggaaaacctgtcacctttaaaatctcaggattaatcctagtttctggtctccgctccttgtacatcatctcattttgattcagggcagtttaatgggtggtatcgtgtctattctataggtgcgcagactgaggcttagagaaaggtttagagcttcggttctagagtcagatgggacttaagtcccagctctacctcttaattgctgtgaccttgagcaagtggcttagcctccgtgtgcctcagtgtctggtacacagtgggcactcaggaagtgtgggccctttaggtcaaaggagcctgagtacaaagttccccgtgagcctggggatgtctgggctctgtcggagtcccctcgggcagcacgtgccgttagccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcatccgcctggtcattgttgaatcacaaatgtatttttgtgcagaagattcctgcagctcaaagccctttctgattccatactgttcggggaaatggagagatgagaggagctaaatcagctttcctctgactcactcccgttcaaagctcatttcttttctgataattttgagagtgtctggaacagcttttgttttcttggtggggtggcaaccttactgggcgcgctgtgggttttgcatccaaggctgcatctccggttcctgctagcctttcatcttgctcaggtggggactcgcgtgcatctcaggcccaaggtcctcccgtcctgcttgttcatggagtgtggaactctcatgaggttcaccctgcagtggcaactttgctggtggccttttctccacccctgtggtgggtggtgctgctgtggtcacctctgttttacaggtggagaaactgaggctcagagagtcaagtgtcacagtgagggagtgcagggcaggcttcaaacctggtggctccgaactccacccatgtcaccttttctgccagattctctcttggcagtccctgacctcggcctgagtgggatgctgggcagagacagtcctggcctgggggaggcaggtgccagtcaggtgggggagactgaccctggggtaggttcccaggggtaggtggcctgactggcaggcacaggactgagaggccaaagggggtccgactggcttttccgtggtagttggggtagggctcataggaggagcagctgtgctcagagcatgccagtctccttccagatcggggcagcagcatgaagagaggcccctgagccagggaaacacctgcttgttggggaaagcaaaggctgaggagagagcctgaagggaggccaggagaggggagcattcaggctgagtaatagttggggctcggcttagtggaatctccagtcaggcctcagtgacacctagagaggcagggaggtggggcaagggggggagctggattcccgagctggtgctgccactcagggtggctgagctcttcactcacctgtgacctggctcc

SEQ ID NO: 16764 - DNA, 9259 bp, Human
aagcaagtaatttaacctctctgtgcctcagtttcctcatctgtaaattggagaataacaccacctgctttctggggttatgaagggagaaataggttaacatgtgtgcagcacttagaacactctggcatattttagctgcaaaatgaatgccagctatgattatttctatacttagtgcggggcttggcacactgcatgggctcaagtggcagcagttgtcgtccttgtggctccaggcctggggtccgccgtgtgctgagctggcttattgtgcacgtccctttgtgattcattcatcgaagtcacattagtagcttagaagtgaccgtagtgggagcatttacgccatggaaattggcaatagggcttttaacaaaggtatttttgagagccggtttcctgcacagaggctggtagttgggcagggtgagcagatccagatgtgtgccagggactcgcacgcaggcaatctctccacctccagtggccatctcagaccttagcttcatgatagccaggaagcgatggtgttggaaagcgccttgggtcaatgggcgaggcactcaaggaaaccgacttggggcatcctggggtggggaccgagtttgggcacatacagccctttgtgtgaatttaaaaacagtgccttttcctctacacaagatgccctttcgtctgggatacagcccccacctctgggatgcagcccccacttgcccacccagccatgcgccttgtgcagtatccaacctgcacaacctgtggcagcctgtggaagaccgaggggattgatatttcagcaggcctgtgcccatttgcagttcaggggctggaaagctctcctctggagaggggagggattcctgcaagggtgaggagatcagagaggccttcagagagcaggtggcacttgagccagaccctgaaacataaggggaagagggtgttctgcagaggggtggcatgagcaaaggagtggaggctgatctcagcagagctcaaactgacgagggtgactggggtcaggggttctggggcggggattctggtgggcgctaaggtaggaaaggagggagggctgggctgtgaagagcctttggggtgagcctggtggagcctgcgggtttgcttatacaagagcttggatccatgtcggcctctttcatgaggtcaagaggctcccatagaaagctctgagtttgccccagaaccataacccttggagatgggagggaagcttgagccagccatgggtcgttccccattccacatcctctactccgggcctctgggtctcctggaggcaagtaaacacctagggcctgggaggcaaaaatatccgggcaggtcatggagcggagggagcccgccagatgcagagcacaggtctaaaggtgggtcctcctgaggtggctgcaggagcaaccccaggcattgggcttggagcatgcggtgtggacatagccttcccttcttcccaggagggctgaatggccacagaaccaccccctgccccaggcttaagaaatgcatgctagtgccttccccatgtcttatcctagaatcacaggctccgggaaagccagatggatgaaccagggaaagaacggattctcaccatagataccatttttgagatttcaccatgtgctgagccctttgcaacaactctatgaattgggctcattttgcagatgagaaaagtgacttctagagaggttaagctactagcccaagatcagtagctagaggcaaggcaaggattcaaatcccaggagtccggtgcttgcataaatgaaaggatgaatgaacggatattgagtgagtgagtggatgaaggaaggagtaaaggagagggcatgaatgaatgagagggtagaactccaagaccccttagaacctcgtctgatgttcccattttacagacagaaaactgagtcctagacagaggcctagaggaggccaagaggtggtggggccaggtcgggggggccctgatgcctgcttctctcgctttgttgcagccccgagccatgatgaagactttgtccagcgggaactgcacgctcagtgtgcccgccaaaaactcataccgcatggtggtgctgggtgcctctcgggtgggcaagagctccatcgtgtctcgcttcctcaatggccgctttgaggaccagtacacacccaccatcgaggacttccaccgtaaggtatacaacatccgcggcgacatgtaccagctcgacatcctggatacctctggcaaccaccccttccccgccatgcgcaggctgtccatcctcacaggtgaggcccactggtgcctgggctggggcggcagggccagggcatgggtgcggagtgtgctgggcacttggcagtttgcatagacttgcatagccatcgtctgagacaggcgtcatccctgcacaatgaggctcagagaggttttgccatgtgctggaaatagtgatgaagtcgggggccccgattccattctgttagactccagatcgattactcatggctgtcggggccgccttccagatcaggagctgataccagcatgccccagggatattcctttctagggaacagaatgatgccctggctgctgctttccttctccggaagatgacccaccagagctccagggcccaaggtcagtccacggggctcaggtctcccacaccccaggcctttgccacctcctagagaggtaagggcaggacccaggcagtgatcaccaaagggaagggggcttggtcatggtcatagtgatggtgatggcactagctgacacttatcagaagctatgggcctggccctgttcttagagcttggcatgtagttttttttgaaacagagtctcgctctgtcacccaggctggagtgcagtggcgcgatctcggctcactgcaacctctgcctcccgggttcaagcgattctcctgcctcagtcccccaagtagctgggactacaggcacgtgccaccatgcccggctaattttttgtatttttactagagacgggatttcaccatgttagccaggatggtctcgatctcctgacctcgtgatctgcctacctcagcctcccaaagtgctgagattacaggcgtcagccaccgcggccagccagcatgtagttatttaaccctcacagtaaatagttattcattccctttttacaggtggggaaactgaagcccagagaggttaagtaactcactccagtggtagcacagctcgtaaaggcagtctgcttttgtgctttcagacaaagccataccacagcctctcagccctgctgggaagggtgaggagggacagggaggttggggggaagaaggggtgagtggagctgaggggctgtgcccttgtttacactgcattagcatggtagctaagaggacaagcccgggacccagcacctgggtgtgagccctggttccgctgcttcctggctttgtacctcgaggcaagggattttatctccttgtgtctcagcactctcatctgtaagactgcaccacatcaacactcatcctaaagggactgtgagacttaaatgaatgaatatatgtaaggcgcttggtgagcagatagtaaatgcacaataaatccccaagtcttctgttgagtcagcatttgcaagtgggcctgctacgggttacacgatcatttcccaagtcacgcccctgaagttgctgagcagggataagggaaggagtgagcaggcaactctctaggcatcattcagataaccccccaactgaggtacttctatacagagaaacccatgccactcccagccctgctgccgccttgaggccaagactgaggctgcggggtggcccctccttgagtgctttctcttccaggctggcttttccgagcatctgacccagacagcagtcaagttctccgctccaccccgagttttggagaaggggcatgtagataggagagccctgggtcgacctgtgttcgaatccttgctgggcctcttggcttaaatgtgtgaccagaggcacatgcatcctgtctgagtctcagcctccccagccacacagtgggcttaacctcataccccgcagggaggctgtgaggactgcaagaaggcttgtggcgggagcttccagcacgtgacgggtattgcattggtgtcagctcccccagccttggggaggggactgggtacccgctgcaatgaataaggctaatgacagagggaaggagaggggagatgtagagaggaagcacatgcatattttcagcattaattttcagtgacacaagtaatacccaaacacaccctcctgcaaacgctacagataaagctaatgcccctttgacccatgtccccaatcccaggctcctgcccctgccccggaggtggccaccctggcagtctggcatggagccttccgggcctccgtgactacaccggcattcgtatttgtatccccacaatggagagtatttttgtctgtctcttttttatggcgcatatcattctgagcacagctgtctgatgcttgtttttttttcacacaccaacccgtgcctcattttccaacctggtggaacctcattttttcaacctcattttcctgctgctcaggaaattctgaaagccattaattccactgccagctcttcttccagctgccagacgggccgatctctgatgcttggcatcgcagtctcgcatttgaatatgtcaaggccacgagtcctcaggggccccggattagcctaacgggatggggtttggcagcccaagcaggaagagttgccaagctgacgctgcctcgcaagtgcctttcagaagagcccacactgcagttccctccatcacctcccatccattcaggcttccttggttaacactgactgtgtgccaggccctggggagaccaggacgagtgggtgatggaacccttctctgtgcccgagctgtttggagcacacctttgatctggacaccattctgaatgtgccatgtgccattaaatgggggtaaatgatgtgctctgggggtgcagaggaaggtggcagccattctgccagaagctggaactggttgcttctcttctcaagaatttgggccaattgctgattcctctgggcctcagtttcctcatctgtgagacagggatcttgtcacaccacaaggctatcaagagtttgagcaaaagtggttggacgcagtggctcatgcctgtaatcccagctctttgggaggccgaggtgggcagatctcttgaggtcaggagttcaagaccagcctggctaacacagtgaaacaccgtctctactaaaaaatacaaaaaattagccaggtgtggtgatgggcacctgtaatcccagttactcgggaggctgaggcaggagaatctcttgaacccaggaggtggaggttgcagtgagctgagatcttgccattgcattccaggctgggcaacaagagtgaaactctgtctcagaaaataaataaataaataaataaaaaatagctaggcatggtgacaggcgcctgtaatcccagctgctccagaggctgaggcaggagaatcgcttaaacccaggaggtggaagttgcagtgagccaagatcacaccactgcactccagcctgggccacagagaaagactccatctcaaaaaaaaaaaaaaaaaaaaaaaagtttaagcaaaagtgaggaaggtgcttattaaaagctggaaatcaggatggaggtaccagtccagacagcctccccaccaccccaccgtctccacagcagcccctgtttcagattcacaagcctgccttgagtgatgcagtgagttatcctggaggcagtgtgggccttggaggccagcactcactttttcatcctatgatttatttgagaagcagagagcacctaccgggtgccaggaacgagctaggtgagaacagaatcaggtagaaatctcagcctagccacacggaagctgtgtgatcttgggcaggctgcataccctttctgagcctcagtttgctcacctgtaatgcaaaggtaacaaaatcttgacagaggcatagtgaggaatcaagagaacaacgggcctggagcatacacccagtgcttagcccccagtaggccctcactctcatcattactgacacctgaggtcactgagcatgtgccactgtccattcattatcttgcataactcccaaaatcatcctgcaaggtaatatttcatcttcatgaaacagacagagaaactgaggttacagaggtttcgtgatctgcccaagtctgctggcagctaagcggatgaggccagatgcaaactaggcattgagcaagacaggcaggacccctgctctcatagaaatgatttttattattatctgaacacagtccacacaagtgacctacccctctccagccctgcaaagaaatgtgaagtgagttaactgtatttgaaccaagtggtccacgtgttagctatgcgactgtgaacaggggcttcaaccccctcagcctcagtttcctgtcctggaaaataatcgcagggagaataatcgcagctaccccgaagagtcgctgtgtaggttaaagcagttatgccgcataactgcttcagggcacctgtgactcccagctcttagggctgatgttctgtggccagaggagggcaggggttgcagctggccggtgaactcactacctgggctctctccctgcaggggatgtcttcatcctggtgttcagcctggataaccgggagtccttcgatgaggtcaagcgccttcagaagcagatcctggaggtcaagtcctgcctgaagaacaagaccaaggaggcggcggagctgcccatggtcatctgtggcaacaagaacgaccacggcgagctgtgccgccaggtgcccaccaccgaggccgagctgctggtgtcgggcgacgagaactgcgcctacttcgaggtgtcggccaagaagaacaccaacgtggacgagatgttctacgtgctcttcagcatggccaagctgccacacgagatgagccccgccctgcatcgcaagatctccgtgcagtacggtgacgccttccaccccaggcccttctgcatgcgccgcgtcaaggagatggacgcctatggcatggtctcgcccttcgcccgccgccccagcgtcaacagtgacctcaagtacatcaaggccaaggtccttcgggaaggccaggcccgtgagagggacaagtgcaccatccagtgagcgagggatgctggggcggggcttggccagtgccttcagggaggtggccccagatgcccactgtgcgcatctccccaccgaggccccggcagcagtcttgttcacagaccttaggcaccagactggaggcccccgggcgctggcctccgcacattcgtctgccttctcacagctttcctgagtccgcttgtccacagctccttggtggtttcatctcctctgtgggaggacacatctctgcagcctcaagagttaggcagagactcaagttacaccttcctctcctggggttggaagaaatgttgatgccagaggggtgaggattgctgcgtcatatggagcctcctgggacaagcctcaggatgaaaaggacacagaaggccagatgagaaaggtctcctctctcctggcataacacccagcttggtttgggtggcagctgggagaacttctctcccagccctgcaactcttacgctctggttcagctgcctctgcaccccctcccacccccagcacacacacaagttggcccccagctgcgcctgacattgagccagtggactctgtgtctgaagggggcgtggccacacctcctagaccacgcccaccacttagaccacgcccacctcctgaccgcgttcctcagcctcctctcctaggtccctccgcccgacagttgtgctttgttgtggttgcagctgttttcgtgtcatgtatagtagtagaaatggaaatcattgtactgtaaaagcctagtgactccctccttggccaggccctcacccagttcagatccacggcctccacccgggacgccttcctcctctgctcccaaacagggtttccgtggcctgtttgcagctagacattgacctccgccattgagctccacggtttacagacaattgcacaagcgtggggtgggcaggccaggactgcttttttttaatgctcccatttcacagaggataccaccgagactcggaggggacacgatgagcaccaggccccacctttgtcccctagcaaattcagggtacagctccacctagaaccaggctgccctctactgtgctcgttcctcaagcatttattaagcacctactgggtgctgggttcactgtgtcctaggaaaccaagagggtccccagtcctggcctctgcccgcccctgctgccccaccaccttctgcacacacagcggtggggaggcggggaggagcagctgggacccagaactgagcctgggagggatccgacagaaaagctcagggcgggtcttctccttgtgcccgggattgggctatgctgggtaccaccatgtactcaggcatggtgggttttgaacccataaaccaaaggcccttgtcatcagctcttaacaagtatattttgtattttaatctctctaaacatattgaagttttagggccctaaggaaccttagtgatcttctattgggtctttctgaggttcagagagggtaagtaacttcctccaggtcacacagcaagtctgtgggtggcagaagcaagctagcgctgggcattcagtacataccacgatgtgctccctctcttgatgcttggcccctggggccttcagggctttgggacatcttgtcctcaaccctctccctagatcagtctgtgagggtccctgtagatattgtgtacaccatgcccatgtatatacaagtacacacagatgtacacacagatgtacacatgctccagccccagctctgcatacctgcacctgcaccccagccttggcccctgcctgcgtctgtgctcaaagcagcagctccaaccctgcctctgtccccttccccacccactgcctgagccttctgagcagaccaggtaccttggctgcaccggtgtgtggcccgctctcacccaggcacagccccgccaccatggatctccgtgtacactatcaataaaagtgggtttgttacaaagccgtgtccttgcccatgtgtattttttgtatt

SEQ ID NO: 16765 - DNA, 14566 bp, Human
aagattagatgtaatcttgccaagcagccactttgtaaactgtatagtcttatgcagatggaaggaagggcctgtgcctaccttgatcatagcactaaacaaactgtactgtattttcattcctcttagttatctccctaaaaagactctgagttccttgaacacaggaaggtgttttatttgattttgttatcctcagcatgtagcagtgtctgacacacagtaggtgctctatcactgtgagagggatggatggatgggtggagttacagatggatagaaggatagatggagggatgggtggatgatggatggatagatggatggaggggggatgatgaatggagggataatgagtggatgaatgagggaatgggtggatggatggatggagggatggaggaacagatagatagatggagggatgggtgggtgatggatggatagatggatggagggagggatgatgaatggagggataatgaatggatgaatgaggggatgggtggatggatgaatggagggatgatgggtggatgaatgaattgagggatggatggatgaacacatggatggatggatagatggatagatggaggaactggtggattttggatggatgggtggatggatagatgaatgaatgcctggatagacaaagagatgatggatagatgaatagatgaattaagggatgtcggatagatggagggattgatagatgttggatggatgggtggtggatggatagatgagtgaatgcatggatagacaaagagatgatggatggatgaattaagggatgacagatggatggatggatgagtaactggatggacaagtggataaatggatagatggttgaatacctgaatggattgaaggaggatgcatggatgtaagataaggctaatcatcctccactctctttctttgcaaaaccatccacccatttactcaataaacatttattcagttcaaacttggcacaaagcaccatgtgaggcccaagagatacgtgggttaataaaacagagctcctgccctcctgaaaactgcaaagaaaggggcgtggcttcctgagttcaaatcccaactctgccagcgactagctgtacatcagtgatgtttccctactttctctcaattaaatagggataatgtcagtacctatcacattgggaggtcttgcggggattaaatgagttaccaaatgccaagtgtttgggacagggcctggcacccagcaaagtctcttgtgagtgctggctgctattatcctaatggagaagatggcatgaaaaccaggaaataggatgccctttgggaagcaatgcaacaggaacttacacaaagaaaggaaaggaggaagcaattagtggtgtctcaaaggagtatgtcaagaaaaacttttcagagggaaacctttgagcagggtcatgaaaacaggagttctctaagagattgtggacttgcctgggaccacctggctataagcacaaaaccatccggttcctttctgtcacttctggctgggtgaggggtctctggcaaaggggcagaaggtgcgtgagaggttgcgaatggccaggactgtcctggggccagccggggcacctggtggccaagcttagaaacatgacaggtcctcttgggagggctgaccgcagggagcgttgggtttcaggctgctggcgtcggcttctgtggtgccctttctgtcggctatgagagtccagacagtgcccaacctcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaaggtataaaaacgcccttgggaccaggcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggtaaaaggaagagattccattgcccctgccacccacaccctaagatcaagggtgttcagctgcaaggtggaaagtttgcacgtggggtaggtcagttggctgcattagttaagggtgttagaacggtcacttgctttttctttgcttttaagtgtcagggattggactcaggagagggaaaggagccatttcaggctgatgtcagcagctggaggaagcatgagaatcaaacctaggatgctcagagtccaccaggaagaattttagaattatagacagtcagagttaacaagggtcctgagagattttgtacagccacctctcttacaggatgaggacaaaaagcgactgagaaggggaggacatttccagagtcacagctcattaaatgctcttaaagtgtcaaggttaagacatgctcttcaaggggagacagatctggttctagacttggctctgccactgagccactgggtgacctttgggaaggtactcaacctctcggagcctcaatttcctctcctgtacagtgaggggatatcctaatatctatatcctagaggagatgtgagaattaaataaaataatgcatgcaagaggcctggcatggttcctggcatatactgagtcctagaaatgttagtagctattactgatgaagcccaggctagggacctttcaaagcattgcaattagagaacagaagatagaggctcattagtgaccttcgatgttgagtatgtctctagtttgagaggtctgaatgatgtggtctgcaagtatatcctgccttctaccacaagggattccagaatacaccaaagaaaacaaaattctgaggtttgtaaatagagggtggctgtggtttgtacatagaagctcatctcctcgttgccttctatcccaaaggtgatacactcttctcttggccccttccctcaccattctgagctggttccctcagaagtctaataggttaagaatcaacgtttctgccaacgggaggaaggaagtgggcgccggggttgccacaagtgaatggattgtctttggcactttaatttgcagattaatttctccttatttgtgagccagagccaattttcctcttccactccgtcgtcctttgggtctcccttgggctttacccatttccagcttctgtctgcctcgggagcattgctggtcctggaagctccgttatctaaaatttgagccgttggtgatccgtgctagaaacacttgaggaagaagagttgagttttctgttgactgtaatggcatcgtggtgtgtttatgtctttcttctcctgtccctgtcatctggctgcaacaggccctgttggattgcacaaagtgctcccccgaccaacacacacacacaaattgacatcaactcctgggccacagatttgccgtgtgaccttggacaagtctctccacctctgggtcttatttctctgctggttgagcgaagggattgtcttccatggtctccgagatcccgtcccacgctcatgccctagaattctctgagtccttgatgcacttttgcctttggcgaggaggcaggacagtcaggcgtggaggtaggagaccagagtttgcagagcagaggtctttccaaggtgatttgggagctgccagacctaaggcagtgacttgtacgtcttgaaagagactcagggtgttgcatcatcagggaggatcacggaggtttgccgggggctgggagccagggataagacataatgcctagggttgctggtccctgaaaggtcccagaggcctggtgccctgtcacgtcttaggttgtgggacatgcagagactgtgccagctggttctgccctctcagtatttggggtacagggaggatggcctccctgggggcagggtggaggaggctcatgcccaggactgcaaatgccacccgtgagagttggcatcttgactttgttctagatactgactctggattttctaactgaccttgaaaggttatgtctccaatcttctgattgtaaaagagggcaaattccatgaagcccagtctgtaaaacactgaggccttcactgcaagtacacaaacataaaattctagaacacagaagctggaaggtcacttggagattctggctccaggagtggggcttcggaagggagggggctgctgagtgggctccacacccctgtttttcctttctttactcaaaccttttttgttttatttactttggctgttttggggagcggggggaacaaaggatttcaaggtcataaaatgtttgaaaatcaccagtggtggtcactacttctcattacagggaggaactgggcctgagagtctccaccggttaatggcagccacaggcaggaccaaaaattcctgggtgatggtgatgataatgataatgataatgataatggtagagatgatgaggaggagaaagacagcaaccatttattcagcacatactgattgctgggctctgtttaagtgtttcactcactgaagcctgacaacaatcttatgaggtagatatgattatgatcaccacatttaacagagaggttaagtaacttacgccaagtcacacagcaagtaagaaaggagctggaattcaaattcaggcagcttggatccagaatccttgctcctttttttttttttttgagatggagtcttgctgggattacaggtgcatgccaccatgcctggctaatttttgtatttttagtagagactaggtttcgccatgttggccaggctggtctcgaactcctgacctcaggtgatctgcccgccttggcctcccaaagtgctgggattacaagccaatgagcccggcccagaatccttgctcttgaccactatgctatactgccccatgaccttgccacacgcaagacgggctgccacccacgctctggttcttttattctagtagagccagaggggtgttcatggatctgacaatgtgctccatgttccatgtgagtgtccaattgggcctcagttcagagaacagcaggaaaatggcctcccttctctctgacttggactgaagatctgtctgatgaaccaggcccactgacagcagggttgaagctggaaacacaggccagcggggctttctgaaatactagagcaaacgccctccgtccatttccacaggctgaggggctttcatctgttcattttccggatcaggcaaatccaggagaatggccttctgtggctgcctggggggctcctagctgcaaggcctgggcccacaggaggcaggcagctgtgtggtgccggaatgatcttgcggggagacaaattagcccgattctgctctgctgtttaaagtaaatatggggtggggtggggtggctcaggcctataatcccagcactttgggaggcaggatcggggaatcgcttgagtccaggagttcgagaccagcctgagccacatagtgagaccccccttctctacaaaaaataaacaaaattagctgggcgtggtggtgtgtgcctgtagtcccagctacgcgggaggctgaggtaggaggatcacttgggcccaggagattgaggctccagtgagccaagatcacaccactgcactccagcctgggcaacagagcaataccgtgtctcaaaaaaatattaataaagtaaatatgagctctctccctggctgtctggtgttgagtggaaagaaaggcattggcgggtctagacccttttggtttacatatggatgagcaatgatccagagaggctaagtgacttcaacatcacagagcacattggcgccagaactgggaccggaactcagcttccgtaactgtcagtcccatgttctcttccctagatatcagagggcaggggcaggccccaaaatgtctgagacccccagctgccttgtggcccaaattcttggccctgctctgcctcagacagtctgctttcagcgtcctgacctcggaccatcgcctgtgcatgccaggtcttgcatctgtcaggcgggagttcaaggatcattgtcgccagataataatagtcaggagctcagggacccttggatgaaaggtgtcagagacaagccgtcagtgacgcacgaggatttggataaggtcctggagcgaggtggcaatgttgggcacggcggcagaccatgcccaacatgggggaagggagtgtatgtggttcaggcttgtgcgtgtctctgtgtgtgtgtgcaggtgagtatggcgtgtgctgggatatatttatgtgtacctctgtgtgagtgtgcaggcccatatgtgagtgtgcacacacatctgtgagagcctgcatgcatgtacacgtgtgaggtgttgatacatgtccatgtaggtatcagtttgcctgtaaatatctctgtgtaacaataacaaagtccgaatagtcatcaagagtatagacatgaagccagactgcctgggttaaatccccagctagttagtctttcggtgcctctgtttcttcctctgcaaaagggcgtctaccccatcaggattttaaaatcagttaatatggctgggcgcctgtaatcccagcactttgggaggctgaggcaggcggatcacaaggtcaggagatcgagaccatcctgcctaacatggagaattctgagaattgctcaaacccaggaggtggaggttgcggtgagcagagattgcaccactgcactccagcctgggcaacagagccagattccatctcaaaaaagaaaaacaaaaaacaaaaaagccatgaactcattttcaggttgaggagctcagcatcctggttgtgaaataccctcctcataaaaccctgggatggagactacggggatcaggtgcttccttgtgacaacttctgggcatggtggctcagggcgcaaactggagtgtggccacaatacatactgtgtacttttacaaggatgtcacagagcctgggtatcataaaagaggagcttttcaaggaactgaaaccattagacaggagagagagccctgggcagacagggttgcccgtgccaaacatttcagctgtggcacaagggaaagggtgggagttatgaaactgttccattttgggtttaggtctgggctctgccgctagctagccaagtgaccttggccacttatctctgtggtcttccatgagtaaaaggcggaaactcactcctacccagagggcaggtctgactccctttaaccagcacccacctgctcacagcaggaaggactgaggtctaaagctggaggtgggcaggaaggactgaggtctaaagctggaggtgggcaggaaggaccgaggtctaaagctggaggtgggcaggaaggaccgaggtctaaagctggaggtggctgctcagagtcccagcagaggcctctggggcacctcactgagtgcctggcaggagtgggtgcctgtctcagggctgggttgagttgctcccaccaggacccttcgtcatctgcacagtgaggggactgggaggttcagagagtcacagcttgggctcaaaacaagcaagaggtttctgagtgtgaggattgctctggagtggaatggccctcacaggtaggagtgagcctcctgtagctagaggtatttaagcagctgaaggacaatccctgggcaggaagctgcagagatggtcgcagcgtggactagaactgctgttttggtcactcagacctcattccagcctggcttctctggacagcacccctgcaatagtgagctggtgactttacgcctcagaacctcggtttctacatctgtaaaatgggaattatatgacactcactatgtgccagacaccctgttggtacatagcacacactatctcacttaatccttcaagtagggacaagttatccccatcccttatatgaggaagctgaggcacagagaggtgaagtgaatggcccaaggtcacacagctgggaagacagggagctaaacttgaactctagtctggctgcccccagacctcacaccgcacctcccatgccgactccagccttccctgtgcccacaggctctttaagggtcacccagagactctggagaagtttgacaagttcaagcacctgaagtcagaggacgagatgaaggcgtctgaggacttaaagaagcatggtgccactgtgctcaccgccctgggtggcatccttaagaagaaggggcatcatgaggcagagattaagcccctggcacagtcgcatgccaccaagcacaagatccccgtgaagtacctggaggtaggaggcagagcctgggcaggtgggaggatgcggggaaggcctcgggtggggcaatgggatctgggttcgagtccaagctcagccactaacttgtgggatgacctatgccactcttctctgtgccccaggtttctcatttgtaaaggggactgccacccactttgccttcctcctgggattgttgagaatgaacacatttagcatttttaatttagtatgccaaattcacatcttattaccaaagaggaaagggagaggggatattgggtgcaaaatttgcatcctctccatgggtaggtaccattatcatatccacttgatagatggggaaactgaggctcacagaggttaagcagcttgtccacggtcacaggaggtggataatggcagagccaagattcaaacgcaggtctctattactacagaaccccagcccctaactgctgtgccactgggagtctggtacatgcaggacttatgtggcaggagctcagcaagtggggctcaatttggggtgggggtgaccagcaggctggctctattggttccagcatcttcacagatgaagagacaggacctcggtttccagcacaagcaattggtttgaacctcctgagatgggttggaaagttgggtggatcagggttgggggcaggagcctgggcttcaggttgtgtgtctataactggtgggaggaggcgatttggggagaggagggagctggggatgaaggaccacagggacaggtgcatcccccgagggtagaaacagcaggaagtctggtgcagccatgaggattaggatgtggtgatagctacccgctgggatgggccacagtgagcatttgctgccatgcctagcacatggcatccatcctcaaagttgcctcatggccaaaatgactgcaagagctccagccagctcttctatattcccaactggaagcaggagaaagagaggaatgctctcttttgaggagtttaaggagtcccagaaatctcatccaacaattttatttacatctcattggccagaagttagttacggagccatcctgtctgcacgggaagctgggaaaggtagtctatcacccctccaaatacaactagtgttctgttaccaaggaagaaagggaaatggatattgtggacgtaattagcagtctctgccccaggcaagtacccttctcatccccattttgctggtttggaaactgagagctcagagggtttaagtagcttgcccaaggtcacacagctgataagccaggaggtacagtcagatccatggtactctggaaccaggctctgaatccactgtggcacaatatcacccattgacaaccaccgccacccctctttaacttcgacctttgcaccccaccccacaattgcgcagagtcctgcctgcccaactgctccacatcaccagcgtgaacagacaaccctgcatgtgaggccgtccctgcctgcccatcttctctctgcaaatccctgttcatccactaaggcccagtgcgaagccatctcccctgcttggaaccccaggcccacgaggctttcagcggttccatctgccagcccctccctgcaccatggcactttatcttcatctccggtcatggcactgccaggctgtgtgataatttgtctctttgcccagcggtctcccagcagacactcagctccctaggggctaccatttctgtgccccactggcacgtgtttggctcaccatacacttccaatgactgagttctctctctagagaggaagaagccgagtgttggatagaaaaaaccatgcagccaagatatcacaaccagttggccactagaacccaggtctccctaaaacatgcttaatctgatgcataacctctgcaaaaaattgagacagagcccagatgtctgcttttccccctcacggtggaccttcgctctgcgctgttcataagacagtctccacctcacctgtggacagattgtctctctgagggactgaggggctgtacagggtggtgggtgccgagagtgtttccatttctcaattatgcagtggctccgttccactgttttctagatatgagtggctctgccatggactccagaaagtctgagctgggggcccaaccaggccatctgggtgggtgaagtcacacatggagtcggggcataggtggccctggaacttgattctctcaagttctctaaggacagggcttgctccatgacaccctgagcccccactttgttttgtggcattcatgaaatggaaggtgaagtcaagcatccaccttgatgcccaagagtaggcgtttgtggagctgcccctctttcccagcagaggggcttatggggtgttgatgcttcttgaggcctccctttgcatgtcccacccgcgactatccctgctttatgtcacttgcaccctggggccctgagaaaacgagaaacccagccttggttcagccactgcctccgttcccagctctggcagtggcctgcccacagcctcctgggcgcaaatccatctctgctctctgcttcctgcgtgacctcggtctggccacttgattttctcctctgtaaaacgacactccttggtgcaccagccagggctgtggttgggatcaaatctggttaacttgagaaagcacagccgcatttcacatccatgagtctttccatccctaaagcagcaccatgctacatctccgttttcccatgcccatctctgttatccgggcagtgagactgtgggtactaaagcaaatggcaatgctgaggctgatagcagacattctccatcctgggagccagccgcgggcctcatccctgtcttcttcctctctctccttccctcccaccagtgtttctgtgcttggtataaaaaataggaggctgtgcccccaaaatagggtctttaaaacaataaccataccaagtcattaagtatgcaaaaattgcatacacacaaatagaaatagtgcctttctagactttctgattgcaaaatcctgaatacaataatgaaatctgagcatttcccttcttttctgctgcccccaagcgggtggtgctctgagctctcacctggtttcagtggggtctacatcctgatggagtggagggggctgtgagtaagagcgtgggctccggagccggccctcctgggtccaaatgtcccttccattcaacctcccctcgcctcagtttctgcatctgtaaatcgagggcagttgtagtatctatctcacagtggttgtggggatcaaaggggttcatccgtggagatcacacagactctcacctggtgcctagcaagtgctcaatacacggtcctggaataaagagaaggtaggaggacaactgactcccatctggcccctggcttgtcccaccctggtgaccattttctctcctcaccctccctgcagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcagtttctgcctggcatttttcatctcctagagtaaatgatgcccccaccagcaccagcatcaaggaagaaatgggaggaaggcagaccctgggcttgtgtgtgcagagagcctcaggaaagaggagaaggggaggaggaaaggcaggagggtgagagggacaggagcccaccctccctgggccaccgctcagaggcaggcccagtgcagggcatggggaaatggaagggacaggcttggccccagccttgggagcaccttctcttcgggggaggtgggaggcagcgaacagacctctgcaatacgaggagagagtgacaggtgcgccaggctgtgggaacccagaggagaggggaagccatcatcatcatggctgcaataccttcagtaacgtgggaaggtcaccctgctagtaagtggcagagctgggactcaaactatggcctggaaggcagcagggactccagccagggagagagcaaggcggccagccagtggcagctgctgaccttctggccacagagaaaggacagacacatggggaataatttacaaacacaggccaggagacaaaatccatatcagcgaaggcagagtgcacgggcagaaaatgtaagtattgctgcgagggccaaaaataaaatgttggcatgtaattgtggcagccaggaagcaggctgcagcaaagggtgtggaaaggggcctggaaaagggcctggtgggctggaccggcccacgtgcccaagccatgaggtcctagaatgccaccacgactctgggcgccatctctgggaagccccaagtcctgggcaccttaaatctccagtagctcccagaacaagggaccttgagcccccctgcccttgagcatctgtcttggggtccagccctacccctaccccacgataatcgtgacctcactgccccaaacctcagactaagctcaggctcacggctgctgggcagagcagtgctcctctgctggatgtggacacgtcccaaatcctagcacacttatttaccaggctgtgcggtggcaccagacaaccgcattaaaggggaaccttcttcctttctgcgccaggatttgggaattcgtatgctctatgaagaggtgggagagaaaggaggggagttcagggtgaggggagctttttgatcttggagcctggagaaaaattccacatacttagagagtaattcaattgaacactcaggcaatgagcagttctgtagaggattcgtgtgcaggatttaaagttgaataaactgggtccctgtctgcaagccattgacaatctagtcagggagacagatgtgttctgataattaaatcagggcagaacaccattaaggatgcagagatgcacccgttacttgttattcattcagcatccattgaacaaatgtgtgctaagcagagcaattttttaaaaaaattcccagtttatgtgcaccttggatgcacacgatgcaacttattctttgtgtgtgtgtgcttgtgtgtgcacgcctgtgactcaaggggacttctgttttgaatcttcattttgcgtgagtggcaaatacttaatctcaatttatttgagatttttctgtggtttttgggctgattccaaggggcttatgtgtgccaagttgtgtgcgtgcatggggaggtggcaatctggtggctgctgtcatctgtccccagggttgacctcaggactgctgcacccacctggtccttagtcattgttccttatcagatcctctgcgtaggaaactgtgatcgcttttgcctgggaccacttcctccctgaaacactcttgccccatgaggtctctgcctggaatgtgaggcatggattttctctgtgttcagaccccgcagacctgtctgaactttttttttttttttttttttttgcctcttttaggacttggtagggcttgtgcaaggcggctctgtatggttgtatgggttgtgcactccacatgagtgcctggacgaagcgggtaa

SEQ ID NO: 16766 - DNA, 32584 bp, Human
tgcaaaaagaaacattggggaatgggaaagagggacagggatagaaaggacatttctaaagtatacttccttgaggctgggcacagtgcctcacacctgtaatcccagcactttgggagggtgaggagggcggatcacctgaggtcaggagtttgagaccagcctggccaatgatgcgaaaccctgcctctactaataatacaaaaatcagctgggcgtaatggtgtgtgcctgtaattccagctacttaggaggctgaggcaggagcctggtaggcagaggttgcagtgagctgagatcctgctactgtactgcagcccgggcaacagaatgaaactatgtctctaaataaacaaataaataaacaaaccttatcggaggttttgagctgtgagccacgtattgttttttgtattcaaaagttaaaattaatttttaattaatttgggaaagagcataatttggggagggtcattagggagggaaggagggtaattaagagtataagctgaggtcattgggaaaggaagaagccagaaggggctcttggagtatttttgattctgtacaaaatggaattttggaaaacaacaaagcactgcttagaaaccagctacaggccaggggcagtgttcacacccataatcccaagactttggggaggccaagaccgggggatggcttgaacacaggacttgagaccagcttgggcaacagtgtctttataaaaaaaaagtccagtgtggcggcatgcacctatggtcccagctacttgtaaggatgaggcagtgagccgtgatcccaccactgcacttcagcctgagcaacaaagaccctgtttcaaaaaaaaaaaaaaaaatcagctaccacgcagaaaaccaaatgtttattgcagcccatctggagcttcagagccatagaactagagctgaacggcaccttagaggtcactgcattcggtggttcgggaactgagacccagagttgctgccacgcttgctcaagatcccacagcaatgtacggcagaatcgagaacctggcatcccccggcaagtctggctttgacgtgatgttggtctgacgtagaggttgacatccagaacctttgcttcacccattcaagtaacccaaggaccacaggggccagcgtcctggtgggagggtatgagagggaactacagcaaatagccaattggcactttaagtccccacaatgactgggaagcagggattcctcatccaggacaagcctgaagcaggctggcagagctgcccccctttcagtggtgcctggtctcctggcacctgccccttttcccctctcccctgaagaccaaagaacctgaggcggtaggttttatcacttccttttggggaacaggcttcaggctgtgcagatggtataaagctccaattatgcatgccatatgtacactggcgtgccttgtagggtacgtgtgcatggcataaacacagcatcaaaacatgccacaagcccttgaggctcagaagcgcacaggtgaaggcatgatgtccgaccgcatccctgcatctgccaacacagggtgtcttgtgctcggctgcctgaggtgctgtccttgcctgtcatcctccttttctcttggagcctcaggtcccagcccgggatggtttccactgcgtgcctgggcctccagggcacctccatgctgatgcgtgcttgctgtgggcgtggagcttaccattctcacctggcagccccagttatggctcccagcctgggggagaacttccctttccaaagttagataacaggctgggctctctgtcagaggattggcgcgacagctccacgtgctgcagctggcgcagggccaggcccgccctgccaagcagcgggaagggaaggcctggctgcagccggagctggcaggtggccgagccgggggtggacgggcgggctgggactggtgctggccattggctgcctcaaggctcccaccccgcctgcctccctagcctgcggctggcggcccctgcctctccagctgcctctgaactccctggagcaagcacctcctgctgggctgtgtgagctgcgactggttctcagtggcccctgccatggacatgcctgaggtcctcaagtccctgctggagcactctctgccttggccagagaagagaacaggtaggagcacaggtgacctgcattgattggctgcccaggtactcgagggggcgagggggcagccacaggcacagtggcaggacaggcatctccaagccagggagggtctcagcagtggtgcgcccttggtctcagggtgcagagtgcggagaggggttcgaggaggcatgtgtcacaccggctctgggactctctcctaggcctgctggatttggggaagccatggccagtgtgtggccactgacaggtgctgtgctcatgtgggaccaggacaggacagggggtcctattgaaagaatctggctggatgctgactgcttttgaagctccctccccctgtacgctgggggtggcagaggagcggcagggactgtggatttgggcagcaggagcctgggtctgaagcagaggctttccttggtgcgcctgctgcagctcccgcttgccggagggctgaactcatggatgggatggaaactgttatgtaacaggaccacaaggctcgaagccctgcgttcctaggataccacaggcaaaacgcgcgagggaggagagaggagggcgtggactgaggggcagacctggtggccagcaccaggtgtctcccaagtcctgcctgggaaccccatggccagattagtttggcggagaatactgataaatctctctccaaatctcttctgttcccagaagtcagaggtcacccccaggtccccagggctccaactcctccttgcctttagaggggcccagctggcttttgctgcctgagtctgacttgagcacctggggtgtcctctcaggggacctttctcaggcctccctctcatcctgctgtgccagcacctgctacctagcatcaccaggtggccctggttgtccccgcaggactccttccttccacaggacgctctcagcccactcccaaaccagagccaggagacagatcccacagcccccggcctcccttcacccctctggaactgggtgtgggtttgcttgggctaagccaggaaaggagggtcagcaggttctagccccagggagacattgcccgaacggggaaggacgtactgggagcttagggcaggggctccggagctctcgcacgcagctctgggctcaggcccctccgaccacactccatgctgtcaaatggtgggacagtccaggccaccctctgagaagagtgtcacagaaggcgctcctgtggcctcctagcactggggacaccagttgctcaccatgagaagcccacctcctcagcgaagccctctgcaactcagccggagggatctgcccccatttggagtccacacccacaaacaagccacagctgacttttttggcatctctgagtggcctgtgtgggtgggcagagctgaacacatttccaaaagctaaggtagagggtcccctccttggtccaggaacccaggaagggtggtacagtccctcctggctcccccaaggtgtcccaggatgccccccagcacacacatgaagggcgaggctgccagtggggcagggaggattctcaggggcgactcggggcactgctcctcagatgaggataacaaggcctttgaagtgtggcagcagctgccggtctctggctcccagctggtctgtggggccctgcaatagccgaaaagtccccctccctcactgtggatgagcaaagtcagggcctggcacataggggaccgcccaaggtttcaggcagagctttgccgagcactggcaagctgtggccgagaattagttagtccagcatggctgggcaggtccaaggggtgtgggccagtcttgggtcacctcctgtcacttcatgtggcatctcactgagagtgagaagcatgaggtcccacaggaccgacagatgccagcagccaactgctagataaaatgaggggaagagggctgaagagccacaggactcacaatgactgcagcacattactgccccctaatctgcaatcagtttcccaaagctgcccgaatctccagaccatttataaacagaaacgtctacctgaaaagcaatagaccttgttgaaaagagggtatagccaccacacagaatgattacagaattacttgccatcagggaccatgtacttaagtagttgttgaagtggcttctcttccatctgccactgctctgactctgggtgtgaattggagaaagacaacagaggccaggtgctccagaaaacagggatgccctcaggtccgcgtgcccttgctttggtggacttcctgctgctcccgtccagtggaagggggcagttatctctttggatgactgtttacaaactccccattttctcttctttctcctgcccaatggctgtgcttcggcacacatttaggtcatgtgcagagcgtatctcacctccagtgggagggaagtgtacaggaaagtctgcggagtgtgagaaactccaggtgtgctctccccatgctctccgctccgtgcagcctctcactccactttcttttattttctctttcccccttttttttttttgagataagagtcttgctctatcgccaggctggagtgcagtggtgctatctcggctcactgcaacctctgcctcctgggttcaagcaattctcctgcctcagctacccgagtagctgggactacaggcgcccgccaccacgccaggctaatttttgtatttttagtacagatggggtttcaccatgttggccaagatggtctttatctcttgacctcatgatccgcccgcctcagcctcccgaagtgctgggattacaggtgtaaaccactgcgcctggcattttttttttttttttttgagccagtgtctcactctgttgcccaggctggagtgcagtggtgcaacgtcagctcactgtaacctccacctcccgtgttcaagcaattctcctgcctcagtctcctgagtagctaggattacaggcacccgccaccacgcccggctaatttttgtatttttagtagagacaggtttcaccatgttggccaggctggtctcaaactcctgacctccagtgatccagctgcctcagcctcccaaagtgctgggattacaggcgtgagccactgcacccagcctcattccgttttctagttcattgatgccccttgaaacccagacttggggtccctctccctcgtgctgcccctgggcctcccagcccagcccgtgtagaccttgcctctttcctgtccctggataaacagactttctccaccagagctgaccagctcccagactcccttggcttccaacgacaatggcttcttggtggccttcactctaggccatgagttcaaacaatttctcttttggcagagaaatccatttccagcaaaagggtgggtctgtagccaagccctgactcagtttcccctctatgtccctgggccctaaatcctgaaaaccactcttcctgtcttcactcccaacctgtctcccaaggatacttttccaagagttgattctgttccagactgctcactccagctcttaacgtctttctcttccagcttctggaaagacactgtgtctctaaatcatatgattagcattttataccctatacttccctctcccatggggccctggccatgcttagagacacctcctcccattttcttgccatctccggtcactcaggcctccgtttcagggagttgtgaagccggaacatacacctcaaaggctgaacaaggcctttgctttgggctgggcaggcggcatccccacgtaggggcactcctgatctagaatcctttctaggcaaggcagtgtggccctgggaagagagcagggggcttatgatcagagtcaggccacaaatcctaattctacaacccactggttgggacttgcccccctctctctccatctccagactttaaaaagcggaaaagaatatctgtgccatgagcttgttgccaagattaagtgagttatcccatgtgaaagtgtctgcaaaccgtgagatgctgtgctggttttttctgtgaaaggcaaacagcagcatggcctggcgtcgtgcgtcttccacctacatcccatttgcaacctgaccctcattcccttctttccaccttcctttgaagaactggatggtacaagttggtgtgtacacacacacacacggctgtctccttggaaacacatgctgaggctcctagaggcatggtgccatctgccctgcacccaatgggacagccccatttcataacaggcaggatctcagtaggacttgctggggcagaggcaggggtacaggagggggccttggtgtcatcctcttggtggactgagggaaatgagccgagagtgtggactcggtgcagcctgggctctcctgagcttggcctgagtgaagggccctgtgtttgcctccatgcacagcctgggaaccagagcaaaactgagaaatcgaggagtttgctttcagggacgaggatggggagagggccttctatgtgctggatatgctagctcatttaatcctcactgcctctttctaaatggtatatttcccctgttattctggtgagaaaatgaacaaagaggcactggctaccctcagggccagtctctctcttcttccttcccaccctaggtgcccagagccttcttctctacctgccccccaccccatcccttcagagaaatgtgagaaactcattcttaccaagtgccaggcattgacggcatgtcgaggagtgatccttccagatggctaggctgctgcaggacgggctcctgacttgacagccactgtctcctgagcgtgagccaggactgtattgtgtgtgcctatgtcactatctgtgcaatggctctgcaaggaaggtatgatcatccactctacgaataaggacatcgacgctcagagagaggaaaggccacacagttgttgaaggattcaaacccagttcctcctgacaccaggctcgtgtctacccatagggtgggtacccatgtgggtaccatgtctcgggtcgtagctcttcgtcacccagccactcatcacgtgcttccagagcgtttgctatgcttggagagcccggggtgaatgaaaccaactctactcttgctcccctggtgtttggattctagaggggagagagaatctgctgtgtttaggcaggaggcggtggtggtcaggaccagcctctcccagggagaggcatttgaactgaggcctggaggcctggagggtgaggaagagccagctacccgaggaactttcaggctgtgggaagagcacctgcaaaggcccttcctgggacaggaaagaaaacgggtctgaggaataaaaggccaccatggctgcagaaagcaagcaagggggagaggggtaccaggtgaggctggagagacccgaagggcgagcacctgcagagctttgacggtcataaagaggagtgacgctctcatctccctgtctgtaaggaccctcacactcactattcttggggaagtggctggtggggagaaattaggtatccccagaacaacccaagcaggaattacagtagagttaactttgaccgagcacatgctataggccaggtggtgtcctagcactgtgcctgaatggactactttacttcggacaccacggtacagagaagttcaacaatttgtccaaggtcaccaagaaatacagttaacccttgaataccacagggattaggaatgctgccccgccatgcagtagaaaatctgcatataatttttgactccccaaaagcttaaccactaatagcttattgttgatgggaagccttacagataacatcaacagtccatgaacatatattttgtatgctatatgtattagatagtatatttttcttttttttttagacggagtctcactctgtcgcccaggctggagtgtggtggcgtgatctaggctcattgcaacctccgcctcccaggttcaagcaattctcctgcctcaacctcctgagtagctgggattatgggcgcccaccaccacgcccagataatttttgtatttttagtagagacgaggtgtcaccatcttggccaggctggtcttgaactcctgacctcatgatccacctgccttggcctcccaaagtgctgggattacagtcgtaagtcaccacgcccggactttttttttttttttttggagacggagtctccgtcacccaggctggagtgcaatggtgtggcctcggctcactgcaacctctgcctccagggttcaagcgattctcccgtctcagtctcccgagtagctgagactacaggcgcatgctaccacacccggctaatttttgtatttttagtacagacagggtttcactatgttgtccaggctggtctggaactccagacctcatgatctgcctgtctcagcctcccaaagagctgggattgcaggcatgagccaccgcgcccagcctatatactgtattcttacaacaaagtaagctacagaaaataaaatgttattaagaaaatcatggccgggcgcagtggctcacgtctgtaatcccagcacttcgggaggctgaagtgggaggagtgcttgagcccaggagtttgagaccagcctgagcaacatagtgagaccctgtctctaccaaaaaaattaaaaattagctaggcaagccaggcatggtggctcacgcctgtaatcccagcactttgggaggccgaggcaagtggatcacaaggtcaggagatcgagaccatcctggctaacatggtgcaaccctgtctctactgaaaatacaaaaaaaattagccgggcgtggtggcgggcacctgtagtcccagctactcggtaggctgaggcaggagaatggcgtgaacccaggaggcagaacttgcagtgagccgagatcgcgccactgcactccagcctggacaactgagcaagactctgtctcaaaaaaaaaaaaaaattagccaggcaaggcagtgcacacctgaaatccgagctactctggaggctggggcaggaggattgcttgagaccagcagttcaaggctgcagtgagctatgacagcatcactgcactccagcctgggggacagagcaaaactgtctcaaaaaaaaaaaaaagaaaagaaaatcataacagaatcttaactaagttgaagtggatcattgtaaaggtcttcagccttgtctccatattgagtaggctgaggaagaggaggaggtggaggaagaagaggggttgatcttgttgtttcaagggtagcagaagttgaaggggaggcaggagaggcaggcaaatttagtgtaacttttgttgaaaaaaatccacatgtaagtagactcatgcagtccaaacccctgttgttcaagggccgactaaagtggaagcaggagtcagccccagggggtctggctccagaggcccacctctgtcccctccagcacgtctttgactgcagaaaccgtggctatctggtagtggcttctgagacatcacacagggcagaggtgagggcttctctctggaaagggcactcttgagggagctctccatttgcagaccaagccctggtagcggacagaatgcaagacaaacaggaaactagcacttttgagagtactgacgaggagggcaagaatcagtaaagagcctccacccaccacttctcccctggaacacactgagaccaaggagggtacaaaccacagagcccaggcacaggtatgtgggctaaaaaggagagctgctggcaaggcttgtgcgggcagacttgccaaaggatggctcatgtttgctgttccaggttcaattgtgaatcaaacacaatgcctgttatttgatgttattaatgctccaaatgcggccgggcgtggtggcacacgcctgtaatcccagcactttgggaggccgaggcgggcggatcgcgaggtcaggagatcgaggccatgctggctaacacagtgaaaccccgtctctactataaatacaaaaaaattagccgggctacttgggaggctgagacaggagaatggtgtgaacccaggaggcagaccttgcagtgagccgagattgcgccactgcactccagcctgggcaacagagcaagactctgtctcaaaaaaaaaaaaaaaaaattgctccaaatgcatatcatttagctctgaaaggtttggttaactgtcctactagtaccaagaacaaagcaagccaacaaatatttactgatagggtggggattttttcaaaaaagagaaaaaagtatatttttactgggttattaccctgaacaaagcatcgtgccctcctgcatttgatttgcgcaaaagacacagataaccgggctttcttagagctcaatggaagaagccttatcaccctcctgctctcacacgtcccaggcccatgtcccattttcagtaagccagaaaacagagtgggactgttctactaggtgcggaatatatggccaaagagatcattatagggtatctggccaaaggctcctgtgttggagttttagctcctctaaacttcaagtttaagtaaaaataatccaaattggcaaaatggcttaatgaaaatcacttgttctgcttatgctctactgaacgaagtttttgttctgtttttgtttttttgttgttgttgagatggagtctcgctttgtggcccaggctaaagtgcagtggcgcaatctcggctcaccgcaacttccgcctcctgggttcaagtgattctcctgtctcagcctccagagtagctgggattacaggtgcctgccaccatgcccggctagttttcacagagatggggttttgccatgttggccaggctggtcttgaactgctggccttaagtgagccatccgcctcggcctcccaaagtggtgggattacaggcttgagccatcgtgccaggcctgaacaaagtttttaacttgggctagttagcaggtttctggaacagtcgtgactagaatttacagccagtcgtccagctttggaaaatggacatttcacatccaatcttgtctgtagcttagactctaaacccaccctcaggcccacagccttgtcctcacacacaaaataactactcctgacccaacacagcttgaacggaaggggaagggtgggtacccacccactccacactgcacaccgtgccaggcgggcacttggcattgcacatcacaggtcatcctcacaaccatcctgtgaggcgggcgtatccatctctgtttccaaggcgaaaataactgaggtttagacaggagaagtcgcttgcccatggccatgtggctgggtcagaaactgaggaaggcctccccacaaagtcactgctgccccaggacccatgcttccctaaagaaaccagtgtggtcttgtttcttgtttttggttttttggagacagggtctctctctgtcacctgggctggagagcagtgtggtacaatcacagctcactgcagccttgatctcctgggctcaagcaatcctcccacctcagcctcctgagtagctagggtacaggcgcaccaccacactcagctaatttttttttctttgaaaaaacagaacgcttcacgaatctgcatgtcatccttgcacaggggacatgcgaatcttctctgtatcattccaattttagtatttgcgctgctgaggcaagcacatcaggctaattgtttactgtttgtagagatgaggtctcactatgttgcccaggctgggctactgttccacaccatacctttatttttctctttctcttttttccccctgaaaagcctctctaatctctcagcctttaaagtcttaatcgtgtaataacatgttcttcttatggggtttatttctttgtcgggctcacaaactatggaaattagctaactagttctcccaacgtttattcctccactaagacggggcaaggtcacaccaatattcccactttagtgataggagacagaggtagagagaggctgctgtggtggagaatgaagaggagaacataatagctcccacctccaggatggcactgtttaatgctgtaaactgatgtagctaacccctcacagctggcaattaagcacgatagagaacgtgtttgcaacgctcctgcagtatttgtgacacatcatctaccctctggttatccaggggaaaaaactctctctggggagtgtcagtacatgaacaccaagttctggaggcttaacccgctggtctcacttctcaccagcgtcacttgcctgttagggtagctgctccaggctgggagatgagtggagtaggcattattcgttttggataactacagctaaaaaaagaaaatctaaatctttacttcctcttactacatcccatctttctcataaacacgtgttagaaccttccactgttatcattaatcattgtctaatactttgagaatgggtttttcttcccagcaataatgtcgtattagccatgagactatataggtatgattctaagccatcaagtctcctcatggccaaactagcaggttttttaaaaagcttccttagcttcctttttttttttttttttttttgagacagagtctcattctgtcccacaggctggagtgcagtggcacgatctcggctcactgcaacctccgcctcccacgttcaagcaattctcctgcctcagcctcccgagtagctgggattacaggcactcgccaccacgcccagctaacttttgccttttttttttttttttttttgagagggagtctcgctctgtcgctcaggctggagtgcagtggcgtgatctcggctcactgcaagctccgcctcccgggttcacgccattctcctgcttcaacctcccgagttgctgggactacaggtgcccgccaccacacccagctaattttttgtattttttagtagagacagggtttcactgtcagccagtatggtctcgatctcctgatcttgtgatcctcccggctcggcctcccaaagtgctgggattacaggcgtgagccactgtgcccggctatattcttaatagagacagggtttcaccacgttggccaggctggtctcgaactcctgacctcaggtgatccgcctgcctcagcctcccaaagtgctgggattacatgggtgagccaccacgcccagccctgtattggtttaatcagtttccttggaatgtcctttgtctaggttagcttcccctaaaggtgtttaagtttcgccacacacagaattctcactaacaattctacaacacaacaaattttctgtacacaattaactattttcactacagagagtgacacaggcaccacactaacctctgggataatggatatgccaaccagttttagtaaaattatgaaaactaaatttgttgaaggtttgcaactgtgcgcctacgcaaattggctcacagaaaccccgtaaggtaggccaggcgcggtggctcacgcctgtaatcccagcactttgggagacgcgggtggatcacctgaggtcaggagttcgagaccagcctggccaatgtggtaaaaccccgtctctatagaaaatacaaaaaattaggcgggcacggtggcgggctcctgtagtcccagctactccggaggctgaggcaggagaatggcgggaagccgggaggcagcgcttgcagtgaaccgagatcccgccatttgcactccagcctgggctacagagtgagactctgtctcggaaaaaagaaaaaaaaaattagccgtacgtggtggtgcacgcctgcaatcccagctactcaggaggctgaggcaggagaatcgcttgaactcaggaggcagaggttgcagtgagccgagatcccgccattgcactccagcctgggcaacaagggcaaaactccgtctcaaaaacaaaaaacaaaaaacaaaaacaccataaggtagagcctgccctaactccatttggcataaaaggaaaaaacgctgggtgcggtggctcacgcctgtaatcccagcactttgggatgccgaggcgggtggatcaccggaggtcaggagttcgagaccagcctgaccaacatggagaaaccccgtctctaccaaaaatacaaaattaaccccgtctctactaaaaatacaaaattagccgggcgtggtgacgcatgcctgtaatcccagctattcgggaagctgaggcaggagaatcgcttgaacctgggaggcggaggttgcggtgagccgagatcgcgccattgcactccagcctgggcaacaacagcaaaactccgtctcaaaaaaaaaaaaaagaaaaaaagaaaagaaaagaaaagaaaataaaaagaaaaggaggcctgaaaaggtaaagcaatcgaggcatcagattcagaaaatgactgaggttcaattacagtggcagtgagagcttgaattttggaatcagacctatcatcctgtctctaccaccacccaaagtccttcaaatctcttgctttccaggcctggtcagctacccaacttctttttcctccttaccccgccgcaaaattatttttatttatttatttttttgacatggagtctccctctgtcgcccaggcttgactgcagtggcgcgatctcggctccctgaaacctccacctcccaggttcaaaccgattctcgtgcctcagcttccccagtacctgggattacaggcgccagccaccatgcccgtctaattatttctgtacttacagtagtgtcggagtttcgccctgttggccaggctggtctcgaactcctgacctcaggtgatccgccacctctgcctcccaaagtgccgggattacaggcgtgagtcaccaagcccagccccagcaaaattctgattgcatcagcttgataacttttagctggctgtgggtgtctggatcatgcatctaccccctgaaccaaggactatcactataccacccccccaacccctcctgctagaagggctgggccactgtagggatgctggataaacaagccaagctctctgccttccgggagttaagcggggagtctaatgttgcctgggtttgcagcggagtctgatctgtactataaagaggtacaaagttctgagcgctgtttaggagcagctttccatttgtgtaccgcgccacatattacatttttacggatttctgcggaactcccggggaggctttatattttaagagaggaggtggttctcccacaaaacgtggcatcggtacctggtgtcaaggaggtttttgttttctaggtaaaagaagggagagttctagaaaggaaaagaatttcacatctgtttgggactgtggagattctctagcccaacctcttaattttatggccgaggaaacaagctccagtgaagcaaccggactttcccaaggtcataagctagtaagtgggagggcggaaacatgtactcgggccctggctcaggtcagagcttcaggaatgctccctccacgctagtgttgatctggatgcgtgggcaacccgacaccccgctctagggcggccaagcctgctcaggccatccctacgacttggcaggtcgcggtccccggccctgccctcaggcgacctctgggtcgcgtgggagcagaagtgcgggctaagctcagcgtccctgccccgcgaccctgggcagagtccccagaacaaaaagacccgtccctcccttcccctcccgccccgccacagccccgcacgtgcggcgcctcgtgcaccgccccgggccccgcccccgccctccattggctgttcccgcgccttcctcctctgccccctccccccgcgaccagactcggctgcggctccacgtgacccgcggggggtggacacgccgcgcgagcaggagctcggataggtcgctttggccggcctggccgctccgagctccgcccctcttcggtggcgcgtcgggaaggttgcaagtcggggacaagagggagaggctgcggtggttggggagggcgggggttatgaagagggcggtgaagggggaacactggtaggagggaagggaccgcgccgaggaaggcccaccacaaagactccagcaggcgccaatcaggggacacaggggcggcggggcggggcctccgcgagggtcctcacctggccccgcacgtgtctatcttatcccggctgcccgaccaatcacggcccgaggatctgcgcctgcccctctcgcaggctggaccaatccagagcaacgatccggggaagctggcctggcctcatgaataattaatgtgccagagccggtccgcaggcggggtagcgatggaaggaggcgggggcgccattgggcgcctgcgcagtagctgcccgtgtcggcagctgcagcgggtcgcacggctccggcccatctcggggggcgggcgggggaggcgaggtgcgcgagccgagtccggggcacgatgtccgacgcgggcggcggaaagaagccgcctgtggacccgcaggcaggacccggtccggggccggggcgcgcagctggggaaaggggcctgtcggggtccttccccctggtcctgaagaagctgatggagaaccccccgcgcgaggcgcgcctcggtgagggcgggggggtggtccgcgcgggctgggggcggggcttatacaggggcggggcctcgtgagggcggggccggggaggcagtgggtcagggagcagtggtccagcggagggggatggggcctggatgaccaggagcctggaggacgaggccggggggctgaggacagagggtcaggggcgggctgagacggtgggtctggcgggagagggtggggagaggttttgaggaggcggaaggggatcgggagcagtcacttaaatgacgctccagggcccctcccccggggccacctgcatcggagtcactcgggatgcctgtttaaattgctggttcctgcgccccacccaatctgcggtcactgggacaggggtcttgcattttaaggagcaccccaccgcacccccattattttccaagtacaccaaagtttaggaagcgcaggcctagggtagcgaactgtcatcgtacgtggccttacccctcccggagggacctggcttcctccctgggtgtgagtagcgccagctactaggtccaacgggagcctttctgttgcggggcttctgctgagcgggtggggggggtgtgggcgagtagtgtgaggcgccttgggaggggagttttgggccaagcagagaaacgatgagggtcagatgagtccactgaggcccttcgcctggttggttggggctgacccttagattctggggccacggcggcaggactgagcttcatctttttgcctaggccaggaacgtcactggggcgtatacggaaagcaggtctggccttgtttttcgccctgggagatggggtgcagggagcagcaggagggccgcctgtggtggggttgtgggtgcactgaggtatactttgagtgtgagacctttgcatttccaagagccatcagttattcagggtttgggaaagggataggccttcgagagttgtctggcctggggaatggattttcctttttaaaatgccatttctcttcctttcctgggtgtatgctgaggctcccatccctgtggctgtcactgttgagttataaatagcttcagcacatcaggtgaggccagcctctctcctcctgctttgggacctcatgtgcacaaacccttttgtttgtttttgagacggtgctttgttccaaatctggggctgagacaagctgcagggacaggtgtacacatctgacagtttcttgtttgaaattaccaggtaataaccatccataacaagaattctacccgatattcgtagagtgctcgcaaagcacgctgacatcatcttatttcattaacagtcctagagggtattctcccctcttcccagatgaggaaaattgaggctcagggaggtgagggtgcttcctcaaggtcacacagctataacttttgaccctcagtttggtgctctttctactgtatcatgctggcagccactgttgcatgacctgagtgatggactagtcctttatctcttacaatttaaaattccaccttacaaaaacactgatttaaagtatcctttattgcttaggccaggcaaaacctggaacttattgttgcctgtctttcactatggctgcttttctatctcctgccttctcctgcctcctttgatcccaaatgaccccacccgacatgggtcacagtcatttctgaacagagtgaggagtccagatctcaagggaggagagcaggaaggccatctggcccacccagcccaccaaggcttgactttcttacttctcagttggttttaaaccaaagcctggtatagaaagcagttgcaggaattcagattaatttgtattagaaagccatgaccaagttgtttgtcaaaacctccaccttcttaactcactgggtgtgttcatttttattggaccaacaagctgctatttggtctgggagtccatgtgtggctggtttatttccaacttaatcatatttgatttctccttttcacttataaatccagagttcaaaattgtctccctcaattttgaaaacccatcatgagcttgtcatgattttatctcccacttccctgattagcctccctgtcactttgatttccttccaaccttgtcacattgctctcttctctttttttaattgccctctcttggatatccacatgtgtaactttgtgactgagacaattgggtagatccagtccccactaattgattagttttcctttgaataggagcagtctttcttcttcaactccacccctctccttcctcccagaaaacctgccttcagtcttttctgcttattcaggaataaaggtctcttgaaatggttgctctgaaaagggtcctgaaaagacagctccaggccctttctaataaacctaacctgaatctgtttgcaaatccaatattctacagttagtatatatattttcccatagtccaccgtctgcctaccccttgttgggcccttgagatctggaaataaatcagttcatactttcagtgagcccacagtaacaatgatgcctacagtgtgccaggaacactgtaaagacactttttttttctttcgagacagactttcgccctcgttgtccaggctggagtgtagtggtacagtctcgtctcattacaaacctccgcctccaaggttcaagcaattctcctgcctcagcctcccaagtagctgggattacaggcatgcaccactattcctgactgattttttgtatttttagtagagacggggtttcaccatgttggtcagactggtctcaaactcctgacctcaggtgatttgcccgcctcggactcccaaagtgctaggatacaggcgtgatcccactgcgcatggctgtaaagacactttcaaatgttatctctggccaggccctgtggcttatgcctgtaatcccagcactttgggaggccaaggtggatggatcacctgaggtcgggagttcaagacaagcctgaccaacatggagaaaccctgtctctactaaaacaaaattagccgggcatggtagcgcatgcctgtaatcccagctacttgggaggctgaggcaggagaatcgcttgaacacgggaggcgaaggttgtggtgagctgagaccgcgccattgcactccagtctgggcaacaagagcgaaactccttctcataaaaaaaaaaaagttatttctaatcttcaccaaagaaacatctttatccttatgtacagtggaggataccaaggctcagagaggttaagtaacatggctaaggtcacacatcaaacagcaagtggcaaaaatgggactcctccctgggctgggttgctgtggagaagcataactggagggaacaggacaggggaacacagaagttcttggcctgaagatctcagccctttctaagctaaggtatcaggaaaggtcagagactccatttccctccttgtagtctctctcctgcagatgctaatcctacagcctattctgtttttgtttttgtttttttgtgacggagtttcactctttgtggcccagacttggggtacagtggcatgatcttggctcactgcaacctctgcctgtcaggttcaagtgattctcctgtctcagcctcctgagtagctgggattacaggcgcccaccaccacacccaactaatttttgtatttttagtaaagacagggtttcaccatgttggccaggctggtctcaaactcctgacctcaggtgatccacccgcctcagcctcccaaagtgctgggattacaggtgtgagccaccgcccccggtacctggctaatttttgtatttttaggagagacagggtttcatcatgttggcctggctggtctcaaactcctgacctcgggatccactcgcctgggcctctcaaagtactgggattgcaatcctgacccccccgcacctggccagtgctacaggctattctgaattaaccctgtggccaggtgcagtggctcacgcctgtaatcccatcactttgggaggccaaggcaggtggatcacctgaggtcagaagttcgaaaccagtctggccaacatgttgaaaccccagtctctactaaatacaaaaaaaattaatcaggcgtggtgccgcatgcctataatcccagctacttgggaggctgaggcaggagaatcgcttgaaccagggaggcggaggttgcagtgagcctagattgtgccattgcactccagcctgggcaacagagcgaagctccatctcaaaaaaaaaaataaaacaggctgggcgtggtggctcatgcctgtaatcccagtactttgggaggctgaggcgggtggatcacctgaggtcaggagtttgagaccagtctggccaacatggtgaaactccgtctctactaaaaatacaaaaaattagctggtcatggtggcaggctcctgtaatcccagtttactggggagactgagacaggagaattgcttgaacccaggaggcagaggttgcagtgagccaagattgcgccattgtaagccagccgaagcaacaaaagtgaaactctgtctcaaataaataaataaaataaaataaaacaggccaggcatagtggctcatgcctgtaatcccagcactttggtgggtggatcacctgagctcaggagttcgagaccagcctggccaacatagtaaaaccccatctctactaaaaatacaaaaaatagctgggcatggtggtgcgtacctgtaatcccagctactcgggagtctgaggcacaagaatcgcttgaacccaggaggtggaggttgcagcgagccgaaattgggtcactgcactccagcctgggcgacgagcaaaatactgtctcaaaataataaaaactaaaataaaattaaataatgaattaaccctatgaccgcttaaggtctcagagtatgtggtaagccttctgggaaggccaggcatggatgaggatgggatgccgtgtctaaaggaaaacagccggcctggttcaagtgcgagattcgaactggagaatagagtaggttcttgaaatgcatgggttggaatcggggctctgagaaagatgggccaggcctgtgaggctcactgcccacttcctgggattgagttactctcctgtgtggtatttcatcgcagattttgtttctgcagataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacaggttggtgaaaggccatcgaggagggccacctgtcccatccagggaagtccatttcccactgagggctgcttgtgtccatgtacccagtgagtcccttctctgaggggaggtcctggtggggctgcagtgtggagaaactcttcactccccacccttccacacagttccccgaggctggagataaaaatagtggtcatgtcactggcagttggaacccttctgttggttgctgtgctgcaaacagtcaggacaggaccttccaggccacggcattacaggatagaaatcccattctgcatttcctcaatgctgctcttttttttttttttttttttttttttttttttgagaaggagtctcgctctgttgcccaggctggagtgcagtggagcaatctcggctcactgccacctccacctcctgggttcaatcaattctctgcctcagcctcctgagtagctgggattacaggcaccagccaccacgcctggctaatttttttattttttagtagagacagagtttcatcatgttggccaggctggtctcgaactcctaacctctggtgatctgcccgcctcagcctcccaaagtgctgggattacaggcgtaagctaccacgcacagccttaatttttgtatttttagtagagacggggttttgccatatttgtcaggctggtcttggctcactgcaacctccatctcccggattgaagcgatttttatttttagtagagatggggttttgccatatttgtcaggctggtcttgaactcctgacctcaggtgatcgacctacgttggcctcccaaagtggggaatgctttctttgtgccagggcataagcactattcaagtgctacctccattacctactagcctgggcaacagagtgagacgccatctcaaaaaaaaaaaaaaaagaaagcattcccaccacctggccaggacaaacatcatcttcagagtctgtccttattcctcctccttttacattttatctctgggggtttgttttcatgctccttggacacgaacctaccaaaggagacatggctcctgttgcaggggttctgcaaagctttctgcagtctctgaggcatacaggctgatagctcctgccagtcggtatgtcaccccaggaatccacacccaataagttctcatactctatttttttttctttttattgtggaaattttttcaaacaaaatacaaaagtaagagacgactataatgaacctctatgtaaccgtcacccagcttcaacaattctcaactcagaagcagttattttcaatcaaattataagtatttcaatatgtatctaaaatataagggttcttttaaaaaaaacataacgaaaatactagttttacatctaaagttgacaataaatccatcaacattcagatttccaaagttgtctcataaatggtattttacaggccgggcgcagtggctcacgtctgtaatcccagcactttgggaggccgaggtgggtggatcacgaggtcaggagattgagaccatcctggttaacacggtgaaaccccatctctactaaaaagtacaaaaaattagccgggtgtggtggcgggtgcctatagtgccaactactcgggaggctgaggcaggagaatggcgtgaacccaggaggcagagcttgcagtgaaccgagattgcaccactgcactccagcctgggcgacagagcaagactccatctcaaagaaaaaaaaagatcgagaccatcctggccaacatggtgaaacctcgactctactaaaaatacaaaaattagctgggcatggtggtgcgtgtctgtaatcccagctacttggaggctgaggcaggaaaatcgcttgaacccgggaggcggaggttgcagtgagccgagatggcgccactgcactccagcctggtgacagagcaagactccatctcaaaataaataaataaaagttttttttttttttctgtagagtcagggtatcactgtgttgccctggctggtttcaaattcatggcctcaaacagtcctcccacctgggcctcccgaagtgttggttgaaattacaggcatgagccactacacccagccgctttgttaagtttcattgctgaatagtagtcaattgtactaacgtaccacagcttatccatttaaccgttgaaggacattctgattttggttatgaataatgctgccatgaacattcatgtgcatgtctttttttttttttgagacggagtcttgcttttgtcgcccaggctggagtgcagtggcggggtctcagctcactgcaacctccgcctcctgggtttaagcgattctcctgcctcagcctcccaggtagctggtattacaggtgtgcgccaccactcctggcttatttttgtagagatggggttttgccatgttggccaggttggtctcaaactcctgacctcaggtgatccacctgcctcaccttccaaagttctgggattacaagtgtgagccactgtgcctggcccatctacatgttttttggtaaatatatatatgcgtttcttttgggcatttgcttaggaagagaatggctaggtcattggacatgcatatgttcagtttgtgtagaccctgccaaatagcgtacaaagttgttatatccatttgtactcacaccagcagggcattggagttccattgtcagcctttgattttgacatcttttgtaatggtggacctatgagagaattatatttcaggcaagttaccaacagatctattccctttccctcttcttccagcaaagtcattttaaggtctcattgtcatctttttttttttttttttttttttttgagatggagtctcactctgtcacccagactggagtgcagtggtgcgatctcggctcccgcaacctccgcctcgcaggttcaagttctcctgcctcagcctcctgagtagctgggaatacaggcgcccaccaccacacctggctaatttttgtattttcagtagagacagggtttcaccgtgttggccaggctggtcttgaactcctcacctcaggtgatccacctgcctcggaaagtgctgggattacaggcgtgagccactgcgctcagccctcattgtcattttctagaatttgttcatagaggtatccatggggaaatgagaattcctcaaaatcttgtccccaggcctctttgcaaattttccccttttgtttcctgcggctttctcttatcctgtccctgaaacttaaccacatcttgccacttggttgttgctgaagggcacccaggcatggcgtcactttgaacaacattctcatgtggtaggtacctgagctgcttgtcttgcaggtactaggtttggcatgcccgaaactgcctacagttaccatgtgggtccctggtcattcactcctctgacactcagatgtctctgtaattaacccctgtctaataggatacaatgaatttatgtgcataatccaattaaagcctaagtctgatcatgccacacctctgcccagagccctccaggtgttctatctcaggataaaagtcagaatcagcagcaccattgacatttagaccagatgattttttgttggggttggaggcgtgactgacctatgcattgcaggatcttcttttcttttttttttttttaagacagtcttattctgtcacccaggctggagtgcagtggtgtgatctcagctcgctgcgacctctgcctcccgggttcaagcgagtctcctgcctcagccccctgagtagctgggataacaggcacggccggctactttttgtatttttagtagagacggggtttcatcgtattggtcaggctggtctcgaactcctgacctcaggtgatccacccacctcagcctctcaaagtgccgggattacaggcatgagccaccacaccaggccggcatctgacttttttttttttttttgagagggagtctcactctgtcgccaggctggagtgcagtggcaccatcttggctcactgcaatctctgcctactgggtttaagcaattctcctgcctcagtctcctgagtagctgggactacaggcgcatgccatcacgcccagctaattttcgtatttttagtagagacggggtttcaccatgttggccaggatggtctcgatctcttgacctcgtgatccacacgcctcggcctcccagagtgctgagattacaggtgtgcaccaccacgcctggcccatctgacatttttatatatcgtttgtatttatcttgtgtaatgcagctttccccactagaataacatttcatgcaggcagggatttttagctgtttgttaactgttttgtctttgccaggacagaacctggcatataacaggtattcaataagtatctgttgactgaataattattttgtatactcctatcagtagcattgaatgagctggccaaaggtatagtttttcttaatataactcttatctctaataacacacaaccttagaattctagaggtggttttaacccaatcggtgtccactattaaatggcagccaggtggggcagggaagaacaaggaatcagccagccagactaagtttcaaattttagttcaattgcttatcatctgtgtgactctgggaaaaccattttatttctctgagcgttagtttcttcatctgtaaactagttgtcataagactaaatggggccgggcgcagtggctcacacctgtaatcccagcactttgggaggccgaggcaggtggatcaccaagtcaggagattgagaccatcctggccaacatagtgaaaccccgtctctactaaaaatacaaaaattagccgagcatggtagtgggcgccagtagtcccagctacttgggaggctgaggcaggagaatagcttgaacccaggaggtcaaggttgcagtgagctgagatcacgccactacactccaccctgggaaacagagtgagactcttcaaaaaaaaaaaaaaaaaaaaaaaagactaagtgactagatggcacagtaacagacatgtctcagggactcaaaagtggaacccgggctggacgtggtggctcacacctgtaatcccagcattttgggaggccgaggcgggtggatcacttgagctcagcagttcaagaccagcctggccaacatggtgaaaccctgtctctactaaaaatacaaaaactagccaggcgtggtggcttatgcctgttgtctccactactcgggaggctgagtcgggaatcggttgaacccgggaagtggaggctgcagtgagccaagattgcaccagtgcactctaccctgagtgacagagcaagactcagtctcaaaagaaaaagaaaagtggagcctggccaggtgcagtggctcacacctgtaatcccagcactttcagaggctgaagcaggaagatcacttgagcctaggagtttgagaccagccctggcaacataatgaaaccctgtctctaaaaaataaaaaaaaattagccaggcgtgttggtgtgcatccgcggtcccagctactcaggaggctgaggcaagaggatcactccagcccagaaggtcgagggtgcagtgagccatgatcataccactatactccagcctaggtgacagagcaagaccctgtctcaaaaaaaaaaaaaaaaaattggaacccatttccattcttcagtctgtgtctgcctggagagacacagctgtttctcattactggagatcttgaaatcacaggaagttaagggaatataaaaatttaatgttttaggctgggcgcagtggctcatgcctgtaatcccagcactttgggaggccaaggcaggcggatcacaaggtcaggagatcaagaccatcctggctaacacagtaaaacctcatctctactaaaaatacaaaaaaattagccaggcttggtggcgggcacctgcggtggcaggcgcctgtagtcccagctactcaggaggctgaggcaggagagtggcatgaacccgggaggcggagcttgcaatgagccgagattgcgccactgcactccagcctgggcgacagagcaagactcccatctcaaaaaaaaaaaaaaaaaaaaattaatgttttgcttaacatttctggagggggtggaaacaattggaaaaccctgtctttttctagggcttctgtttccttttgagcattctgttcctgaaggaaagaattctttgaatgtttgtgttgtggaattgaaccgtgtgccagtctggcttaggggctggtactgttggggttttcttctccccaggcggcagtggcttatgcagccttgaggttcaaccaggtgtctgggtgtgtggcgtgggtcttctctgtccagtgggctgcttcgggaccacctgtctctgtgtcttttagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggtaacctggtattccttataaataaagatgcagcgttggttcaagggcctaggggatatggctcctcgcatttgattttatctggagagccttccctccttgtgacaccatttggaaagacatgagtttagtgcttaaagccatatccttcagcagtttggtagaaagaaagggagtcacgtggcatttggccccagtgtgactccctgtagtttctctccttccccgggccatcggctgtgttgatgttcctgcctccctggctgtagcccagccactgggcaagagctcactaggccacaggaactggggttgaaaaagtccttgctttgaaggacaaagggtttcttgtatgttgccatccccagggatgagcaagcagctttcaagctggtggtgctgttaggaactggtgggaagagagaattttgcagttttccatcctttcctatgaaaaacttacagcaaggatttttcatccaaatctttggagtcaggcacacctgggtccaaactccatgttgccacttgtggcctagctgtgcctcaagttcctcatctgtaaaacgggagcaactgaacctccctcccggggaggtttgtgagactttaataatgatgtgatgatcatggtgaatatttagatggtactcactgtaggccaggcactgatttttgttttgtttgtttttgttttgttttgtttttgagacagagtctcactttgtcacccaggctggagtgcagtggcgtgatctcggctcactgcaacttccgcctcccaggttcaaccgattcttgtgcctcaccctcctgagtagctgagattacagatgtgcaccaccacgccggctaatttttgtattcttagtagagatggggtttcatcatattggccaggctggtcttaaactcctcacctcaagtgatccacctgcctcagcctcccaaaatgctgggattacaggtgtgagccaccatgcctggcctgttatttctcagtgtaaagataagggacctgtgatattgaggggttaaagtacttgcacagtttcactgctagtaatcttggagagccaagatctgaactcggggatctaggcccttacccacaaccaacatgcctaagtaaggcaagggtgtggacagtgcaatgctttgtgctggagcagcaggtaccaggcctccaggagatgagtctccttctcttcaccatgtaacgtaccaaataacttttgtttctcgtcctgcccccgaggaaagggcagtgccctcaatgtgccctggtttgtgctgctccctccctggtatccctgctttagctctggccacaccagatgagttaggggaatccaggtggtgggagtggaaaaattgggttctctcgtggggaaagacgagagactcacagagggcacttccccacaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcagctcccgcaccccttttcccttatggctctgaggccatcggctgtctctgcatttcattggctgtggaggagagactcctaggatggctgctgtctgagccatgagtgccagggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccaggggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgc

SEQ ID NO: 16767 - DNA, 44477 bp, Human
ctcaggaactttgagaactgggagagttacactctgtctagagcttcagttttctcatctctgtgctgggaagggtggtaatgatgcccacttcccttgtggtggtgaagattaaatgagctgtgtgtaaaaggatatggcatgatctgttaattaattaattaatttatttatttatttagagacggagtttcgctcttgttgcccaggctggagtgcaatggtgcgtctcggctcactgcaacctccgcctcccgggttcaagcgattcttctgcctcagcctcccgagtagctgggattccaggcatgcgtcaccatgcccagctaattttatatttttagtagagacggggtttctccattttggtcaggctggtctcaaactcctgacctcaggtgatccgcccgcctcggcctcccaaagtgctgggattacaggtgtgagccactgcgcccagcctgcatgatctgtttaactttttttttttttcttttttcagtttttgagacaaggtcttgctctgtcgccagggctgaaatgcagtggtgcaatcacggctcactgcagcctcaagctcccaggctccagatcctcctgcctcaggcccttagctgagactacaggcttgcaccatcacgtccaactaatttttgtattttttgtcgagacagggtttgaccatgttgcccaggctggtctcacactctctcgcctataatcccaacactttgggaggccaagatgggcaacaagagtgaaactccatctcaaaaaaaaaaacaaaaaaaaaaaacgctgtttgtgtttttatgcttaaattcacacctacagaaaagttgcaaaaatgttcaaagaactcccatattcttcaaccagattaactgattaacattttgccacatttgtgtctctgctttctctatgtatatgtataggtatatttcttttaaccataaaggttgcagacatcatgtcctttttgtccctaattatttcagcatttttttccaagaacaagggcagtctcttacataaccctgtaccataatcaaaattaataaatttaacattgatacaatactattatctaatatagtcaagttttgctgtttcagtattgtcctttatagcaatccccacccaggatccgatccaggaccatgtcttgcattcagttgtctttttcgtttcctgtaatcggcaacagttcctcagtttttctttgtcttacataatacagacatttccggaagggtacagatcagttattctgtaccatgtccctcagcttgggtttctcatgattagactaaggtcatgcattatagaccggacggtgacgccgtgtttttctcagtgcatcacacagaaagcgtgcgatgaatgtcagcttgtcctgctgttgatgttaacgtggccgttcaagtggtgtctgcggagcttctctacgatagttactatttcccctttttaattatcaggtaatttgtgcatatttatgtggaagccttcgaatgccctttcagtttcatgggacggaaaagagtcttttctttcgggaaatggatacctgtgtcttgcccaagagacccagcagccagcagtacctgttatcaacaaagttacgcgaacaaaacctttccggaagagctgagggacctgggtgcaacgcattctgggaattgtagtctctgggcgctcccggctgaacacctccctgcggtctctgcgagaaagagccagaagccaccaggggagggcgaagaggagggcggtggaggacgctctgcgcgcggtgcgccatgggacgggtagttcgcggtgcgcgccccatcgcgctcccagatggggaaccggactactctacccgagaggccgcgcgagcggggcgagggcaagccggccggggcctcgaacaaatcaaatcgaagcaaagaaactgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacggtagagtcagggtccctttcctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatgtgagtcactgctgacgctttgcaggagcatgcatctcacctcagaaagtctctgacgttgctgcggagcggggagaggatgtttctctattagccctttgcttttgctctggcgctgatcctttgctgaccttggacaaatcaatttacgtttctgtgctccagtttcttggtttataaagtgagtgtggaggggtgcatctctgtctcgctctctcttggactgaggaatgggcccccgttcagctgagaagttctgtccctattctatctggaggcttcaccaccaccttttaccctcaaattgtcccatctcagaactgcaagagatgctggggtttcaggttaatttttttgttggtttttctttaaatttttttatctttttagagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacaggtgtgagttattgcactgggctggtttctggttaatttattttttgaaacagggtctccagaagtacagcagcaagatctcagctcactgtagcctccacctacggggctcaagtgatcctcccaccttacatcccaggtagctgggactgcaggcacctgccaccacacccagctagtttttgtatttttagtggagacagggtttcggcatactgcccaggctggtttctaactcctgtgctcaatcgatccgcccacctcagcctccggaaatgctgggattgcaggagtgaaccattacacccgactctggttaattttttttttttttgagacggagtttcactcttgttgcccacgttggagtgcaatgccacgatctcagctcaccccaacatctgcctcccagattcaagcgattctcctgcctcagcctcctgagtagctgggattacaggcatgtgccaccacgcccggttaattttgtatttttggtagagacagggtttctccatgttggccagggtggtctcgaactcccgacctcaggtaatccacccacctcagcctcccaaagtgctgagattataggcgtgagctaccgcacccggcctggttaatttttattttattttattttattttatttttttgaggtgagtctcgctctgttgcccaggctggagtgcagtggcgcaatctcagctcactgcaagctccacctaccgggttcatgccattctcttgcctcagcctcccgagtagctgggactacaggcccccgccaccaggcccggctaattttttgtatttttagtggagacgggtttcaccgtgttagccaggatggtctcgatctcctgacctcgtgatccgcccacctcagcctcccaaagtactaggattataggtgtgagcctttgcgcccggccctggcctggttaatttttatgcaatttcaactggtcgtttcttgagcaccttctaaatgccaggctctatgtggcaagtagagtgatcctgtcaaaatgtacgtcagatgacatctgctttctgctaaaaacttcagtggttttccttgtcacttatagcgaaagccactgttcttcaaatgggctttatgacttgggccccttgttaactgtctcttctcttaccttgtttttttcctctctctctgtgcttcagccccactggccctgttgcagtttctccaaccctctgcccctacaagagccattgcatttgctattccctttgcaggaatcatgttcccccagatgtgtgcatggcccaatccctgatatctttatttaactatttcctaataatgcctttttgttgttgttgttaatgcctttttgttgttgttgttgttatttgtttgttttgagttggagtcttgctctgtcgccaggctggaatgcaatggcgcgatcttggctcactgcaacctccgcctcccgggttcaagcaattctcctgcctcaacctcccgagtagctgggactaaaggcgtgtgccaccacgcccagctaatttttgtatttttagtagagacggggtttcaccatgttggcctggctggtcttgaactcctgacctcgtgatccacctgcctcggtctcccaaagtgctgagattacagccgtgaaccaccactcccggccccccaaccccccccttttttttttaaatcacatactaaatgtgtcatttagaacatatgcttcaagaggtcagggtttatgcttcctttactgctatactgctgacctggaacaacatccagcacacagtagtaatcaatgtgtttttgaatgaatgagtggacaccttacccaggataataattcatgcttattgataaaggcagacaaaccagggttataagttagaacccagaggaagcctaggggtgggaggattcagggtatcacaactgtatctgagaatgaggaggttgtaggaggaggcctttcggatagcaccccctagttctgcccctcatatctgcttccttggtctctcctgattacttgctgtttcttttctttttttggagcatctcacagatacgtttattcataccacaaagtaaacactattcaggtatgtagtgatgttccacgttcctgtctaatatagctggcttcaatttataggcagtacacattgagacatttaatctcacatgtactccaagtaaagctggagtaccatgagcaggcgcaggagttctcaaagctttacttgttttaaaaattttcatttattggccaagcgtggtggctcatgcgtgtaatcccagcactttgggaggctgaggcgagtggatcacgaggtcaggagatcgagaccatcctggctaacacacggtgaaaccctgtctctactaaaaatacaaaaaaattagctggacatggtggtgggtgcctgtaatcccagctactcaggaggctgaggcaggagaatgacatgaaccttggaggcggagcttgcagtgagcccagatggcgccactgtgctccagcctgggcgactgagcgaggctccgtctcaaaaaaaaaaaattctttcatttatttagttacttttagagatagagcctcccgctgttgcccaggctggagtgcagtggcagtcatagcttactgcagctttgaactcctgggctcaaatgatcctcctgcctcagcctctccagtagctgggactgactacaggcacgtgccaccacacccagctaatttttatttttatttttatttttttgagacagggttttactctgtcacccaggctagagtgcagtggtgagatcatggctcactgtagcctctgtctccggggctcaatcaatcctcccacctcagcctccccagtggctgggattactggtgcacaccaccataccctgctaattgtatttatttttagtagagatgggattttgccatgttgcccagactggtcttgagctgctgggctcaagcgatcttcccatcacagcttcccaatgtgctgggattacaggtgtgagccactgtacctggccagctttacttcttttaccagcactcctgattttataaatagtgaggcttatcaaccccatttctacccaaatcttctggtagacttgagtatagtagggcttcataggtagcagccctgtccctgtcctattatgatggtagctgttgtgatgtggcgatctctgatctagaaacccctgaggggccattgtggcctgcccagtctcccggccacggttgaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcaggtgtgtgcttgggccagactctgcagcctttggtttgggacttgactgccattcactgaaggggcccaggaaatgggcagctcacatggtgttgctgggtgtccagctgcggcagtttagcagaggaggacttgtaatgagatggtagcttcttataggctaagacatgatttttctgttcttttactacctcctgcaccttctagaactgttccttctctgatgctgttttcctttcttccagtgatttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatggtgagtttctggaagttgtgcactggtgtgtccaggggaggagagggagtgtactgaactcttactggttgtcaggctctttctgctacattgtctccattatttgtcccagcagctctgtgaggtatcattgggcctattctaacaatgaggctcagagatcatttgcccaggagcaagctcccctgcactttccatgtttgtattgggcatccctttgtgccctgccctttctttctcaggaggggatgataggtaatgaggggccacagttagtgccagtcccaagatacagcctctgactctgacttaatatccggtgttgtccccacccttgcccttaacccccatgatcccaggcaggcctgggaatagctgcagctttccccagagctgaggctctggtggagctgcattaaaacaacctgggccctcttgggagatgctggttcatgcaaccagatgtacctgggagagggatggctgtctgtgtgtatacaggtattgcaaccacagaaaactaggaaccagagagcagaccctgtcttttcatcccttgtcaaggcttggctgccactgaccaaccctgaatcacctggcacctgcaagtgaaggcacctgcatcaagtgaggcctcctgggattctggcccaaccaggggaactggtctggacatgcctggttgtcatgttgtgtaggcagccttgttctcctctccaggtcggaggctgcttgagtccttgggtagctgggagcgtgctgatgcatgttcctaacatctccataaggtctaacgtttatagacttcctccctgtgcatttatcactttttttttttgagatggagtctctgtcacccaggctagagtgcagtggcacgatctcagctcactgcaaacctctgcctcacgggttcgagcagttctcctgcctcagcctcctgagtagctgggattacaggcgcccaccaccacacccggctaatttttgtatttttagtagagatagggttttgccatattggtcaggatgctctcgaactcctcatctcaggtgatctgcccaccttggcctcccaaagtgttcggattacaggcgtgagccactgtgcccggctttttttttttttttgagatgagtctcactctgccacccaggctggagtgtagtggtgcgatgttggctcattgcaacttctgtctcccaggttcaagcgattctcctgcctcagcctcccaaatagctgggactgcaggctcacaccatcacgcctggctaatttttttttttgagacatagtcttgctctgttgcccaggctggagtgtggtggtgcaatctcagctcactttaacctctgcctgggttcaggcaattctcatgcctcagcctcctgggtagctgggactacaggtgtgtacaaccatgcccagctaattttcttttctttttgttttttttttgagatggagtcgtgctctgtcacccaggctggagtgcagtggtgcaatctcggctcactgtaagctctgcctccctggttcacgccattctcctgcctcagcctcctgagtagctaggactataagcacccaccaccatgctccgctaattttttgtattttagtagggatggggttttaccatgttggacaggctggtctagaactcctgacctcaggtgattcgcccgcctcagcccccaaagtactgggataacaggcgtgagccactgtgtctggccttcagcctatttttgtgtttgtatttttattattattattttttttgagacggagtctcgctctgttacccaggctggagtgcactggcatgatgttggctcactgcaggctccgcctcctgggttcatgtcattctcccacctcatcctcctgagtagctgggactacaggcgcccgccaccacgcccggctaatttttttgtatttttagtagagacggggtttcaccgtgttagttagccaagatggtctcgatctcctgacctcatgatcctctcacctcggcctcccaaagtgttgggattacaggcgtgagccaccgtgcccggccccttatttttgtatttttagtagagacggggttttgccatgttggccaggctggttttgaattcttgacctcaggtgatccgcccactttgacctcgtttatcacttttgatgcttgcgtcacccttgtgggagatagattggaatgttgctgttttataaatgagaaaaaggaatttaggagactttaagtaacttgaccaaggtcacacatttgataaatagcagagctaggattttcacagaggttcagtgaaatccctattcctgtgcttctaattagacattgagctccgtttaggaaacagagatttgatggcaaatgccatttattgaacaccgtgtcagataagggtattaagtgccagataaatagtatctcagtttatcttcacaaaatcctttgagatagattgcatttccattttgcagattggaaaactgaggtttagggaggtggtatgacatgcctaagggcacagctttaatgagtagagctgggattagaactcaagtttgggccaggtgcggtggctcacgcctgtaatcccagcactttgggaggccgaggtgggcagatcacctgaggtcaggaattccagaccagcctggccaacatggagaaaccctgtctttactacaaatacaaaaattagccgggcgtggtggtggacacctgtaatcccagctactctccggaggctgaggcaggagaatcgcttgaacccgggaggcggaggttgcagtgagccgagatggcaccactgtactccagcctcggtgacagaacgagactatctcaaaaaaaaaaaaaaaaaactcaagtttggctggctctgaaatccatccagttaacttctttactctcccagcacaggctgaatgtggtgtctcccattttgtaagtccccaggggtgcccagcttacccagctcctaagaagcagcaaatctggaataggaatgatatacccaggtaactaagtgaaggcaaaatgtgaatatactctatgaaaacaagtgaaaaggctctgggaagtaaggcagggagaggtctcacttttactttaagagcacccaggaagtcttttcatcccttgccaaggcttggctggcactgaccaaccctgaatcccctggcatctggaagtgaaggtacccgcatcagtgagccatccttgggttctggcccaaccagggaaacttggacccaccttggacaacttcttagggagcccctgctaggttataagtcctttctcaagacccttcttgaccagaaggtcaagttcaaactttatctcccatacccatctctatctcttccctcccacatgtcaccctactccatcctgtaccagccagactcaactttttgtttcatgtaagttttggttttgttcagattatacaattaatgcaggtttattatagaatacagaaacattcaaagaacagggaaaaaatatatcctcactttcggccgggcgcggtggctcacgcctgtaatcccagcagtttgggaggccgaggcgggcggatcacgaggtcaggagatcgagaccatcctggctaaaacggtgaaaccccgtctctactaaaaactacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaaaaaaaaatcctcactttcatataaccccagggatataactactattactttcagggcattttatttctaacacagtctttttttttttttttctgagaaacagtctcgctctgtagcccaggctggagtgcagtggcaagatctcgctcactgctacctccgcctcctgggtcccagttcaagcaattatgcctcagccttccgagcagctgggattacaggcatgcgctaccatgcccaactaatttttgtatttttagtagagacggggtttaccatgttggccaggctgttcttgaactcctgaactcctgacctcacgatccgcccgccttggcctcccaaagtgctgggattacaggcgtgagccaccgcgcccagcctagtctttttttttttcctgaacatagctgagttcattttgttttgtttgttttttgaaacggagtttcgctcttgttgcccagggattagtgcaatgccacgatctcggctcactgcaacctctgcctcccaggttcaagcaattctcctgtctcagcctccctaatagctgggattacaggcacccaccaccacacccggctaatttttgtatttttagttagagacagggtttcatcatattggacaggctggtctcaaactcttgacctcaggtgatcctcaggcctcagcctcccaaagtgctgggattacaggtgtgagccactactcccagcccattttgtttttaattgggattatattatagatcttttaaaagctgctatataacctgatatattgagaacattttacttcaaatagtgaaaaacacacaatcacccattatcctaccagctagagagaactgctatagcatttggtttctatgtttctagaccttgttttatgcacatgtgtgcatgtgtgtttgtgtgtgaatacatatgtttttaaagagtgatcagcccaaatgcttgagtaacctaatttttcacttattgctataacagatttttccaagtcagaaacacctgtgtcatctttcatagcagtgctggtataactatttgtgtaacgtgccacagtgaacctctgtcctcctctctgtcttcctgtctctctttttttgtttgttttgttttgagaaggcagggtcttgctctgtccccctggctggagtgctatggcatgatcatggctcattgcagcctcaacttctcaggctcagctgatcctcccagctcagcctcccaagtagctgagactacaggtgcacgccaccacaccagcctaatttttttttttttttcttgagacagagtctcactgtgtcgcccaggctagagtgtagtggtgtgatctcggctcactacaacttccgcctcccaggttcaggtgattctcctgcctcagcttcctgagtagctgggattacaggcatgtgccatcacgcccagctaatttttgtatttttagtgaagatggggtttcactatattggtcaggctggtcttgaactcctgaccttgtgatccgcctgccttggcctcccaaaatgctgggattacaggcgtatgccaccatgcctgacttttttttaagatggagtcttgctgtgtctcccaggctggagtgcagtgacacgatctcggctcactgcaccctcctcctcccaggttcaagacattctcctgcctcagcctcccgagtagctgggattacaaacacccaccaccacgcccagctaatttttgtatttttagtaagacagagtttcaccatgttgcccaggctggtcttaaactcctgggctcaagcaatccacctgccttagcctcccaaagtactgggattacaggcgtgagccactgcactgggtcttctgtcttctcttgatggacatttaggtggtttggaatgtttcatcaaaataaaatagtacagtagtggacaaacaccccacacatgaatcacttaacaatgaaagcctttgtgccatcgtgcctgctggccctctggcttgggtgccgtttctctgcttggcctggtacactgcccatctttggaggctccacacacaccacctacttggcaaagtcttctttgctgtgagcatccagttgctcttttccctcggctcccaagcctctctacatgcctggttttaacactcattacagagaaatcatctgcatagctctgtactctggaccatgagcctgtctgattctctgtaagccaaggctcattgcatggtaggtgcaccatagactgttgagtggcaaggtggttgccaacctctctcctatcttagctgtttgtgattccaaaagcctaaggttctgctctttggtccctggcagctaaagatgtgattaaagagattgaagactttgacagcttggaggctctgcgtctggaaggcaacacagtgggcgtggaagcagccagggtcatcgccaaggccttagagaagaagtcggagttgaaggtgagcagagtggggcgagtaggcccaggctggtttgaacaagcttctgttcacacttccacaacccctgcctgtgtccagtctcttccaggcccctgcctgtgtggctgtaccccaagcagctcctcttcctctggcctccccagggcacacagcattggctagggaccctctccctgtagtcagcagaccttgagagggtgttggggtgcaggaggattattggcatgacacctgtgaaagacaaagtagggagagccttctcataatgcagagctgtcacatgtgaggtgggaaggttgcagaaataaccagcaggagcctctgactgtgaggctgctctgacagacccaccctctgggagtttcagagcaaagattgcccatttaaaggaatctcatgttgggcagaagtggccaggcctcagctcaaatgccgcagcaataggaaggtgctgtagctggagactgccagctccctacactcctcgcagcagaggcaagttctctttttttgttttttgagacggagtctcactctgtcgtccaggctggagttcagtggcgcaatctcagctcactgcaatctccgcctcctgggttcaagcgattctcctgcctcagcctcctgagtagctgggattacaggctcccaccaccactcccggctaatttttttttgtatttttagtagagatggggtttcactgtgttagccaggatggtctcgaattcctgaccttgtgatctgcccgcctcggcctcccaaagtgctgggattacaggcatgagccactgctcccggcctttttttttttttttttttttttttttgagatggagtctcacactgtcacccgggctggtgtgcagtggtgcgatcttggcttgctgcaacctccacctcccaggttcaagtgattcttctgcctcagcctgccaagtagctaggattatgtgcactcaccaccttgcccagctaattttttgtatttttagtagagacggggtttcactatgttggccaggctggtgtcgaactcctgaccttgtgatttgtctgccttggcctcccaatgtgctgggattacaggcgtgagccactgcgtgcggctggcaagttctcctgaaggttagatccaagtggtgccctttttggccaacgcaaagggcaagtcaggttattctagccccgtgttccccaaacaggttctcctaaacaccagtcttctgatacgctctgtgagaaaagcaagagtgtcatgttcaaagcgttgggagatgtcactgggtattcccctctctttgaaattccaaagtcatgagggagagagaccagagttccagaatggcattgtctcttcatatgtgcatggctggggttgggctgggctcttctgcatgtcattgcctgctcacagcaaccagggaagagactgggttgagtctccatttataagtcaagggaactgaggctcagaggggctcattaaatagccacgatcagtcgggcacgatggctcacagctataatcccagcactttggaaggccaaggcccagaagttcgagaccagcttggacaacatggtgaaaccccgtctctacaaaaagtacaaaaattagcccggcatggtggtgtgcacctatggtcccagctccttgggaggctaagatgagaggatcgcttgagcctgggaggcagtggtttcagtgagccaagattgcaccactacactccagcctgagcgacagagcaagaccctgtctcaaaaaaagaaaaaaaaaagccgggcctggtgggtcacgcctgtaatcctagcactttgggaggccaaggcgggcagatcacaaggtcaagagatcaagaccatcctggccaacatggtgaaatcccatctcaaaatacaaaaatttgctgggtgtggtggcgtgtgcctgtagtcccagctactcaggaggctgaggcaggagaatcacttgaaaccaggaggcagaggttgcagtgagccaagatcacgccactgccctccagcctagcaacagagcgagactccatctcaaaaaaaagaaaaaaaaatagcagagatgtggccaagccacacatcacactcctgagatcagtgttctctctgtggtgccagtttctgcaggaggaggaatatgggactgggggccatgagaggattcacgccggaagggcctgcaaactagtttacaaagtggcactacatatttgtttccttaggaaggtcatggtcaagttaaccaccaagacagtgattgtttctgctctcctgcctggggcctgtactttccctgagcataagctgggatgttttccaaccaaagaactcagaactcagccctccccgagacctgtgaagaacaggaatgaaggagccatgggcctgaaggctacaggactcagcaggagctgagcttgctttcggcacatgggatcaagccctaacagcaccaccttgtttgccgtacgtggccttgccctgcgtgcagctctgaggctgggctcttatatgaaataggagatagagcccttccttcttcctcagaggttgtcctgggagagcctggccggtaggagtgctgcatgcaccttcccgcctgctacagatgcagtggctcgagtgaatcactgcacaccacctcctaggccctcctctgtgcaggaagcagcccagggcaggggcagggtgggatctgcccttgatggcccagtgttccgggcgtagtgctgatgccagaggggttctctctgctgctgcagcagtgtgcaagtgaggagtgaggtcttgacgggcgagagaagtgtagcccagagtcacacaactaggagtaggctgaggtggagtccaggcgtcagcccaagctcttttttttttttttttgagacggagtctcgctctgtccccaggctggagtgcagtggcgtgatctcagctcactgcaagctccgcctcccgggttcatgccattctcctgcctcagcctcccaagtggctgggactacgggtgcctgccaccatgccggctaattttttgtatttttagtagagacgggtttcaccatgttagccaggatggtctcaatctcctgaccttgtgatccgcccgcctcggcctcccaaagtgctgggattacaggcgtgagcctctgcacccggcgtttttgtttttttttttttttttttttttagagacagtttcacgccattgcccaggctgtagtgcagtggcatgatcatagcttgctgcagccttgcactcccaggctcaagtgatccttccatctcagccccccaggtagctgggaccatgtgtgtgccacaatgcccagctaattttttttttttttttaatgatggggtcttgctttgttgcccagtctgatcttgatctcctaggctcaagcagtcttcccactttggccttccaaagtgctggaattatcggcgtgagccaatgtgcccaacccaagcaagctcttaactgctttgctgttctcgtgggagatcattaggacctaaaacctcatttcagagataggataccagaggctggagagggggagtgatggctggagtcagctaaatcaggattggaagccaggcggtgtgccctagagtcctatgctgactgttcagctcattagagttaggtttggggagctttgttccgaatgacctgccggtatctgttgtgagggactgtggcgctccggctccggctgcctgttcctggccctgtggacccacgtgcaggtggaactactaagcagatctggtgtagagcagacagctgaggccccaggtgtgttcatggtctgctttattggtggatatgcggatttttctgcaaaaaccagcttccttagtatgtacggtgggagcagatcacgtgatcccaggagtttgagacaagcctggacaacatagggagattcccaactctacaaaagatacaaaaattagctgggtgtgttggtacacacatgtagtcccagctacttgggaggttgaggtgggaggatggcttgagcctgggaggtcgaggctgcagtgagccgtgtttgcatggctacgccccggcctgggcgacagagtgagaccctgtctcaaaataaaaaataagggagggctgggcatggtggctctcatgcctataatcccagcactttgggaggctgaggcaggtggatcacctgaggtcaggagttcaagaccagcctggccaacatggtgaaaccccatctctacttaaaaaatatataaaaattagctgggcgcggtggcgggtgcctgtaatcccatctactctggagactgagacaggagaatcacttgaacttgggaggtggaggttgcagggagcccacatcaggccattgcactctagcctgggcgatgagtgaaactccgtcttaaaaaataaataaatagataaaataggccgggcacggtggctcacgcctgtaatcccagcacttttggaggctgaggtgggtggatcacctgaggtcgagagttcaagaccagcttggccaatatggcgaaaccccatctccactaaaaatacaaaaaattagctgggcgtggtagcgggcacctgtaatcccagctacttgggagactgaggcaggagactcacttgaacctgggaggcggagattgcagtgagccgagattgctccactgcactccagcctgggtgcgacagggtgagactctgtctcaaaaataaataaattaaataagggtaattgaggtatccatcaccttaaatatttatctttatgctaggaacattcaaatttttctcttccagcttttttttttttttttttgagagagtctttctgtgtcgcccaggctgctgtgtagtggcgcaatttcagctcagcacaacctctgcctcccggttttcagcgattctcttgctgaaatgagtggcctctagagtggctgggactacaggcgtgcaccaccatgcccggctaatttttatacttttagtagagatggggttttgacatgttggccaggctactctcaaactcctgacctcaggtgatctgcctgtctccgcctcccaaggtgctgggattacaggtgtgagccaccatgcccggcatcttctaggtattttgaaatatataatagattaatgtaaacaatagttaccctgttgacctattgaacactaggtcttatttcttccaactttatacttgtctccattaattaacctttcttcagcctcccctccctctaaccttccaggcctctggtaactaccaatctactatctttatgaattgcctaatactttctttgaatcataccaggagtggtgtcacatgcctgtaatagcaggtactgtggaggctaaggtgggaggatcacttgaggccaggaggtcaaggttacagtgagctatgattctgccactgcactccagcctaggcgacagagtgagaacctatctcttaaaaaaaacgaagaaaacagcaaactttcatgtaatttcaaagcacttctatgaatggaaagctgacattccttacaataaaggaaataaaatagtgttactgaattattatttgatgctgttgctgtttaatggctctgagcctgaggcttgctcttcctttgttaaaaagtccccgtcactatgctaatttttgtattttttgtagagaaggggttttaccatgttggccagactggtctggaactcctgacctcaagtgatctgcccgcctcggcctcccaaagtgctgggattacaggcgtgagccactggccctcaacgtagaattctgtgttgtttatgttcatgtttctctgtcatccataaccacgtcacacgtccacctagagggttgtacaagtcagggattttcctgacacttgtgagcccccaataactcttggaggcctcttgatttgaggactggcctccaggtcccaccaactacagccagaatgggtccagctttttacaaacaaagctcaagttaagtcttgggggccaggtgcggtggctcatgcctgtaatcccagcactttgggaggccaaggtgggcagatcacctgaggtcgggagttcaagtccagcctgaccaaaatggagaaaccctgtctctactaaaaatacaaaatttgccaggcatagtggtggacgtctgtaatcccagctactccggaggcttaggcaggagaattgcttgaacccgggaggtggagattgtgatcagctgagatcgcgccactgcactccagcctgggcaacaagagcgaaactccgtctcaaaaaaaagaaaaaagtcttgtgatgctctggtagttcaaatccaccaggatgaggcttcactatgggcctccaggggtctctctcccgctaactcttctcttctttccgttgcagcgctgccactggagtgacatgttcacgggaaggctgcggaccgagatcccaccagccctggtaagcgaactagccgctcttcccctccacgcgcaaggccctctttggcaattcccagggcttttctcatgctttattctttctggagcctaagattagccctgtgggtgactgagctgctggaatggaagcccggcaagtccagcacgtgccctgtgtcctgacaggaggggagggtgggagcacagagactgacaggggaggaaccctaagggtggggacttcagggaggtgggagagctgagaccatgcactcctgggtcctcctgagctgcttggcttggttgactgtggatttcaccccaatatgattgccccgcctttcctggcaaccccttcctgcacctcgcagtcctgctccttcatgacttctctgcacacagcccatgtagccgtccccatctttctctggctcctccctttctccgtaccactgtctgctttggtttgtgcccgtcatgggtggcttcccatttcttcattcccagggctcagactggcttgggtcgagttcccagtctctgagtgcatatgtgtggaaggaaatagaaagaggcaacacagaacacagaaaggcatgcctggccaagggaagagggcagggctggtggtcggcagcctctcagtgtgtcctcctggcacggggctgcacacggcaggccctgagggtgcaggtttctggtcagtgatgagtgtgcacattgatgttactgagcccctcaccctggttgcgcccaacctccttttatttttttttaaagacagggtcttgctctgttgcccaggctggtcttgaactcctgggctcaaacagtcctcccgcatcagcctcccaagtagctgggattacaggtgcgtgccactgcacctggcttgtgaggctaggatttggaatgtaggttaagaaaattcatttctggccaggcgtggtggctcacgcctataatcccagcactttgggaggccgaggcgggcagatcgcttgaggtcaggagttcaagtccagcctggccaacatggcaaaaccccgtcttactaaaaatacaaaaattagctggcatggtggcacctgcctgtagtcccagctacttgggaggctgaggcaggagaattgcgtgaacccaggaggtggaggttgcagtgagccaagatcatgccactgcactccaacctgggtgacaaagcaagactccgtctcaaaaaaaaaaggaaattcatttcagtgattgcatgttaaagaatttcaagttaggccaggcgcagtggctcacgcctgtaatcccagcattttgggaggccaaggtggggggcggtgcacgtggatcacctgaggtcaggagttggagaccagcctggcccaacatgctgaaaccctgtgtctacaaaagtacaaaaattagctgggcgtgatggcaggggccttgtaatcccagctactcaggatgctgaggcggaagaatcacttgaacctgggaggtgaaggttgcagtgagctgagattgtgccattgcattgcaaccttgggtgagagaaagcgagactccatctcaaaaaaaaagaatttcaagtcagaaaagatggtgaagagaactctcttttgcatactcactgtggaattctcactgtgcaagttttgcctaaattttagcatttcatttccctgagctttcagaaggtattcttttggtttttgttttcttttacttgactctgtaggaatggggaagagaaagtattcttatctctatgttcccaatcgtgagaataaatcttaagagggggataagagaatttggggttagaagatggcatgtggtggagtaggcacagggtgtttgagcagctgtggttgcttcagggctagaggtcagttgaggccagatcgccaggggctaggctttttttttttttttgaggcggagtctcactctgtttcccaggctggagtgcagtggcacgatctcggctcactgcaagctccgcctcccgggttcatgccattctcctgcctcagcctcccaagtagctgggactacaggcgcccgccaccatgcccggctaattttttgtatttttagtagagatggggtttcactgtgttagccaggatggtctcgatctcccgacctcgtgatccgcccgccttggcctcccaaagtgctgggattacaggcgtgagccaccgcacccagccaccaggggctaggctttctgtgggtagggcaacgagaggacacattgccttttgcttactgagtggtgggaggatggtagaaactgcctcatctgccatatctgtggccagggtgagggcagaaagtctcccttccacattcctgcccccatggaccacctgctcagccccatttctgacccagtctctggcagagcctcctctctgaccatttctcctggtggggtgagggaatgtagctctccccagcccaggaggtttccaggagagcttcaaatcaccctgtcaaagctgatcctggccgtggcttagagatggccacctccatctgccagtcaccaccagaaaccctggaggcatttgtggttcctccctccctcctcctgcacgaacagggaaccaacagcttctgcatgtcccctgctccatgaacaggcagctcctctcccacacttgtcacaccggctggcaggtcccctctgttgccagtgtcgctgcctcacactcctgggtgggcactccagcccccctttctgtgcatctgctcacctcaggtctggggatattaattccatatccctcagccacctcaaagcccactgctctcaggctgaggctcacagtccttggcctggcattcaaggctcttgcctgatctgacccctcacttcccttccacccaaagcccatgccacggcttcttctggagcctacccacagctttcctccaggctcacagcctgctgcttcatgcttatgtctctctgctcctgttttttcagctgcctggagtcttttcatgttgactagctgattctcatccagactaagtccaaatgccacctcttacaaggagccttcccgggccactccaggcatacgcatcccccactctccagctgttaggagccctttgcagggtttccagtcttaagaatactgaaatggtttgtgtctgtgctggttctgcaccagccggggtgtccttggaaggcagagctgggcctggcacagaagcagcacccagcacagaagctgggtgtctatgaaactgacacgagcttcctctgtgcccagatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaaggtgggtgtggcagccccctccccgcagagtcccctggtccatccacatccgtctgacatatgtgccctggcccttggccaccaccatctgggatggtcagccgttgttttcaaaagagaaaggcctcaaaggcaacagcctgtggccggagggtagaggcgtccatgagggtggggttgccaagcaaccatccccagttcttgggttggcttggcaacgcagagggagtgccactgcatacctgctccagcctgctgcctctgcaaaactcagggcttggggcatccctatactcactgtacccgcagagcagctggtagagcctggcacataggcagagggagtctgaaaagaggagcatatgctcaggggggcaccgtcacagctcacctttattcctagacagggccttgcccagggaggtgtcctcaggcaaggtcagtgtagagcttcacgttgggctggtcagtgtagagtggagcttctttgcttcccagaacctgcatcaagggcggcctgccgtattattctcttccaactccatcccagtgcctttagacccagggttggaggacactgagtgccaggctgcaacccctacacacactttctaaccaaagggagaaaagggctggggacacagaagtaacagcagttggggatatcttatttgaatatgcaataccttaacttttcccacccacactgaaaggtggctgatgccatcccagtttttccacatgactcagcataggcttagagagatggggtggagtggatcacatagctagtgctgtgaggcccatggagccccaggctgaggagctggagtggcctcccctgcagagggtgcctgtgtccctcggcctgacgtgagggtgagcaggggcaggctctgtgcctgccttagccagccctcccccaagtccacttgggcaataagctatccctgtgttaagatgtaaaaatgggccgggcacggtggtgcagtggctcatgcctgtaatcccagcactttgggaggccgagtcgggcagatcacctgaggtcaggcgttcgagaccagcctggccaacatggtgaaaccccatctctactaaaaatacaaaaattagctgggtgtggtggcaggtgcctgtagtcccagctattcgggaggctgaggcaggagaattgctcgaacccgggaggtggaggttgcagtgagccgagatggcgccactgcactccagcctgggcaacaagagcaaaactccgtctcaaaaaaacaaacaaacaaacaaacaaacagaaacatataaaaacgtttgcgtcagcacagaaagcaggcgtggcccaacctagagtgagtggcatacgctgggagagccagagactctattctagcaaaatgcttcggttttccttccattacttcccttctcctgcccagcagtgcctggaaactgaggctcagggagctttcctactggccaggagttgtctggcctgtcctatacttgtaatggggtgagttggggaatgagttttggacccaggaccagagggcctcctgggcagacaggcctaccctggagtttgattgatggttctctgtgcctccctgaccactgatttgattaggtctctgggtctcggccttgctgacctatgcctcttgggagctcagacgccatggtctgggtgtctaaccaaggcctgcaggtcctttggaatctttttcttctgggcagtgtgtttagtgtggtttctgtgccatgcaccatgagaatagaagggcccagaggagttggtggggcaagaggcatggccctgtgcttgagaactctccatacccaagttggactcctgcaggagctaaggccatcaccacgtggcctccagggaatctgggagaatgggggtgacctagcagtcggctgctgctgctgagtagcttcctcagaggctggtctttggcagaagtttgatgtctctaccctgagtgtgtgcgtgatcgtgtgtgcgtgatccaccatcaccaccgtggagtcaggcaggtgctggctcttctgttcctcaaggacggctgtgtgcagtctcatgccaggagttaggccaacccacccgccatgtgcggctttgctaaatacttaccgggtgaccttggccaattcactcatctctcagagcctcagcttcctcatctgtaaagtacggccaatcctgcctgcctcccaggctggtgttgaggttgaaacaagaaaatatgccaaggatgcccaggccctagcaggtgctctgcaaacatcaggtgttctgcaaatatcacttctctcggtgcactcgctcgtgattcttttatgtcgcatttaccatgggctctgattcccatcggtcagtctccgtttttcagtgcttttcctaatggtgtaaccagggtagaagctacttcctggcaccacaccagggacagggcaagctgggtgttaggtttttaccaccagcaggcaagctcctgctgtgcctggccagcttttaggcacaggcaggtgtcagacaggttcgtctggaccgtggacttggcagctggctcccttggacattgtggaacgtggaagagaagctggaagatttgggctttggtccagagtccaccacttgtttattgaccataagaaagtttccgttcctcttaccctgagtttcttcagctggaaaatgggagccatgattttcccacctagcagagggccttagacagtgaagtgagctgactaggaagtccttcccctggacctggctaaaagttcatccactccatgtggtctctccctttcctgagtagggcttggtctccccgtctcgaaagtgaagctaaacctctcaggctggtgtgacacagcattagagataaaaaccttgtgtaactgaagtgctggacatatttaaggtgtgactgttgagctgttagcagtcctgcgtcccctgacctgcaccgatgggtggcgtgggatgttgaagagcagttcagcagcagtggccaccccgctgggagaaggggctcctgcccatgaccagggccccttgcctttccccacagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtgagtggtttctgtccatcctgcccctgcagccttgaggtgcactcggcatagtaggctgacagttctggatgctaatcccagggctggcactcaaccaagagacctggggcgtcacgtgccctctccaagcctgttaacccatccgaaaatgagccagaattcctgtcgtgcatttctggaaaggtgtgtgactttccggaaaggtgtgtgactggctcccactggtgagccagcccctatggggcttcaggccaggcaggccactctgaccaaggagtgtcatctgccaggctcagaagtggtgaagtgagatggtgcgagtgctgacagtagcctggcccagccactggtgtggggcacagagaaggaacataccagacctccaagacagggagataggcaggggcagccgcagggctcaggtgccaaatgacgtgctctcaggtgaccttatccccactcctcttccactctcctctccccatccccgcaggacattgctgagtccccgatcgtgagtgccagcagaaggctacacttgcccctaacaggactgaaaactttggggtctgtctccctcctctctttcctgttttttttgaggcagagtctcattctgtcacccatgctggagtgcagtgcgtgatcttggctcactgcagtctccgcctcccaggttcaagcagttctgcctcagcctcccgagtagctggaattacgggcacccgccaccacacccggctaatttttgtatttttattagagacggggttttaccatgttggccaggtggtctcgaactcctgacctcaagtgatctgcccgcctgggcctcccaaagtgctgggattacaggcgtgagccaccacgtccggcccctcttctcttaatttaaatgttttcttcagcaaacagtatcctaggagcattgctcatacgggccggaatgtcctggctgcccatcgaggctgtctgtagataccctttgcctgcttcagtgccaagtgaacatcgcagagatctgccttgtgtctccctgcacccctggctgcaggggagctcctgctgcctcctctggagctggtgggggcctcactgccatccttggatccctccctgccgtcagcctgctgtcctcagtgcactgggaggagggggtgcgctgtggttgtgttgagccttcataggtgtcctctggtgggcttagaatgggggttcttaatcccccccagtatgtggatagaattcaggggtctgtgaacatggatgaggaaaaaataacattattatttattactaatgtagctaaaatatgtagtgtgacctttgattataaatgtagacaataaacctcacagcattagaaaggcctgtgactacccacataacaaacaagcacatgtagtccctgaacccaaaaaaaaaaaaaattttattgaggcagggtctcgctctgttgcccaggctggagtacaacggtgcaatctcagcccactgcagttgaagcttcccaggctcaagtgatcctcccacctcagcctcccgattagctgggactacaggtgtgcaccaccatgcccacccagttaatttttgtattttagtagagatggggtttcaccatgttagccaggctggtctcaaactcctgacctcaggtaatccactcgccttggcctcctaaagtgctgggattataggcataagccactgcgcccagcttaaaatttttaaaaaaataaaaagaaaatcttgtgactttatccccagtggaaatcacaggtatttcatatgaagttatagttactgctgatatatagaaatatttctcactacatcaaaattacagtaatagtggacccacccctagatcttgttatttggtgcattaacaagaagtttgtatatcactacagcatgcgtttggagttttttcctaaatgttttgataactgttccaactgagttgatttcctttgtaattctgtgtaatttatcttaaaattttaaaaaaacattttttgaggaggggacccaggggcttcaccagactgcctgaagggttcatggcacagaaaatactaagaaggcctgacctggagtgtgcccaggttggccttcctgtatttatttgtggaccacccgctccccccattgccctgtgctgcactgagcacctgaagacagcagaagattccttggcacagttaagccaggccaaccctcagtcctgggtcacagtggagactgggacatggccctctcctccaaagctcaggggccgatgggatgcagacggaatataggctttgaatgtaggcaggatgaggaccaccgtgatagaggagggaccaggtgctccgggagcacagaggaacgcacactggaccgtggctgggggaatccaggaagccttcctgggagaggaggtgaccaaaacaagagccctagaactcatatgagttagcctgtcaagaaaatgctgaatggccgggtgtggtatctcacgtctgtaatcccagcactttgagaggccgaggaagctggatcgcctgaggtcaggagttcaagaccagcctggccaacatggtgaaacctccatctctactaaaaatacaaaattagtcgggtgtggtggcgcacgcctgtaatctcagctactcaggaggctgaggcaggagaatcacttgaacctgggaggcagaggttgcgatgagccaagatcatgccatcacactccagcctgggcgacggaacgagactccgtctcaaaaaaggaaaaaaaaagaaaaaagaaaaagaaaataaggaggcagagagaatgggtatcaaaaggccaggctgtgatagggctgcatgggccagggaacaccctcctcatccctagagaaggacgccatgtcgaaggggttatgttgtgtaggtgggtgggctaggagggcccctaagaaagaaaggtcacatggagctatgtcatccagagaaggggcatgagtgcctgcccaccacagccagggtccccactgtgctgaggacaccagactgagaacaagaaatcgacctgctggatctagagctctgtgaccctgggcaagtcacttcgcctctttgatccctagtcttttctctggtggggatcctatcccaggcagtaggcctccctcaggaggttgtggaaagagttagatgcagccatgccccaaaatcccacagacaggcccctgccctgtgctggcggcagcccattcctgtgcctgctgtgtggaattgctctcctgcctgctggatgtcacctggcactcggggccccctccactctctgcctcctcttcacaggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgaggtgaggcgagtgtggcagagccagttgggccccgccagatagaggctggctgctgtctttccagggaagctggggctccgtttagcagggactcctctaccccctgcctgccccctgggtgtgtgccccatggctccagctctttgaacatgtcctgaacagggttgcaggtcccaaggtaacccacgccctcctcgggcagctctgattcttcatgccaccttctcctgagccgcctctgcagcccccagcggctgccgctggtttgttctcaggctgcacaggagcagactgctccccacatctgttttcctggttgatttgttcagcagctgttgtttgttttgttatttattatcactttttgagacggaatcttactgttgcccaagctggtcttgaacttctgggatcaagtgatcctcccacctcagccttctgagtagctgggattacaggtgcaggccactgtgcctggcccagcagctgttttttgagtccccatttagtgcttggctttgtaccaagtgcaggccacatggggttgagccaaagaccccgccttcagggagaccctagctcaaggagggaaggaagctgccagtggtaacagtgctgggctctgaacgcagtggcttcttggctgccagggtcccgtggccccacagaaggctagtccggctgcctgtgtgttagcagagatgtgtgcaggtgttggggaacacgccagaaggaagttcaaatcagacttagggcaggcttcctggaagagatcacattttggctaagttgtatagggcaagtggtctttctctggacagagggtgggggatgggtgtttcaggcagagggatcagcttacgtgtggaagacccggatgctcagcaggaaccttgcttggttggtctcaggaagagttctggccgtaacatggggaggggtggaggaggtttggccaggggcccagaggccaacaagtagaagacggcaaagctggtgacttgcagaggaggacagtgtgtggtggctggcttgggatgtgaccgtgtggggcccccggggcttgctgagggctggggtgtggtctgcaccctcactctggacccttgcttccccctcacagaccttgaagaccttgcggcaggtggaggtgattaattttggggactgcctggtgcgctccaagggtgcagttgccattgcagatgccatccgcggcggcctgcccaagctaaaggtgccagcctggacgcctgacgtcctccctctggggtctgtgggtggtggggcggctgggggcacaggggtctggtctgaaggcaggtgggcctgtgtccatatcccagctcctccacttcgggccctgtgatgctgtgtgagcctccacacccctctgagccatggtttcttcatttctaaagcgggaggcagggagtggtgtacatcactgtcttgtgatttaagtaaacacagtacgtgactcatcgttggctgcagggcattatttttgttgttggtgttattcttcctgcccactttgccccacctggaggacagagcctgccatatcctcacttggggaaactgaggcttagagtagaacctggtgtcctggcccgggtttctgcctgcctccaacccttcctcttattttcaggagctgaacttgtcattctgtgaaatcaagagggatgctgccctggctgttgctgaggccatggcagacaaagctgagctggagaagctggacctgaatggtagtcggatgggggaggcctctgcacaggtctgctaggctggccctggcaccccggctgactgctcttccctccccttgagcaggcaacaccctgggagaagaaggctgtgaacagcttcaggaggtgctggagggcttcaacatggccaaggtgctggcgtccctcaggtagggaactcggggtggccccagaggtcggggtcaggccattcctttctttctttcttttgttcttgagatggagtcttgctctgttccccaggctaaagtacagtggcgtgatctcggctcactgcagcttccacctcctgggttcaagtgattcccctgcctcagcctcccaagtagctgggattacaggcacccaccaccacacctggcccctttatttgtttctacttgtatttattcagaaacgttgggtgcactcctgttacgtactaggtcatacactaggcatcagggctataaggatgggacagtcagggtttctgtctcgtggggtggagacagaatgagttgtccgttcaacagaggagctcgtacgggctgagcggggccaccctgtagagtggtggagttggggaggcctctgaaggggtgaggccagatctcatcctgatgtggtggggcctggggagtgatgggggtgggaggtgggggcagccagaaggggctgcactcgggattgttcttaagacgctgactctagaaaggaagagaccatggggcctggggagtctacctggaggtgaaggtgggtggccggggagtggccatctcctggatccaagtccggttgggccatcagcatcgggctccctgtgcccctcgcatctccaagtcggcctcattcgtgtgtcagatactcagtcgtgtctcctcggtgctaggccctgagctgaggctaggaactggggactccgaggtgggctgaacctcacaggtcccactgtccctgggaaatggtccagccttcctatggggcaaggacacccctactcttcttcctcccccacacctgtagcttcctgaggtcatgtggatgtgggcgcccctgccctggcatctcaacctgggcagtgttcctgccaagccctgggctctaggtgtgacaaagctgtcttcgttttctgtctctccatgaaacctggggctccttgaggacagggacaagatctgatttttttttgttttttttttttgtttttttgtgggggatggagtctcgctctgttgcccaggctagagtgcagtggcacaatttcggctcactgccagctccgcctccagggttcacgccattctcctgcctcagcctcctgagtagctgggaccacaggcgcccgccaccacacccggctaattttttgtatttttagtagagacggggtttcaccacgttagccaggatggtctcgatctcctgacctcatgatccacccacctcggcctcccaaagtgctgggattacaggcatgagccaccgcgcccggccgatcttatttttttgtgtccacagcatggatttccctggtgatccacctgcccctgccctgggagcaggtgctcccaccccaccaggctctctccctcctggctgaggtgaggtctctgggctcatggagccaggccttagagccaacctgggctgctgggtagagaggatctgcttcagccagctctttctgcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggtgagtttctatcatctgccacaatcagagccctggtcctgagaacgtgaaatcccgaggcactttcacaatggggtagggggtgtctccttaagcacagtagccacaaacatttttttttgattgcatgatattgagtaaaaaaaggaaaatggtcccagtgtaatgatagttacctatatttcttttttttttttttgagatggagtctcactcttgtcacccaggctggagtgcagtggtgtgatctcggctcactgcaacctctgcctcccgggttcaagtgattcttatgcctcagcctcccaaacagctgggattacagatgcttgccaccacgcctggctaatttttgtatctttagtagagccggggtttcgccatattggccaggctggtcttgaacttctgacctcaggtgatccaccctcctcgacctcccaaagtgctgggattacaggcattgagccaccgggcccagccatagttacctatatttctatttaccccaatataaatgtctatttacaggtagcagtgctgctgcattatgtatattataagatatgcataagggtttctgaaagaataaacaaataagcataaatagaaattctgattttttttttccccacccaccagaggattgtcttggtgacccttaggaaccactcccccattcctgggatggtggctgggccatgacctggcttgggcacttggtgtcccttgtctggcccggggctgcatcagggctgccacacctccagttcattcatttgcattccctgtcaggttcctaagtaaagctcctggagaacttggctctggacaaggactccccatgcttacgctgaattgggctgcttctctggtttatggaatcaattaaacaaatggctaggttcgcctcaattcagtttttcctctgggcacctctggtgctagcagggcttacccaggctggactgtagttctacggggacccactttagcccccatgtgcctccgtagtcatttctggggcactgcatgtcatgacgaggatccacttggccgtagcaggttttttgagtcccagggaggtagcttccccctcaccccaaaggctcctggaccaagagccatccagggccagcatctctgggtgatattgatagatgggaaatgcagctgagtgggaggaagaattctagactttgagcctagatgggctggagtgaagggtggatgtgctgggtgtggggatgggcacagctgtgtcggggagtctggggtccggaattctccagagcctctgtgcccctacttcccaggagccagctcccgtgctgtcctccccacctcctgcagacgtctccaccttcctggcttttccctctccagagaagctgctgcgcctagggcccaagagctccgtgctgatagcccagcaggtaataaccacccctcgacccccacgctgtacgtgctgtggcttctggagctgttagagaaaagggacgaacagctcagagacctgggggtgcgacgctgtcagctgggggcagggaggcttggcctgccactgttacaacacgcgcaaatgtccagggtatttataagcctccaggggttgcaaatgttccctccccactcagcctacagaaagtacagcccgccagttcccatgctgactggggttagggaatttccttaagagccttgcatgtgcccaccccctccttggcttctctctgcgtgttccgtcagcccagctgcttcgagaacaactctgttgcccagggctcctttggaagtgacgtgcctattgcaggatgggtgccctcactccagcctcacttgttggttggctcattcattcattcatagatgatcttcggggcatccattttctgccaggcactgcatttgggcatgattttatttaaccctcttggcaacatgaaatgtagactctgctgcccttactttattttattatttatttatttatttatttttttgagatggagtctcactctgtcgcccaggctggagtgcagtggcacgatctcggctcactgcagactctgcctcctgggttcaagcaattctcctgcctcagcctcccgcgcccagctaatttttgtattttttagtagagacgaggtttcaccacgttggccaggctggtctcaaactcctgacctcatgatccacccacctcggcctcccaaaatgctagggttacaggcatgagccaccgtgcccggccagcccttattttgtagataagaaagcggaggctcggaggttacagagaaataaaatgggcccactctcagagttggcttaacatttcggccaattgctttgttaggttttgcctgtattctttgtttcttttaacatgataaatcagatgttgtaagcctttctgtggcctatcactttggtgtagcaccattcatcactttcttgtgcccataaaactcttctcaggatttttattgcaatgtgtggatgtagcacttaaaagccaggcactgtttctgacgttttttccacttttccctgttgtgaggttgaggtaaacgtttctgcatgtgagtattgtctacatgctagattatttcttcaagttcaattacaagatggggaccactggatccctgaaatgatttttttttttttttttctgagacaatgttttgctttgtgactccggctggagtgcagtggtgcaatcatggctcagtgcaacctcgacctcctgggctcaagcagtcctcctgcctcagcctcccaagtagctgagactataggcacacaccaccatccttggctaatttttttcctttttgttgacatggggtcttgctatgttgcctaggctggtctcagacttttcgcctcaagccatcctcccacctcagcctcccaaagtgctggggttacaggcatgagccgccacacccggctgggatgatttttcatccttgttcattcactcattcattccctctctatgctgcatatgtgcttgctgcaggccaaatccaagccagactctgaagggacagcatggggtaaggcaggacctgttcttgcccgccaggggcctttgtactgcccaggcctctcctagctagcgtcagagcccaggtacctctccaccacgtgccacaggccaaccattgtctcttttgtcctcagactgacacgtctgaccccgagaaggtggtctctgccttcctaaaggtgtcatctgtgttcaaggacgaagctactgtgaggatggcagtgcaggatgcagtaggtaatgtgggctgggtgagacctgggtgccctctgtcccttgatgctcgtgggccccaggtatccttcgtggttgccgtaactcgtcagccccagcgctctcatgggaactgctctttggccacctgagtttttcctccgtcagggtcctgccgtggagccagctggctgctcttctccctgtttttcaccactgagaaactgaggcctttcccaaatccacacagccatgtacagttagaacccatagcccgctctaggaagtccagatagccacatctgcaagcccaatggacgcaggtctatcgggaggagggatggtgagagccaagcccttgtccacaccttggagcttctgtgctcacgtccactctacctggaggttccttgcacagaggacacctttccccataacattatgggggcttccttggagcaccagcccatatccctccagccctatcacaaccctctccccaccctgtctgtttcctccattccagcacctgtcaccttccaccctgtttccatgtgcttgactgagcctccacatctaacgaaacctgagccagttccggttaggcagaggggaggaagggccctgaggcgagggggacggttcctggaaaagatagaaaggggtggaaggacatgtggtgcctcttcccggcgtggcgtcgaagcggggagggcggctcagtgggaaatgaggctcggaaggaggtgggggccagacacaagcctgctccctgagggcccgcctgtgggcatttttgggaacaagttgccctagttctgtttcccaggaagcctagcacagtccctgcacatcccctcaccctgccaaaataacctgaatcctccccagtggtagcctgcctcaggaaatctccattcccacggtgtgaggtgggcacagtgggtgtcatccccatgcccattttatacctgaggccaggatgggcaagggccagagtgtcacagctggcagatggactgagcccatcccctgatgccaactgccactccctctggttcctgtgtctctgccgtccctctcgtgttcgcctcttcgtcagggcgaggaggcaggcgagcctgtgtctgcgcggtgttgggggaaccctgggtgccttggcccagccctctgccatagccagcagcctgcccctgctgcttctgccctacagatgccctgatgcagaaggctttcaactcctcgtccttcaactccaacaccttcctcaccaggctcctcgtgcacatgggtctgctcaaggtgaggccggaaggaacagcaggcccgggagggaggtgggtggggtctgcacagaagctgccccagccatgcccgccaacctccctcacctcgagtcctgagccggctcgcccacggggccccgaggcctgggtctgccccagcagccttggtcttcacgatgagattccggctagactcagttgtgggcactatcagcagagtctggatggtggagtccaggggccccccaggtgactttgaagctcaccccgcttttcgctgtgttcctctcagagtgaagacaaggtcaaggccattgccaacctgtacggccccctgatggcgctgaaccacatggtgcagcaggactatttccccaaggcccttgcacccctgctgctggcgttcgtgaccaagtgagtgtggccttgtccttctgccggtgcctgccctctcgggcttctctggccaggtctgaaggcgcccggttccgggaggcccagccccagcccagccagcctgctggccccactcaggtgcatgagaggccctcatgcctcctgggctctcagcatctgcattggagtctcaccacccttgggaggcccactcccctctgcccagctgaggacagtggggctcagggacagtgagagaggagacacgcggcgcccccattgtgcagatgaggagcactgggttggttaaggagtttcccttggtcacacgctagcaagaggctgggccagtgtccagacccatgtctgctgagcgaggtgctgcggttggtgacatctccggagtggctttttgtccacattcacagcagcgcaggccaaaggggcctggtcacaccaggctctgcagccccgggccctctcctggggacacacattgccacgggagctgccaaatgcccagcaatgtgtgaaccttggccttgttctggagggtcctggggtgtcccggggcattgatggggtgatgggcacagtcaagtaagagaggcaaggccccaccagggaggggtcgggaggcttgccctctgaaggccctgtgtggcccctggccaacctgtggccttcatcaggcctcagtctccccatttgtccaaccggggggttaggtgagattgtctccaagcgccctgaccagccacacttccagtcagtcggcgccatccggggacatggggcaggcagaggagcaaggaagtccctttgctgggggagcccagagcccaccagctgaggcaggatacttggtgcatgtggggaggcggggctggcggagcgtgagcggcccccgctggcctccagcacccagctggtgccgcggcagccctgtccactccagtgtctgcatggcgccgcctccttagccaggccttaccttctggccgcatttcccccacaccagaccaccccttgggctgcagctggactggccttggtgaatggcagatctcactgttcccctcctctgccaggtgctaggtagagcctcactgtgaatctcatggctggccacagcctcaccccgaccccaccccaccccaccccagcacagtgtgctctccctgagcccctttccatagcagtgctgttgctgcagtgccgagctttgcccatgctgtccagagcttgtttggccagtggccccagcccccgtctgcgcctgagccctttgtgtccttcctgccccctggtcagagtagttccctctgtatccctggcagcccctgtgctatcctaagcctgggcatgtgcctcttgcccttgttggtcagagcaaaatgccttttcccagcttgttgcccaacctccagcacaggcctcagtctgccccctgggtcttgtccaaggtgactgattaactatgtagtgacatgcacggaccctcttccctcagctcccagccaaatggtctgggatgcccggcctggcgcagatcctggcctgttcactggcttcaggccagaggtgttgtcaggcctggtcctggctgcgtcccgcacttgcccagtcccccagagtcttgcctcagtttcttcctttgcagtgaaactaatgatattgagggcaacaacagccagctcaggcgcagtggctcccatctgtaatcccagcactttgggaagctgaggcaactggatcacttgagcccgggagttcaaggccagcctgggcaacattcgtgaaaccccatctctacaaaaaatacaaagttagccgggtgtggtggtgtgtacctgtggtcccagctacttgggaggatgaggtaggaggaccacctgagcctgggaagtcgaggatgcagggagccatgattccaggactgtactccagcctgggcaacaaagagaggccctgtctcaagaaaaaaacaaccagcctggcgcggtggctcacgcctataatcccagcactttgggaggccgaggtgggaggatcacgaggtcaggagatcaagaccatcctggctaacatggtgaaaccctgtctctactaaaaatacaaaaaattagctgggcatggtggtgggcgtctgtagtcccagctactcgggaggctgaggcaggagaatggcgtgaactcgggaggcggagcttgcagtgagccgagatcgcaccactgcactccagcctgggtgacagagcgagactccgtctcaaaaaaaaaagaaaaagaaaaagaaaaaaagcaaccaaaaaaacaatggctagccatttacttatgatccagattggactctagtgggccagtcctatgtggccactggcagccagtaaggattccctggcctatgtctgctggaagggcccttggagagcctggctgagggggccttcattctggccagctctgggctgtgtggcgttgggtgcctggctctctgagcctctcgcacctcccatccccacccacggtgtgcagaaggcagagggctaatgtctctcttgctgagtcgttgtgcaaattaacaaaaatgagtctggcaccaaaatggcccccacacttggaaaacaggccaagaggcatccaccgacctgctgacccctctttccccgcaggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcagagactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccaggtggcagaggatactgctggccctgtcccctgtcttctgtgtgagttgatacggtagggggtgggtgtggggctggcattaagttctgatgccagctacaacgtggatgaactttgaaaacatgttaaatgaaataagccagacacaaaaggacaaatatgattccatttagatgaggcatctagaataagcaaattcagagacaagaaggtagaggttgccagggctaggggaagggtggaatagggagtgaggctgcaaacagattctctgggatgatgaagatgttctggaaatggagagtggtggtggttgcataacattgtgaatgtacttaatgcactgaattgtacacataaaaatggttaaaatgatagatttcatgtattaatatattttacctcagttaatgttttaaaaattaagcaaaactatagagcttcacccgggtgtggtggctcacgcctgtagtaatcctagcactttgggaggacgaggcaggcagatcacttgagcccaggaattcaagactggcctggccaacatggcaaaaccctgtctctactaaaaatacaaaaatgagctgggtgtggtgatgcatgcctgtagtctcagctacttgggaacctgaggtgggaggatcacctgagcccaagaagtggatgctgcagcaagccgtgatcgtgccactgcactccagcatgactgacagcgagaccctgtctcaaaaaagagagagagagcttgtaggagatagtgtaagtgagtatcttcaaggccttaggagtgaggaaaagatgaataaattaagctgtatttaacctcctttgccattatcgtgggatgttcacacaatggaaatgatgtagcagtgagaacaggtttctgtttatcaaaatactcattaaggagtacaaaggcaacttacagacagggagaaaataattgcctaaactctctctgtatatatatatgggtgggggggataactttaatttttttcaaacagggtctcatgttgcccagcttctatctcggctcactgcagcctctaccccccaggctcaggtgatcctcccagagaaacataatcacagtgtgacactcttatgccctcactagaatggctaaaatacaaaatacagtaccaagtttggtgaggatttggggcaactggagtggctggcagatgtgtaaattggtacaacctttttttttttttttttttttttgagacagggtcttgccatgtcacccaggctggggtgcagtggtgtgatcacagctcactgcagcctcgacctcctgggctcacttagtcttcgtgcctcagcctcccaagtagctgggaccatgtcacaagccaccacgttcagcttttttttgtaaagacagggtctcattgtgttgtccaggctggtcttgaattcttgggctcaagtgatcc

SEQ ID NO: 16768 - DNA, 12513 bp, Human
ggatataatgaaagtattacttggagcctaagatgctaatgctagggagaaacgggataaaaaggtagaaaaaaacactagcacaaaataaccccaaagaaagtagaaggaaagaaaaaaaacaaaaggagaaattgctgaaatagaaagtagagcatactgctgggtcttttcctttccgaagcccctctttctcaccagagagagctgttctttctctttcttttgcctattaaacctctgctcccggccaggcgcagtggctcacgcctgtaatcccagcactttgggaggtcgaggcaggtagatcacctgaggtcaggagttcgagaccagcctggccaacatggcaaaacccagtctctactaaaaaatacaaaaattagcccggtgtggtgacgcgcacctgtaatcccagctactggtgggggctgaggtaggagaattgcttgaacccaggaggcagaggttgcagtaagccaagatcgcactactacactccagcctgggcaacagagcaaaactccatctcaaaaaaaacaacaaaaaaaaaccctgctcctaaactcctgtgtgtccatgtcctaaattttcttggcatgagacaacaaaccctggatatttaccccaggcaacgaagctagttcagtttgacactgttgtcaaagttttggggaattagtcactgtcatgcattgctggtgggtgtgcaagttgttaaatcctatatagggtcaatttagaatagatataaaagttacaaatgcatattatatcttttgactcgttaatcccacttctaggagtttatcttacagatatactgaatgaaacataatatagattaggtatagatgagattagacattatagcatttacataatagtgaaagattaaaaaatatataaatgggctgggcacagtggctcacacctgtaatcccagtactttgggatgcccaggcaggaagattgcttgaggccaggagttcacgaccagcctggacaacataataagacagtgcctctaaaattaaaaaattagccagacgtggtggtgcatgcatgtagtcccagctacttgggagtctgaggcaggaggaccacttgagcccaggaaagtccccctcagaaagattaatcgaaaaaataaggccaggcacggtggctcacgcctgtaatcccaacactttgggaggctaaggcaagcggatcacttgaggtcagcaattgggagaccagactggccaacatggtgaaagaccttctctactaaaaatacagaaaaattagccgggcgtggttgtgcatgcctgtagtaccagctgctctggaggctgaggctggagaatcgcttgaaccccggaggaggttgcagtgagccaagatgccaccactacactccagcctgggtgacagagcgagaccctgtctcaaaaaagaaaatgtttaagtaggtaacatgtgaaggagacatactctatagacattaaaaagaaaggatggccaggtgcggtggctcatgcctgtaatcccagcactttgggaggctgaggcaggcagatgacctgagatcaggagttcgagaccagcctggccaaagtggtgaaaccccgtctctactaaaaatacaaaaatcagccggccgtgatggcggtcacctgtaatcctaggtactcaggaggctgaggctgcagtgagccgagatcgcgccactgcactccaacctaggcgacagagggagactccgtctctaaataaataaatgtatgaggaagagaaaaataatatggaggtcttcccttgacctcccccaacccccttcctttagagaactcctccatccttcacctaattcttcctagttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatggtgagtgttcctactgggccattatctccgggtcacctcccgagagctgtggtgccgcgagcgtggtcccgctgtgtcagaaaagctgtaaaaaaacggaaggaggaaaaggcaggtgcgcggtgtcgggcaggagaccaccgaggcaggcgctatagatgagtggtcccaccaggccatctccgtctccagcgactgccgtccaccctatgtccagcctccaaggccgaggttaggtggtagccgcagtgaatcactcgcgattcgcacgttacacacgatggcgacatgtggggccgcacctgggttataatatgaatatatccttgtatataaatatgtgtttgtaaaaacaaaaaaaaaagagaaaaattaatgaaaatgatttactggagcagtgggaatgagatggaaggagcggaataggcaggccactcacccaatatgctccctacatgggtgtgtatttatttatttattgagacggagtctcgctctgttgcccacgctggagtgcagtggcgccatctccgctcattgcatcctccgcctcctgggttcaagctattctgcgtcagcctctcgagtagctaggactacaggcgtgagacaccgcgctcggcccctacatgggttattttgacacagatctgaatgacatcattttatccataagtattacagtatatatctataaagtaagaatttttaacataactgcaaatgccattaattagttaataagggttgcaagttggtgatatttaactgtaccattccctctttatttattaggcggaagagtgatacaagaggtacttctcatcttctacctggttaccgcctaatacagcatttaggaaaggcacagaagatgattgtttccctttcccagttttcaaaatattgagttgctatcacttgcatagttttgacttttaaaccatgaagatattttacatatttgaaaaataaaatttaaagcaagctgactacaaaataaatctacttgtataccaaattgctaaccacaaggaaaattttaatttgaataacttttgaacaaagtcctgccactggatggctttgataggatatatcctaagaacaaaaataaattttgactttggtgagtttgttggtagaggtggtatattggtgtagcaattttggaaccattttgtgtgtattgtagaggaggtgaggaaatactttaatgtgttggaaaccatgggtttgaacagaagatacgcatatggagtggggaatggaaagaaaactttgtgctacatttactgtaaattatatcttattgattcagtaaattcaggtggaatacggaagttcaaatttaaagattacccatggactcctgacctcaggtgatccacccgcctcggccacccaaagtgctgtgattacaggcgtgagccaggagtttgagaccagcctggccaacacggtgaaaccctgtctccacaaaaaatacaaaattagcctggcatggtggtgcacgcttatagtcccagctacttgggaggctgaggcacaagaatcatttgaactcgggaggcagagattgcagtaagctgaaatcgcaccactgcactccagcgtgggcaacagagcaagactccatctaaaaaataaaaacagaaatggattagccatggactcaaatggatgcggagccatgggaacccgtttgtaatccattcgctgtaatattatcaaacattcggctgaagaaagacaaaagtacatgagctttagtatactttactgaactgtgtaattcctaatagtgtatttcctttttttcgaaggtaggagtggaaagtccattgttaactacctggtgttttgtgtgtttgagggttagggagcagggcagctgccccctgtgtctcaattgttgattagtattttgtgactcaggtaggaaaacttctggctcaatttgtctgatatttttatttcccccccatagactgaggctgatgtgaatccaaaggcctatccccttgccgatgcccacctcaccaagaagctactggacctcgttcagcagtcatgtaactataagcagcttcggaaaggagccaatgagggtaaggcagccacaggatgctctgggggaatgttaaaggcacctgtttccatctggggcctctgatctgatttccagtttgggaggagggctagctgctctcgactacaaccagtgggaggactttggcattagatgctaaagctgatgggctaagaattttttttagacccaccaattgttaacattttgccacatttaccttctttttcactctataagtgaattttatttttgctgagccatttgaaagcagttgtggagactgtatagtggctgtatgacctcaccagagccatcagaaggaaagggatattaatgctttttagcatcccttatacggtggatacttaacattcatgaatttcatttggttcccagaaacattccctacccctctcccttttttttttggatgcaattattcaaaaacatggaacgtttcacgaatttgcatgtcatccttgtgcaggggtcatgctaatcttctctgtattgttccaattttagtatatgtactgctgaagcgagcactacctccctttgtaaaaaaggaaaaaaaaaaagctgtttttcagtagaataattatgtatgcatgatgcttctgcccagaggtgatataggatactctcactttattcattattatttttttaattttattttatttatttatttatttttttatttggagagttttgctcttgttgcccaagctggagtgccatggcaggatctcagcttactgcaacctccgcttcccgggttcaaatgattctcctgcctcaacctcccaagtagctgggattacaggcatgcaccaccacgtccagctaattttgtatttttagtaaagatggggtttcactatgttggtcagtctggtctcgaactcctgatctcaggtgatctacctgccttggcctcccaaagtgctgctgggattataggcgtgagacactgtgcccagccttatttttatttttattttttttcaagtagagacgaggtttcaccatgttggccaggctggtctcgaactcctgacctgaagtgatccgcctgccttggcctcccaaaattctgggattacaggcgtgagccactgtgcccggctgcccagccttatttttattttattttatttttttggagacagaatctcgctctgtcgcccaggctggtcttaaactcctgagctcaggcaatctgcctgccttggcctcccaaagtgttaggataacagcaggcgtgagctaccatgcccagccagaatactctcattttaatagatgctgggtagtttgatgtggtagagctcttttgtcgttgaagatttttaatggaaacatcagagattttgtcaactgtgtttgagatttaggagaactattacaatcgcttttacctgtgttgctgaaggaagataaagtagactctgtgggtctcgtcgtagtgctctttcctccctgctcgtcacactgcagtaactgcagtgcctggtatagcagtggccagtggggcattgtagggtgacccaccagctctcctgggaggtctctcttctcacttgatgcactcaggtcagcttggctgggcagggatgtgacttcttacacttcaggtagatgaggactcatggacacagagcaaccttatttcctcttgccatactttgcacggtgataagcacacaggtccttgaatggagatgctcagtctcagcgacttaattcagaatatgcttactgggagttcagggagggagatgcaacaattttccgtacttctgcctcagtgtcaggtattctttcttgccatatttattgattgcctgctatgtgccaggcgcatgtatatatgctgatgatgcactggtgaacaaaatgaagtctctgccttcttggagtatacattccagtggagaaagacataggttttatgcctggtggtaaagaatgctgtaagaggccgggcgcggtggctcacacctgtaatcccagcactttgggaggccgaggtgggcagatcacaaggtcaggagatcgagaccatcctggctaacacggtgaaacctcatctctaccaaaaatacaaaaaattagccgggcgtggtggcgggcgcctatagtcccagctgctcaggaggctgaggcaggaaaatggtgtgaacccgggaggcggagcttgcagtgagccgagatctcaccactgcactctagcctgggcgacagagtgagactccgtctcaaaaaaaaaaaaaagaatgctgtaaaacagaataaagtagagaagggggataggaatggcagtggtgggtctttttagatggagtattcagagaaggtctgtctgaggagtttgagcagagaactgaatagatgagggtgttggaaagaaacgtttttgggcatggtgtaaaggcatgcttgagggattctaaggaggctggtgtgtggctggaactaagtgtggggatgagaggtactaggagatcacatgagaccatgtaggccactgttagcagtgagtacaatggtaaatgagtagaaggattttgaacagcaagattgctatgatcttacttaacacttataaaagagtcactcctatgacttttgtagggtgagtaagctatagtaatatcaatagaaatgaacatgctttgcatttgccatgtgtcaggtattattattattatttattttacttttttttgagatagggtcttactctgcagcccaggctggagtgcattggcattgatcatggctcactgcagccacgacctcctgggcttaggtgatcctcccacctcagcgtcccaggtagctggaactacaggtgtacgccaccacacctggctaattttttatatttttagtagagatggggttttgccatgttgcccaggctggtctcaaactctgagttcaaacaatctacctgcctcagcctcccagtgggctgggattacaggtgtgagccaccatgcccagcctcatcattcttattaactggtttaatcctttcaataatcctattaagtagaattattaggtaattagaattaggttaaaaagagctgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacattgccaagagaaaatgcaatgtgaggtaaaagatgaaaaagatgacatgaaaatggagactgatactaagagaaacaaaaagactcttctagaccagcatggacagtacccaatatggatgaaccaaaggcaaagaaaaaggctgacggcaaagcgagagaaaagaaaggggaaaagcaaagcaaaagcagtgaaagtggcaaagggtttggcgtggtagactcttaaaaccttggaaaatgccacatgggatagatgatggattagaatgtatatacatgtatactttgatttcagctgccaccaaatgaaaaccatttgttttcctattttaacttggccttttttcttcaattcaaacccagcataactcctgaagtttgttttgggaacttgaataaaatattttctttgatacaaaaaaaaaaagaattaggttaaaaagaattaggtaattctttttttattaggtagaatcctgttaggtagaattattttatagatgataaaagtaagggaagttaaacaccttgctcaaggtcatttgtgtaacaagaatgagtgccagcatttgcactcagacagtgtagctctagagtgtgtgcccttctcaagtactccagcatgaatgcagagtattcgcactgagccacagaggcaagcagtcaggagagtacgcatctgaaacggtgctgtggggtgttgaacttgcatggtgagtcgcatgtgggatcagctttctagaagtattgattatggcagattgagatggtaaaactctgactctcagtcacagataccttgagaaatactatattattaatatactactacttgctggtgggggtttgtggaagctgttgcagttgacaaggtaagagatgatggtgacttggacgagtatagcagaggagtagaaagaagtggtcagggccaggcgtggtggctcatgcctgtaatcacagcactttgggaggccaaggtgggtggatcacaaggttaggagtttgagaccagcctggccaacatagtgaaacaaaaaattagctgggcatggtggcaggcacctgtaatcccagctacttgggaggctgaggcaggagaatcacttgaacctgggaggcagaggttgcaatgagccaagattgcgccattgcactccagcccgggcgacagtgtgagactccatctcaaaaaaagaaaaaaaaaaaaaaaagaaagaaaaaagttgtcagattaggacaggcacagtggctcatacctgtaatttcagcactttgggaggccgaggtgggtggatcacttgaggtcaggagtttgagaccagcctggacaacatggtgaagccctctctctactaaaaatacaaaaattagctaagcacagtggcacgtgcctgtaatcccagctgcttgggagactgaggcaggagaatcacttaaacccgggaagcggaggttgaagtgagccaagatcgcaccactgcactccagctgtgtgacagagcaagactccatctcaaaaaaaaaaaagaagaagaagaagtggtcagattcaggacgtgttttgaggataagtggtggatttaatgtagggcttgagaaaatgccattgtgtatgactgactggtgtttgaatcctttatcatatcccagggccggtctaggacacataattgtgtgtgcctaggcattcttcccagtttgttgtggctgccctgcccaagcccacatcacctattagcttcacgtccttctctccgcagccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttatttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatgacagaatggcagtgcctgattcttagtaagtatccggctaaaattggaatgaagacatacttagctttactagagtggtgatagctgcttaagactttttttttcttctttgtgaaagagtttcactcttgttgcctaggctggagtgcaatggcacgatctcggctcactgcagcctctgcctcctgggttcaagtgatgctcctgcctcagcccccaaagtagctgggattacaggcgtgcgtcaccacgcccagctaattttgtatttttagtagagacagggtttcaccatgttggccaggctggtcttgaactcctgacctcaggtaatctgcctgtctcagcctcgcaaagcgctgggattacaggtgtgagccaccacgcctggccacttgcttagacttttttttaccagaaggctatggaagagctgtctcctcctaccaggtagtttctaccttggcagttcaaaatgtcgtcttatacacactcaactggagcattgctatcactggaactggctttctcaacctccgtgctgttgacatttggggctggttaatttgttgtgaggactgccctgtgtgttgtatgtttagtagcatcactggcttctacccgctaggtggcaatagcagcacccccccacaaccaaaaaatgtttccggacattgttaaatgcccccggcagtaaaatcacccccaattgagaatcactgttggagaatcagggtttctagtaacccttggcacatgcaggattggtattggtgactaaagccactgccccctcacttgcctcttctacttattatcttaaggataagttccttgagagcctaataactcagcttgagaaatcttccaaggtgcaagtaactgggtaccatagtgatcccctctttgccagcttgggccaatatacccctgctctagcaagaagcacacctgggggaacctggcagccaccttagccagtcggacctgttctgtgcatcctgggctggtcatttctcccagcttactccagtgttctcatcaccacccctgaagcagttttatatttttggatggtggaattttacacagtgcttactttttcacagtcatgcattcagtgtttttggtcaatgacagaccacatatatgacagtggtcccctaagattgtaatactgtgtttttactgtacctttcctacgttaagatgcacaaatgccattgtgttacaattgcctacggtattcagtaacatgcagtacaggtttgtagcctaggtgtatgtatagtaggctgttccatctagggttttgtttgtttgtttgagacagtctcgctctgtcgcccaggctggagtgcagtggtataatctcagctcactgcaacctccgcctcctgggttcaagcgattcttttgcctcagcctcttgagtagctgggattacaggagcacgccaccacacccggccaatttttgtatttttagtagagacagggtttccccatgttggtcaggctggtcttgaactcctgatctcttgatctgcccacctcggcctcccaaagtgctgggattacaagcgtgagccaccgcacccagccggtttttgtaagtatactctatggtgtttacacagtgacgaaattgcctaacaatgcatttttcagaacttacctctgtcattaaatgacacattacttttttttttttttgagacagtctcgctctgtcaccaaggttggagtgcagtggagcaatctcagctcactgcaacctccgcctcctgggtttaagcgatgctccttcctcagcctcctgaatagctgggattacagacacacgccaccacgcccagctaacttttgtgtttttagtagagacggggttttaccatgttggccaggctggtcgggaactcctaacctcaagtgatccaacctgcctcagcctcccaaagtgctgggattacaggcgtgagccatcccgcccagccaa

SEQ ID NO: 16769 - DNA, 63982 bp, Human
agtgctgagattacaggtgtgggccaccacgcccagccggatgtcatttctgaataagaataaccacagagacatgaatgagagggctctccaaattgctggtcttgacaaagatttgcttcccttgcattcttccccttgatgcaaaataactgccttttattggactacacccagtttgactcacagaacttgaagaaattataacctagatgactagatgaacacagtaatctccatagaccataggagattgcagtggatggcaaagtgttactaaacaaaaggagggaaggtcagatggaaagctgtacacttacgtccttctcctggatggtgcactccttacaataataggcatcagagaccccaggtcctccacagatcacacagcgcccctggtaagatccatagttacactcatcacatatgcgcaccagagtgcagggacgcacataggagtcacaaatcacacacttgccatcacctgtaaggaagagaatggagtcatgctcacaagttcttcagtcctctgctatctcctgccatggggaaatatactagtctcctgggaaatacactagtctccttttgacagtgactttagggccctcctcttggcatcacaaaacttggtttccccagtgtccatctcaagcccctcaacacatacaaaagtttaccaattaacatatgtgaagagcttagaaaagcacctcggagatgataagcctgtataattgctggcaaagtgctgtgtgttggggaggggtcatgctactctggcgattcttcccgttgaaaactagagagatacagcgttaaatgtgcaagcggcagtggggagttagaggggcctttggctaaagtgcagcattcagtgttcacatacttccaggcacatctactcaaagccctctttgtggcacttttgctggttccacagaaaactgggagtgggaagggtgggttgttgggacggtgtgttccactcacatttttcacacagtcttccgatggctgcaagatgaaagatggtaaaaagtacaattagaataaaggttttgagaaagaggagaagtacctcctcgagctgggggtagggacatgagtaaggactgcagtgagtgagacctgcggatagccattttatcattacaaatttccatatgaaccaaacctacatccaagcaccctcctgaatctcctccaacgccctgggcaagctcagagtttctctggacctggttcagaccccaccccccgatacctgcctggggctcccagcacgcgcacccccgccctcttctcatcagaggccacaaacctgcgcgctcctacaacaccccgcgcctgagaggcgggaaacgtggcgcctgcgaggcaagcccctaaggaagagacgggaacccccgaccccccagctcctaataccacccctgcccagacagccaggggtagggcgcagtctcaccaacaccagcctgcttgcggcaaaagatcaaatcaggatgatgtttagccatagctcctaactaagccggccaccggaagcttcgggaacttccgtccgacctttaacccccattgttcctgcctccacgtcgctgtgattggttctctaagcttccgtcagtttacaatccttgcaccaggcccgtcttgctctcgcgcgagtttttgtcgctgctgggcggccaggtcctggcaggtgcatgaaactcttaaaaactctcccagatttggatggcggagataactaaaatttgttcttgggtaaaacatctttgtgcttggtatctatttctgcaagtgtctttgggcagtccgatttcctcttgcgtgtctgttcgttgcacgtgagctccgcccattgcgttcacagggttctggcgcctctagggaggcctcgccttcaccgtgacgccccactcttccgggcacgcccctgcccaaaggctttaaaggcgccgtgtgggacgtcactttaatgcgacctcatctttgtcagtgcacaaaatggcgccctacagcctactggtgactcggctgcaggtgagcgagctcagggacctctgggttcacgggggcggggtgcctcctactgtgccggcggctgtgggcgaggcagggcgaggcgggcccaacctggggccaacttctcgtgtacctgtcccggttgtgggcccggcacccgtgcccgcttctctggtgccctaggtcaaggcgtccccggcacagtcagctttcctggccctgtccctgcctcgcaagaagcgtgggcccaagcagcggcggccgggtgaagagcggaggcacctctttcttctttttgaggacagcattgcctgctcccgtggggtgtgtttccattcctcaaggtgaggacaaggtgactagggggcgcggtcgttgttgagtcttctaggcccagttcctgaggcctcacttcccatctcttagcaacagaggcatgacagcatctacggttgccaggcctggagtctggagaagaaactaggaccctgtaccaccttttgaggaccctgcggaacgtggaatgtcggggaggggggcggtcttctgggcccatacgtagtaaataatataataatagtctctcacctttgcacaagatttgaggcctgttttaattcttcataatattatttgattcatgtaatcgtaggaatgaggtggtttttctcatttgatgataaagctggtagaaagtaggtgaaagttctgattctcaagagtgtcaccgaagtgctgtggcagaagcatgggccctaccaccactcagttcttgtttatgtcagcctgccctcacagaactttatgaaccacggtgcaattatttctgtttgtcagaatgcagtacgaatattttgagcctcacaataagttgcttgtcaaatatgggaggataaggagactccagtttgaccttgactcccctgttaggagctatctagaaagctgactgactgccagatgattttttcacttctaacttgacagccctgggaaggtgttatactcagaggttcaatgtcaaatgtgtactttgttaataaaaatcaagcaagcatctgtagacattctctgtcaacctttcacatttaactttgtgaattccttttggatcaagtggcgcaactttgataatagaattttacgagttgttatgcgttgtactctcaggaagcttgtggtacttgaacttatttttcatcacattgcttaaatttaaacttgaacttatttttcatcacattgcttaaattgaaaccatatggtttaaagtaaaatcatcatttatctgaaagaaaatatttctgatctcaattccgggctaagggaaaggatttgcacctaattatctctttacatctttttttttttttttttttgagacagtcttgctctgtcacccaggctggagtgcaatggcgcaatcttggctgactgcaactctgcctcctgggttcaagtgactctcctgccctcagcttcccgagtagctgggattacaggtgtgcaccaccatgcttggctaatttttgtatttttagtagagacggggtttcaccctgttgaccaggctggtcacaaactcctgacctcaagtaatcggcctgccttggcctcccaaagtcctgggattacaggtgtgagccaccacacctggcctcttcacgtcttttgattctctaggttaatgatgtggaaatagttgtttcttcctgtctcatgatttaagggagtcaggcaagattatttggtaagataaatgattatagagttcttgaacttggaagagaagaatagtatcacaccattttgaaccgaaaaggatcttggaaagtatgagtattagactggtgtagaaggagatctgggctctctttcctgatcctgtgaccttgagtaagttacttcctgaatccattgtctgtccattggagatgatcttcattgaacaaatgtatattcagcaagtggatgttagaaagtgatgagcaagtagaatgagtttacaaccatcacgtagactaacctcttatacaggtggaaaaatctaagaccttgagagcctgggtgacttccagtagcagagtcaggattaaaatcctggtctccttgtttgttccttcagctaagatgaatgaacaatattatgcagtttgcacactgcctcccaataaccaggctgtctcaaataaccaactaacacggtttctctgagaagcttgtatatttaccccttttgtgcttagatacatttgagaagtgatggttactaccttaatagtcatgtatgcaaaaccctatgcctgtagtcaattcattcctacctcattcaccatatatttactgagcgcccaatgcttgttctggataccgtggtaagcaaagacagtccctgttctcgtggagcttccactgtattctaatgtacctgactgcagagggccttggagatctttctcagccaaatatagtatttttctttccttggctggaccaaaggtgaaggtagataatagaatgatgggtgttactcccagcactaagagtacctaacatttatcttactgtgtatgactaatttcacatgactctgtgagatgaggcaggcctattagcctgatttatagatgaagaaacaggattagagagcaaacatagtgttatggttgagagcatggactctggcatcaggcagcctagatttgaataccgtaatgactctaacactcatgtagctgtgttttgggtaagttactcaacctctctgcacctgtttccttgcctttagatacaataataatagtatgtctgtttcaatcatgtaatagttgtaaagtatttagaaccctgcctggtacttaataagggctatataattgctaaataaatttgtggcagggtgcagtgtctcacgcctgtaatcccagcactttgggaggccaaggcaggtggatcacaaggtcaggagttcgagaccagcctggccaatatggtgaaaccccatctctactaaaaacacaaaaattagctgggtgtggtggcaggcgcctgtagtcccagctactcgggaggctgaggcagaagaatcccttgaacccaggaggcggaagttgcagtaagccgagatcgcgccactgcactacagcctgggtgacagagtgagactccgtctcaaaaaaaaaaaaaaaaaattgcctggggctttatcagtagttgttagtaggtatggtttgaatctggacatgtctgattccgaagcctgagggcttagcaactggcactatgctgcttccctttggcatcgagctcagcctgtggatcagggcaccataacctcagaacagtgccaagttgaatgtgtactctcgtttgacagtacctgctaccaggtagtaagattagaaataagaaaatagaacgtgggttttgttttattttgttttgtttttttaaagaaatgggggtctcgctatgttgcccaggctagtctcaaattcctgggctcaagcaatcctggcttggcttcccaaagtgctgagattacaagcgtgagccactgcaaccagctaaggaggtgagatttttgaaaaaccacatttattctctggtttttagcatttatttttgtgcatatgactgagtagtacacaagaggggctgagcagttgcaagtatgtttattaggtgtttggttttgccttgagataactggggtgctgaggtttcatgtgaccttgggggaagtcatgtaacctcttgcatataaatttgtgatggcagttaactacaaaaatatttggcagaaactctgtgccatgttaaaataaaatcttggtttgaattgtgaaacagatgattctggttgtatggtcactgtgataaccttcgcagatatcagttgttattagaattgagtgaatgaattggtaaataagcttccatcttagatgtggacagagggaacagacacaccatcctgaggattaagggagcacagcattacctttcaaaccaactgcttcacagtgttctttgaaagctttggctgggctcggtggctcacgcctgtaattccagcacattgtgaggccaaggcagatgcatcacctgagatcagaaattcaagaccagcctggccaacatggtgaaacccaatagctaataaaaacacaaaataagccgggtgtggtggcacatgcctgtaatcccagccactcgggaggctgaggcaggagaatcacttgaacccaggaggtggaggttgcagtgaaccgagatcacgccattacactccagcctgggcaacaagagtgaaactctgtctcaagaaaaagaaagaaaaagcttaatgtctagcactgcctagcattgttctagacactgggggtgcagtagtgaacaagaatagtggggcttaaattgttgtcctggggaaattacgtagaaaaataagaatattgtattactgagtgttgtggggaagataaggtagagagaataggggtgggaacatggcatttttaactggggtgtttggggaagacctcgtagaagaggtgacatctgaactgggacttaaatgatacgaacgcagctgtttaccatttttggaggagacttcaaatagaaggagcatgtgcagagcacccacctaggtatgagctgagtgtgttgaggataagagctaaggccagtgttgctacagtgtcctgaggagcgaaaggtctgaacaagaggctggggctagggtcaggcaggcttcggtaaggaaatccaagtgtagtgaaaactgggagattttaagccagggagtgatgtgatctgatcatctgggctgctgcgtgcatgatggaccatagagggtcaaaaggaggaggcagggagaccagtgggggactgttggagtcatcccaggaatggcagaggagtctgggactagggatctggggggtggagataatgagatgtattcaaaattgggatatatttggaggcagatgggttggcgcatgggagggatagagaataagggtgactcctgggtttggggtcttagtaactgagggatgggtgagcttgattgaattcagtggtcgtgtgtttgcagtcattttttttttttttttttttttgagacagggtctcgctctgtcacccaggctggggtgcagtggcgcgatctcggctcactgcaagctctgcttcctgggttcatgccattctcctgcctcagcctcccgagttgctgggactacaggcgcctgccaccacgtctggctaattttttgtgtgtttttagtagagacgggtttcacgtgttagccaggatggtctcaatctcctgacctcatgatccgcccgcctctgcctcccaaagtgctgggattacaggcgtgagccactgcgcctagccttttttttttttttttttttttttgagacggagtctcactctgtcacccaggctggagtgcagtggcgcgatcttggctcactgcaagctccgcctcccaggttcacgccattctcctgcctcagcctcctgagtagctggaactacaggcgcccgctaccatgcctggctaatttttttttgtatttttagtagagacagggtttcactattagccgggatggtctcgatctcctgacctcatgatctgcctgcctcggcctcccaaagtgctgggattacaggcgtgagccactgcacccggcctgcacagtacttataaaaattagctaagggcagaatctcattgataaatttttgattctttcatcagttctcaagtactttatttcacaggtgagaaagccagatgacgtcaagtgtcttacccaggggccctcacttgagtcgagtatgagcatattgtctcatgtggactctgtcctatctggtcttattgtgaaacctggtgtgtgtccaagagggccatcttgtaaatgcttaccttttttataaaaaaaaaaaaattgttttttcctttttttttttttttttttttgagatagggcctcattctgtcagccaggctggagtgcagtggtgtaattatagctcactgcagccttgacctcctgggctcaagcagtcctcccaccccagcctccctagtagctgggactagaggcatgtggcaccatgcccaactaattttttattttttgtggagatggggatcttgccatgtcacccaagctggtcttgaactcctgagctcccaaagtgctgggattataggcgcgagccactgtgcctggctagtgggaagagagtgttgagtcttccttggctccagctttctttgacttgcctcgttttcccagcacctggtttggaaggcagtggtgggctctgggcctctcagcatgaaggaaggaaggtattgtagagagacttcttgtagcctttaaaaagcagcaaatgggccggacgtggtggctcacgcctgtaatcccagcactttgggaggctgaggtgggtggatcacaagctcaggagttcgagaccagcctggccaatatggtgaaaccccatctttactaaaaatacaaaaaaaaaattagccagtcgtggtggcgcatgcctgtgatcccagctactcaggaggctgaggcaggagaatcagctgaacccaggaggtggaggttgcagtgagccgagatcgcgccactgcactccagcctgggcaacagggtgaaactctgtctcaaaaaaaaaaaaaaaagcagcagatggaccctcaggagccttaggagacttctgccactggcttactgggtagcttcgggcaaagtctcaactctctgtggtcctgcagttagttacacatctgcaaaacagtgtaattaataactacccttcagttaagaagggttctgaaggcctaatatttgaaaagttgttttgactctgtttgatgtgttataaagcattgtgagccgggtgtggtgcctcatgcctgtaatcccagcactttgggagcccaaggcaggtggatcacctgaggtcaggagctcaagaccagcctgaccaacatggtgaaaccccgtctgtacttaaaatacaaaattagtcaggtgtggtggcgcatgcctgtaatctcagttactttgtgggctaagacaggagaatcgtttgaacctgggaggcggaggttgtactgagttaagattgtgccattgcactccagcctgggcaacaagaatgaaactctgtcttaaaaaaaaaaaaaaaaaaggccagacgcagtggctcacacctgtaatcccagcattttgggaggccaaggcaggcagatcacctgaggtcaggagtttgagaccagcctgaccaacatggtgaaactccatctctactaaaaatagaaaaaaattagctgggtgtgtgggtggtcgcctgtagacccagctactcgggaggctgaggtacgagaatcgcttgaacctgggaggcagagcttgcaatgagccgagattgcgccactgtactccagcttgggcaacagagcgagactctgtctcaaaaacaaaacaaaacaaaaaaacaaaaaaacacacacactgcaaatagtttctgatattattttaggaataggccatttctaagattgagagtagggacagattttccccttgtagaatatcttcattttggaagtcttgaaaggtagggagaatgggccaggcatggtagctcacggctgtaatcccaggactttgggaggccgaggtgggtggatcacttggggtcaggagttcaagaccagcctggccaacatggtgaaactctgtctctactaaaatacaaaaaattaactgggcatggtggcgtgtacctgtaatcccatttacttgggagactgaggcaggagaatcaggttcaagcgagtctcctgcctcagcctcccaagtaaattaaaggtagggagaatggtttccatattatttatttatttatttatttatttatttatttatttttttgagacggagtctggctctgtctcccaggctggagtgcagtggcgcgatctccactcagttcaagctccgcctcccgggttcacgccattctcctgcctcagcctcctgcgtagctgggactacaggcacccgccaccacgcccagctaattttttgtatttttttttttagtagagatggggtttcacggtgttagccaggatggtctcaatctcctgaccttgtgatccacctgcctcggcctcccaaagtgctgggattacaggcgtgagccaccgcacccgacctctttagttttattctgcagcacctgggccagaggaaggggcaccagctttggagccaggcctggaattccaccttgctgcgtgaccctgggcaaaacagttagcattccagagcttcagtttcctcatccattaaatgggcacaatgccttctgcctcacagggtagtcgtgggattgtgtggataaagtacttggggcaaatccagtgcagggtagaggcacttggtgaatattcatttctgtctccagcccctgcagatggcccgcggcatccatcaccccagcctttatccttagctcatacgtttaaaaaagaccagttgtggccgggcacagtggctcacgcctgtaatcccagcactttgggaggccgagatgggtggatcacgaggtcaggagtttgagaacagtgtggccaatgtagtgaaaccccgtctctactaaaaatacagatatgagccgggcatggtggtgtgcgcctgtagtcccagctacttgggaggctgaggcagaagaatcgcttgaactcaggaagcagaggatgcagtgagccgagatcacgctgctgcactccagcctgggcaacagagcgagactctgtctcaaaaaaaaaaccaaaccagttgtgaaaattgcttgttcctcccatcatctccccagatagcaggtaagtggtagttgttcaaggaaacctttttttcaagatagagtctcgctctgttgctcagtctggatgcagtggcatgatctcactgcaacctccacctcctgggttcaagcagttcttttgccccagcctcccaagtagctgggatcacaggcacgcaccaccatgcccagctaatttttgtattttttgttttagtagagacagggtctcaccctgttggcaaagctggtctccaactcctgacctcaagtggtccagctgccccagcttcccaaaatattgagattacaggcgtgagccactgcgcctggccaagaaaaccctttcaatactgttttaaaagagttgggggaagaggtagaaatgaatcttttggtttagttttttaattctctaaggacaacattggggaagtgagctttagagttatatttgcagtatttatttttatcatgaaatattcaagtctaggcccttggtgaattgaggcctggtgagtatttctgctttccccctggagagattgagatggtttctgattgggagctttaattctgtgggcatttgtgggacttaccaaagaggtatctagagttcctttaaaacccccgccctgtccctgccacatatcttcttttttttttttttttttttgagaaggagtctcactctgtagcccaagctggagtgcagtgagtgacacgatctctgctcactgcaacctttgcctctggggctcaagcaattctcctgcctcagcctcccaagtagctgggaccagaggcatgcgccaccacacctggttaattttcttgtatgccacacttctttagttccttgtagccgggctccttgaccttctgcagggcatctgtggttgtggtatttataagcactcactgtgtcatgagtgtgttcacagagctctaagacaagggccctgtctgtggaagagcttttagggtggtgagggagaagtcatctaaatagctataatacacggtactgaagcaaggagtaggtgggggaatttgctgggtgggactaagtacagcctcagccacccgtcctggaacatggatgtagtggtggtgtgtttggtccgcccacagacaatgacagatgcccatccaggcctggaggagcggagaaacgcattacccaccatctgttgagcaatcaggccctctgtgccagtcacagaactaggtcttgttttacaaatattgcctcatttgtccttcacaacaaccctaagaagtacatatgagtagcctgtttcacagtgatgaaactgagtcccagagaggttaaatagctcctctgaggtcacagctagcacatggatgcagatttgactgcagaacccaggctttttaccagtcagccaaaccgtttccccagagggagtagaaactgatctctgtggagtgggctggatataggggatacagttcagtcggctctgtgcctgtttgggttatgtctttgagactgtgattgtctcctgccctaaacaccagtgaggctggtgggggagaggctagaggggtgggttgcacagaggcagctttattccttgactgagcttcagctcagcctcacaggctgcctgttgagcttgcagagaatgcccgtctcaagtgtgtaggtgcagagctgctgcctgtggggccagagcagggcttgggatttgtatgcagttcatagtgtacgactgatgtaggcagcaaaagagaattagtcagatgagcgaatctgtcatcagcctattccttaaaggaaccccctgctgcctttggtacccatttagaggctttgacttggagagacatggctccttgctccctttccaagcctctgaaaaggactgcatcacttttgttcctgccagttgcatagcaaccaagctagctgactgcctgctggcaggagggaattgtttagctttgatttcttaggagaggagccaggcatcgcctaccaggagggggagaaaattgttagaagccctgcaatggaggtgtgggaagatgcttctccttaggagggtgtggactgatgtgcattcctgtgttgcccacttagacagagtccacctgagacttctctgccaggaagggctaggcagttagttgctaagagatgtgagcccgaagtcatccttctgtgaaatgggctgccgtgtaatgtatgagttccccactgctggagacagcttggctaggttgggtgagtgtgttaggcattcaaatacagaaggagtggatagatgaggccttttcagttccatttcaattccaagatgtgctgtcctggtgcttgggacctgctctggggctctggtctttggtggctggggagggagaagtaggcggcatagtggaaaaacatctgcccgtaatcctctccccagtacacaggcaggccacgttttagtagcagcatctcattctcccaggcgaactgagtaatagcagcttacgtttattgaatgcctgccagaagcccagctaccaagctctatgcctttcgtatatattttttgtaatagaatgcagtatattcataaaagctctcttctccccgtcccagtccccagggcaattttgtgtttatcattctagacttttcctctgtatttacaagtctttctaatcctcacaaaatctctgccatttttgttgttgttgttgttcttccgagatggagtcttgctctgtcacccaggctgcagtacagtggctcgatcttggctcacagcagcctcaaactcctgggctcaagcaattctcccacctcagtctcctgagtagctcagactatagacacaggctaatttttgtatttttttgtagagatgggggtctcgctttgttgcctaagctggtcttgaactctgggctcaggagtggtggtgatccacctgtctcggcttcctaaagtgctgggattacaggcatgagccattaccctcggccaaaatctctgctcttttacccccatgttacagaagaggaaattaaggctcagagaggtaaagaatcttacctgaggtcccacagctagggaagctgagattccaagccagatccctccagccctagagtggatgccatttctgtgactcggcacttgtcttggagtgtttccatgatggcactctgacaagtgcttggtgacttctctgtcagttgttaaagcaactgtctcaagagacctggcctctcccggaccctggcctgtttgggtggctcggcaccctcagctctgtagcttgctctgtatgctggggctcactggtacatggctccccaacaagcagtgctgtatgcaccatgctggacaaggtgggcagaagcctgcccgagaataggtcagtccgtttcgattgtagtattctctgaatacaactggtcccaagggaagacctccgacctccgtcctttgggaagagagggcagcatgtctgactttggccgagtggggttgtggggagttctgagtgggtgtacatgtgatgtgccgtggggtgggcccttttcccatctgccacagctctgaacccgtgctgttgctcatcacggcttctgccagaggcacttaacttgagtttgaaagcacaatccagaaggccggtggtcgtgtcacggctctgccttcatctgtttcatcagtaagtctttcttgaacttcttctatgtgttggacattgtcctaggttctgaatatattgtgaccagaatagaccattttttgtccccatggagcttatattttagtggactttactttcccatctggtccaagtctctgtcttctcatgtaaacaagggacagaatgacctgtagtagtcccacttggcacaattgttagggtaagagagctgttgtcatctcgccagcagcatcctttcttcccttgtcttgcctagccgtgtggtgcctggctccccggtgggggtctgctgtggggatgccccttccctcagcgtttgcccactgttctgtgttggtagatgcaggatcagcagagcctcccttactccctggaagccctggagatttgtggctcatccagctagactcagcaaaggcacttagggtcagcagttgggaccaacaaccccctggaggactcagcccacctggccgctgggcctgaagcagaggttgggagacactgtcggtagcacagggagaaagtctcggcctctgcaagttcccagctgtttgaccttaggcaggccccttcctgtctctgagcctctgcagcttcaggcagttagggaggctgagctatgcacagcaaggttcacaagagtcacacagagatgtgtgggaggtgatagttactccaaaacagatctgtgggcatctggctactggtcaccctgatgggagactcccacttaggtgtaaaattaggaagttgttttgtggctgaggaagtgctataacgatgcttaggatggagaagacataattgtggttttcagtgatttgaagggctggttgtggaagactgactagcctcatttgatctggttccaaaggataggactaggaagttaggcctgtcatgtgccaggcactggtctaggttctctcctttcatcctcactgcagcctgtgaagcattatccccatttacagatgggaaaaattgatgtttagagggattaaataaaaccacagaaggttatacagcttgtaaggggcagagctgggatttgagcccagatctccaaagctggaatgatgtaatgggggcacattttcatttgatttaagaagcattagtttaaaatcttagaactgaccagtagtagaataggcttttgggaagagagtgagcttccagacctagtcatgttgaaccagggggcttatgggagttgatgaggggagattttctgcctcgaggccacctcagtcctgccctcagcccctttgttccccagaaagtgggggaaagtggagggcgagggcgcagtgaaagtatttcttctagatgagggcctgggatttaccagtgaggattttacaaggcctgagacgtaggctccaagtatgggaaaaaattttcccgtttcccagttttgggaaaactgtgttggatggccttatgggtgacctcaggaatgtctctgtggcctgaggttgaactgagcattgagtgtgttttacttttggaatcaggaaataaaaacagaactctgtaaagttatttttaaaaaatatggctgggtgcagtggcttatgcctgtaatcccagcactttgggaggccaaggcgggcggatcacttgaggtcaggagttcgagaccagcctagccaacatggcaaaaccctgtctttactaaaaatacaaaaattagctgggcgtggtggtgcatgcctgtaatcccagctactcagcaggctgaggcaggagaatcgcttgaacccaggaggcagaggttgtagtgagccaaggttgcgccaccgtattccagcatgggcgacagagtgagactccgtcttaaaaaaaaaaaaaaagaaaattaaaaatatgcccaaggcatcatcatcatccttccttaaataatactgggctgggcatggtggcttacacctttaatcccagcactttaggaggctgcagtgggaggatggcagatacttgaggatgtgttctctcaaaacgacagtaatctaagaaaaatccattgaatccaggaaacaagaatccaactcaagaggaggacaggatattctaaggatactaatggatgtgagttccagagaggtattagaccttatggggaaggagacagaggctccaggagatgacgaggctggtggatctcctgacgcattcataatatcgagtgtcgtagccgatggagagtttgagaatgaatttgtgataagtacaccaagtgttgaagtttgttgtctttggggcagggaaatggggggttgggacttgagtcctggtttcctttataatgatagtttttaaattttaataatgcgtaaagatgttactctgatcaaaatagaaaattacattaaaaacaaaagtatcaaatactactaataaagattagtattatcagggttgtatttgctcagaaacttcagccctgacacctgttcagtgtgggtacaatggattccatggtaccagggattgtggggagggagagatgcagcatggactagtgcttggtgccttgcttggagtcattgagtattagagacccacaagatatcctgtaccaggccagggagctggtggatgggtaatgatgatagatgtccctggatgggcttcagggagtctgtaaaattgtgtgttttatgatttttctatattttctccatgaaatatatcttgctttttataacggaggaaaaattctggtaattttttttttaaatagagactaggtctcactatgttgcccaggctggtcttgaactcctgagctcaagtgatcctcctgcctcagcctctcaaagtgctggaattacttttagtattttacatattacataattacatacttgctattctttgggaacccattcatattatttcatgcctcacagtaactcagaataacattcatatcatttcattcctcacataatactgcagatattattctttttttccaagtgaggaaattggggtgaaatgtgcttgtcatgtaggtagtaagtgacagagctgggctttggagtcagctcttttttttttttttttttttgagatggagtttcactcttgttgcccaggctggagtgcaatggtgcagtctcagctcactgcaacctccacttcccgggttcaagtgattctcctgcctcagcctcctgagtagctgggattataggcgtgtgcgaccacactctgctaatttttttgtatttttattagagacgaggtttctccatgttggtcaggctagtctcaaactgccaacctcaggtaatccacccacctcagcctcccaaagtgctgggatccgtgagccactgctcctggtcaggttaagttatcttcactgtgccacattgccccttgtaaacagcaggttatagttcaggtttttaggacagcgagccacaccctcccctgcctggctgggtttccaccctgatcttccactatttcctgctttgtcttttttttcgagatggagtttcactcttgttgcccaggctggagtgcaatggcacaatcttagctcaccacaacctctgcctcccgagtagctgggattacagcatgcgctaccatgcccggctaatttttttttttttttttttttttgagacggagtctcgctctgtcgcccagtctggagtgcagtggcacgatctcggctcactgcaggctccacctctcaggttcacgccattctcctgcctcagcctctcgagtagctgggactacaggcgcccaccaccacgcccggcaaatttttttttgtatttttagtagagatggggtttcactgtgttagccaggatggtctcgatctcctgaccttgtgatccacccgccttggcctcccaaagtgctgggattacaggtgtgagccacggcgctcggcccgcccggctaatttttgtattattagtacagaccgggtttctccatgttggtcaggctggtctcaaactcccgacctcaggtgatccgcctttcttggcctcccaaagtgctgggattacaggctcgagccaccgtgcctggcctcctgctttgtcttttacaccccagcattttgagtgattggcagcttctgcatgcttcacttggtgagtctctgtgtgcatgctgtgtgttctcttcacctgccctgcaaatgcctggttgccctctgcgaccctgctcaggcgctgctctctctgtgaagccttgtggaaacatcccaggcagagcttctcattctctgtgctccactcctgccccttgtgtgtgtgtgtgtccttctttcaaaggttacagtgaggttttgcatttacttcctgatcttggctagactgaggcatattagtctagtgactgtctcactcttcttggtatctgagtcctattgcttggcacataatagagtgcaaatgtgctgctaggaaagagggtacacgataagctactgtcaacctcttcttttttttttgagacggagtctcgctctgtcacccaggctggagtgcagtggtgtaatcttggctcactgcaacctctgcctcccaggttcaagcgattctcctgcctcagcctcccaagtagctgggactacaggtgtgtgccaccacgcccggctaactttttgtatttttttttttttttttttgagacggagtcttactctgtcgcccaggctggagtgcagtggcgcgatctctgctcactgcaagctccacctcccaggttcatgccattctcctacctcagcctcccaagtagctgggagtacaggcacccgccaccgtgcccggccaattttttgtatttttagtagagacggggtttcaccatgttagccaggatggtctcgatctcctgacgttgtgatccgctcgcctcggcctcccaaagtgctgggattacaggcgtgagccattgctcccggcccattgtgtagcatttctacaccttcaaggtccctcgtgatacctggttcctttttgtctcctcagtcttattttctgccatttcttcttcactttgccacaaccaagctgcttttcttttgttttcttttttttgagacagtctgtctctgtcgcccaggctggagtgcagtggcgccatctcggctcactgtagcttccgcctcccaggttccagtgattctcctgcctcagcctcccgagtagctgggattacaggcgcccaccactacgtccggctaatttttgtatttttgatagagacagggtttcaccatgttgaccaggctggtctcgaactcctgtcctcaggtgattcacccacctcagcctcccagagtgctgagatgacaggcatgagccaccgtgcttggctgcttttcttttctttcagttgcaagtgctttcttgcacatgctgttctctctgtgccaaattccctggactccttcccctaaagcccatttgtttagcctcagatcaaacatcactttcttggagaagcccttcccccattctggattaagctgtccagctttatgctgttacagcagcttaactttttatcacagcacttctctcacatagtcacttacacagtcccttgagtgatgacttgacatgttttctcacctaaaattcaggcaccacaacacatagtctgggactggagaaacatttaatgaatcaggaagacgttagtttaaattggggaggtagtatgggagggaaagcattgacttgataattggagggcttgaattctgcccctaacttctgttaactaggtatgtgaccttggcattcatatcctcatctgtcaaacaaagaaaaaattcttggtgatctggggtcatcttgagttgtgataatctatacttctagatgaatcatcaaattaacacagctctagagggctgcttatctaggatgagaatccacctgcctgcttggcctctccacttgggtatcagatagtccaatgtccagaaccaaactcctgatctcaccgtgcatgcctgctcttcccgttgccttccccatttcgtttatagcaacccattttcccagttacttaggtccaaaacctaagttatattcttgattccttctctcacaccccttggccaacttttcagcaaatcctactattattaccttcaaaatatatgcatctctagccagtttttttgaacttgaactcaaacatgatctggtttgagcctgataaaatcttgcctacttttgcgcttgattgctcatatttctgtggcctcactgaatcttgcacctaatgtgcacaatagcaactataatactacagcactttctgttttggtgtcttccttattctaccagatggtaatcctgacggtaggggccccatggtggtgttcccagtgtccaatgtggtacaactaggcatccctcaggtgcgctatagcagatgggacgtgggcatgtcaagatagtgagccctggctttaccctaccctagcagggtgacatgctgagcctgccggttgcctcctggcagcagtttagtctgcttactgctctgtggtgtccaaatgtattattttgttaatgtgccttaacttggaaaagcttggaagcctcatggtaacagcatttggcacctaggaaggtattcattgttaaatgaattctttgttaagtgaggtagactacagggatcattctccctgttttatagaagaaagagtaagctgtgtgaccagccagtggcctgatcataatcgagtgctgttctgagtctcatgtgcgttctggggcaacacactgggttgcatttcacatgtgcacacatgtagctcgttgcttccttacctgcatgtacatgaaggtgaaggctgtggctaagccagaagggcctgggttctgggggtttcttccttgatacagataaatccattctgacattgctgtgctttcctccaggcctttggggattaagggggtttactggagagcctgcttgctggggaggaatatttatagactgtgagctggaaggaactttggagaacatcaggttcagtggttaccagatgtggctatctcagagtaacctggtaatcttttactgatgcttaggccctactgcaggtgatctggttcagagctctgggagtgatagggcttagaagctgagtttttacaaaaccttccaggtgattttgatacagctggaataatccagttcctcctcctccccttttttttttgagataagatcttgctctgtggtccaggctggagtgcagtggcacacatgatcacagcccactgcagccttgaccttctggactaaagctgtccttccatctcagcatctcagggagctgggactacaggcgtgtgccaccttgctcggctaattttgtttatcctttgtggagacagggtctcactgtgttgtccaggctggtctcaaactcctgggctcaaaccatccttctgccttggcctcccaaagtgctgggattacaggtgttgtgagccctgcactggccaaataataatactcttaatagtaatacccagaccacattcttaatttcttccaaaatgtctttgatagctatctgtttccaaatcgagatctaataaaaaacatacattgcatttgtttttccatttctgcctgtcttaatctacagcagcacccccgctccctgccccagcactttcttccccatgacattgactctttgaagagaccaggccagttttcctgtagaatgtccaccttctgggtttcattgttcttttttcctcctgcatttcccttactctggaggtaaggttccaaagcttgcttagatgcaggttaaacattctgggcaagacttctttataggtgaggccgtgtcaccaggaggcaccggtgtcgggtggtcctgctgtcggtggtgccgtgtttgatctctgggttaaaatggtggtaatcagatcctgctattgtaaaggtacattttttttttccttttccttcatagtgataacttcctgtaagtaaacttgctgaaacaaagggtttgcacatttcaaaaaaccaaaacgcttttgattattgtcaaattgccgctaaacaattctgctattctatattttaaggagtatgcttttcttcactatttgcctggtttattttttctttttctgattacaaaagaaatgtatatatcatgcaacatttaaaagttacaggccgggcacggtgtcttacacctgtaatcctagcactttgggaggcccaggcggatggatcacctgaggtcaggagttcaagaccagcctggcaaacatggtgaaaccctgtctttactaaaaatacaaaaattagctgggcgtggtagcacgtgcctgtagtcccagctactcagtggggggctaaggcaggagaatcgcttaaacccgggaggcggaggttgcagccagccgagactgcgccactgcactccagcctgggcgacagagcaagactctgtgtcaaaaaaaaaaattgtggtcaaatctaacagaaaatttgacattttaaccactttcagtgttcaattcattagtactaattatgttcataatgttgtgcaaccatcaccattatcttctttgtaaacagctgtagagtggcattccatggtgcatgagccagaatttattcaatcagtgccctgtgtatggacaattgggttgttctcttaaaaacagcgccgcggacagtacctttgcctgtctctctgctcttttatatattttaattagatagtttcctggaagagggaaagctagtcaaagagtgcaaacactttacattttaatatgtattacctaattgtctttcaaaatgttgaacctctttacagtctaactaaaagcatctaagactgataaagtattgatttgccttgataactgttggctctcacaagactaactcaacctgctctgtattttaatcctgcttagtaaggaagagctggttgggaaagtagaagcaacatccctttttttaactaattggtatttatgtaacacctcctgtgtatcgggcttgcttttcaggccgggggattttagttatgaataaacagagacaatctctccctagtggagcttacagactaaaatatttggagacagacatcatctcatgaatgaagtcaaggagaggtaaagggcatatataataggaggctctcatagggctggggattcggagaaggattccctgagaaagtgaaatgtatttggagtttgatggatcaactggatgttccctaggcaaagggcagactgggaatggaggtggacagcaaacattccaagcagaagaaaaactgcatctgtaaagacctgtggcaggtccctttagaatgtgttctggccaaggaggttcatcatgttcagtgcccttgaggaaggcgggttctgaatttcccagataccagatagatgagatcccactgccaggggcccatgagcagaaggggtttgagagggatgggagactttccaaggcaaattctaacaaattacaaataatctggagaggagaaagagaggcacctaaataaatcagtttagagttttagaatgacttgtccaaagttggaagggggtcaggtaaccaaggaggaacagtgcagagcagctggaatacatcagaagggggtcaggaatgccaaaggacctgatgagctaaggcttctggaaaatgctaatcagccacaagggcctttaaaactgtctgcagtaagaaaaataagaagaggcatgctgtttctggcaacatccagagaacgaacacaatgtcaccacttctagttttacgttcatctcctttatggaggaaacaatatagtataacacatgtggagtgcttttattatgaataggccatatgccaagcactttatgtagatgatttcatttttatcaatgctgtgaagtttatcttcattttatttatggcaaaactaagatgtggggagcttaaataacttccccagggtcacagcagttaagtggtggagctgggttgggcaatctgactatagttcttcaatccgaactaccacactgttctgggaaaggaggggccatatgaggtgagagggactggccgagattctagaggtagcaggatctagaagaagtgatccatcacagaaggagagacctgagcttgcatcctggagtcaactgcataccagctatcgaattctgacttacctccctgatctccagtttccacatctgtgagatgggaataagttacttgcactgttatattgggaattcaaaataggcacagaaagtgcttggcatggaacagatgcttaattagtaatttttaatttttattctaaaagcagggtaaatacccaaagctagtcttttatttatttatttaacatatgagagatatgtggtccatgaatgaatgatatgtggtgtcttagtccattttgtgttgctataacagaatatcacatactgggtaatttataaaggaatttaggccgggcgtagtggctcatgcctgtaatccctgcactttgggaggccgaggcaggcggatcacctgaggtcaggagtttgagaccagcctggccaacatgatgaaaccccgtctctactaaaaatacaaaaaattaggccaggcgcagtggcttatgcatataatccgaatactttgagaggcagaggcaggcagatcacctgagtttgggagttaaagaccagcctgaccaacatggtgaaaccccgtctttactaaaaatacaaaattagctgggtgtgctggtgcatgcctgtaatcccagttactcgggaggctgaggcaggagactcgcttgaacctgggaggcagaggttaccgtgagccgagatcacgccattgcactccagcctgggcaacaagagctaaactccatctcaaaaaaaataaaaaaagaaaattagccaggcgtcatggcaggcgcctgtaatcccagctactcaggaggctgaggcggaagaatatcttgaacctgggaggcggaggttgcagtgagacgagatagcgccactgtactccaacctgggcaacaaatgtgaaactccgtctcaaaaaaagaaaagaaaagaaaaggaatttatttcttacagttctggaggatgggaagtccgagattgaggggctgcatctggtgagggccatcatgctgtgtcatcacttagcagaaggcgtaagggcaagagagaggggaggaagggggccggatttatccctttatcaggaaccgactcgcatgacaactaacccacttctgtaataacagcattaatccggtcatgagggtagcgcccttctgacctaatcgcctcttaaaggccccacctctcaacactgacattgggcattgagttgccaacacataaactttgggggacacattcaaaccacaacacatggtggccttgcccttgaagttagtctacagggtaagcatatttcttgcccatgtgtagagaatgaaatttaaaaaaaaaaatacagggtaagcatgttgatatggccccctcttttaacagtttccatgtgacatttcatgcactacagcctctcactgctctgaagccaggagtcaagctgagatttcccctgaggactggagaagataggtgaactggcaaagactgaaagtctagctgtcttttacttttttgttgcaatgagcagatagactagtgagaatgagtgtttcatccttactaatttataaacctaagctgttcaatctggcaatttaaaattcagtgacataagaaattccattccttggctgggtgcggtggctcatccctgtaatcctagcactttgggaggccgagatgtgaggatctcttgagtccaggagttcgagaccatcctgggcaacatgttgtaaaaaataaaaaggccaggcgcggtggctcacacctgtaatcccagcactttgggaggctgaggcaggcagatcatctgaggtcaggagttcgagaccagtctgaccaatatggcaaaacctcctctctactaaaagtacaaaaattagccaggtgtggtggcacatgcctgtaatcccagctacttgggaggtggagacaggagaattgcttgaaccctggagacagaggttgcagtgagctgagatcacaccagacagcacagatctagaacatgttcatcaggacaggaagtcctcttggacagcactggatgttgggaacagacactttcacatagttggaaagcagaacggcacagtgattaagggtgaaatgtgtagctgatttcatttgtgtttaacactgtgaagtgtatctccattaagcacggaggtttaaggagttaaatgacttgtctggggcaacagcaggcacgtgggtcactcaggctggatttggatcccgcctgagataatcataggagccgcttcactgggtggctgtgaagattaggccatgtaatatattccaggtgcgtcacactgtgcttgtctcatattagagacatcatagtctttctttacccataagttgtattctgtatctttttttttttttttttgagtcagagtttcgctcttgttgcctaggctggagtgcaatggcgtgatgtcggctcactgcaacctccacttcccgggttcaagcgattctcctgcctcagcctcctgagtagctgggattacagtcgtacgccaccatgtccggctaatattgtatatttagtggagatggggtttcaccacgttggtcaggctggtcttgaactcctgacctcaagtgatccgcctacctcggcctcccaaagtactgggattacaggcgtgagccactgcgccaggctgtattctgtatcaacatatgattttgtcctttttgttttttgagacagagtctcactctgtcacccaggctggagtgcaatggcgggatctcggctcactgcaacctctgcctcctgggttcaagcaattctcctgcctcagcctcccgagtagctgggattacaggcgtctgccaccacaccctgctaatttttgtatttttaatagagatggggttttaccatgttggccaggctggtctcgaactcctgacctcaggtgatccactcgcctcagcctctcaaagtgctggaattataggcgtgagtctccacgcccagcctgttttgttttgaggcaaggtcttgctctgttgcccaggctggagtgcagtggtgagttcatagctcactgcagtctggaactcatgggctcaagtgaccctcctgcctcagcctcttgagcagctgggactataggtgtatgccaccatgctcagctaatttatgttttattttattttgtagaaacaaggccttgctgtcttgcccaggctggtcttgaactcctgggctcaattgatcctcctgcctcagcctcccaaagtgttgggattacaggtgtgagccactgtgcctggcctgttttgtccttgacaggtcttgctatgttggccgggttggtcttgaattcccggtctcaagcaatcttcctgtgtccgaaagtgctaggattacaggcatgagccaccgctcctggcccagcattatttcttaagcccatctacgtattgataagtagtctgtagtttgcttaaccgtgccctggctgttgggaattggggctttgccttttcccggtactatagataagattacaatgtattgtcttgcctactgaccaggcaataggtattgttacagttatttttatttctttttttttttttgagactgagtcttgctctgtcgtccaggctggagtgcagtgatgtgatctcggctcactgcaagctccacctcctgggttcatgccgttctcctgcctcagcctcccgagtagctggggctacaggcgcccgccaccacgccgtagtagagacggggtttcaccgtgttagccaggactgtctccatctcctgacctcgtgatccacccacctcggcctcccaaagtgctgggattacaggcgtgagccaccgcgctcagccacagttgtttttatttctaaggaaactgaaacttagggcaattaatttgtaaaaataaagaaacaggttggtaatttcacattggaaagctgtctgagatttgttagtaagtgaaaaagatgagttgcaggccaggtgtggtggctcacacctgtaatcccagcactctgggaggccaaggtgggtggatcacttgaggtcaggagtttgagaccagcctgggcaacgtggtgaaaccccatctccaccaagaaagtacaaaaattaaccaggtgtggtagtgcacgcctgtagtgcccagctacttgggggactgaggcaggagaattgcttgaacctgggaggcagaagttgccgtgagctgagatcgtgccactacactccagcctgggcgatgagagcaagaccctgtctcaaaaaaaaagtaaaagaagaagagttgcagaacaacttgtatggtttctcatttgtgtgtagaacatggtgggggtagctgtgtgtacacttaggaacgcacagggtaataatcatggaaacgtactcagtactttatataatccctccagatcctcacaatagctctgtgaagaaatgattgcttggagaggttaaattgtccaggatcagtaagttgtggggccatccttaaacccagggctctgctactccatctaccccatgcactgggctcctccacccgtcacagggatagcgtttatcactgcagcagaaatacactaccttcttcctatgcacacgcactgtggaaggtcctttgatgtcatgtcattggtgggttctttgcacctacccagtgaggcaggcagtgaggagccatcagtcaggtttgagcttgagggcaaatggatgtgaagtctggactggggatgttgcccctgccataggttagaatgggtgatggtcaggggtgctgtttcagaatgtggcctgttcttactgctgggtgactcgaacagggaatggctgctctgggtacatactgggttcaggtgctgagattgacagcgtttggattatatatccaggtgacatacagaagggagcctggggcagtggcttcagctttgcctcttcccttacccaaggtatgacgaggaacaccaaccacctagaagggaagcagctcttcccttcttgctgtcatttcttttttcttttttttttcgagacggagtttcgctctgtcacccaggctggagtgaagtggggtgatcttggctcactgcaacctctgccccctgggttcaagcaattctcctgcctcagcctcctgagtagctgggattataggtgcccgccaccatgcccagctaatttttgtgtttttagtagagacagggtttcaccacgttggccaggctggtttcaaattgctgacctcaggcgatccacctgcctcagcctcccaaagtgctgggattacaggtgtgaaccactgcacccggcctcttgctgtcatttctttggattcatttattcttctcctggtaacaaggtacccttgaaggttgttattcatagtttaagattaactaatacaggcccggtacagcggctcatgcctgtaatctctgctttgggaggctgaggcgggaggattgcttgaggccaggagtttgaaatcagcctgggcaatgtagtgagaccctatcactacaaaaaataaacctaaaagaattagggtgggcgcagtggctcacgcctgtaatcctagcactttgggaggccgaggcaggtggatcacctgaggtcaggagttcaagactagcctgaccaatatgtagaaactgcatctctactaaaaatacaaaaattagcaaagtgtggcggcgtgtgcctgtagtcccagctacttgggaggctgagacaggagagttacttgaacccgtgaggtggaggttgcagtgagccaagatcatgccactgcacttcaacctgggcaacagagcaagactccctttaaaaaaaaataaaaaaaatattgggaggccgaggcaggcggatcacgagttcaagagatcgagaacatcctggccaacatggtgaaaccctgtctctattaaaaatacaaaaattagctgggcatggtggtgggtgcctgtagtcccagctacgcgggaggctgaggcaggagaagtgcttgaacccgggaggcggaggttgcagtgagctgagatcgctccactgcattctagcctggcgacagagcaagaatccatctcaaaaataagtaaataaacaaataattgggtgtagtagtgtgcgcctgtagtcccagctaccgaggaggctaagatgggaggatcatttgaagtcaggagtttcagactgcagggaagtatgatcttgcccctgcactccagcctggacaacagaacaagacactatctcttaaaaaaaaaaaattaactaatacagatcccaccataacaatcatttatttattgctgtgtaacaaattgcccccaaacttaaaggcttaaaacaacaacaagcatttatctcatatttttgtgggccaggaatttgggagtggcttggctgggtggttctggcttggggcctctccagaagttgcagtgaagatgtcagccggggctagccatctgacgggttgaaccggggctggagcattcgcttgcaagatggctcactcacacctggcaaggtggtgctggttattggcaagaggcccctgttcctgtctaggtgggcctctcccaggattgcttaacaatatggggactgtcttcccccagagcaatccaagagagagagcaagccaggcagaagctgttcttcttatgacctagtctcaaagtccaatagcatcccttgtcacattctataaagtagaagtaagtccgccacacattcaaagggagggtaatggctgggcacggtggctcatgcctgtaatcccagcactttgggaggccgaggcagatggatcacttgaggtcaggagtttgagaccagcctggccaacgtggtgaaaccccgtctctactaaaaatacaaaaattagacaggcatggtggtgcgtgcctgtaatcccagctactgggaagctgaggcaggagaaattgaagcttgaacccaggaggcggcggtatcagtgagccgagaccccaccactgcactcccacctgggcggcaagactccgtctcaaaaaaaaaaaaaaaaggaagggaattaggcaccaccttttgaagggatgaggaaacatccaaagctcacgcacagggttttcctcattcattcttccctctgacccatggatatttgttgaatctccagtatgtgccaggtagtccagacatagagatgagtaagataaataaggcttgatctcaaccctcaagaagcttatagtgcaggtagactaatagctatggtttggatagtgttttacagcttaatgagcactttcacttatggtcttatttaaccttcccagtaccccgtgtgatcaccagagctggttatatccctattttctatctcctctgggttttagtcaatgagggcttttcttacattgatacaccttacatgatagaacttgactttgatcccagcgatttttgtctataaatcccttgcacttttttcctaccccaggctgtgttccttgtggctgctttgtcatccctgtcctgcagatgaggaagctgaggctgcagttactgaacagctcttgacactttaattcctggatttttttcaccatactgagctgccctcggggatggactctcctaagtgctccattgacagtggctgtcatgtttcttcttgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacggtaaggctgcagatgggaggctgtgactgtcaagggcattgcgtctgctgcctgcccgtcaggcagagaaggaggtgttttgtgaaggatgcttggtgatagtggcagggtcaaggtattcaaggtacaaaggtttctgctgaggaaaggcattccagatcagtggtgtaacttctgtcctctctgccaagggagaatctgtgttatcaagaagcctctagatgtgaaccacagccaggtctctgagacactttggcactataacctgaacctcccaaccttttcagggcaggctgctgaccctcggcctgccctctggaagccaccaggcccagtgcctggagaatcatcttctatttcctcttcagtgcacaggcacagaggagagctcaggtctgagacccagaagataaactaagatgggacctttttaatttaattttattttattttattttattttatttatatatatttgaggcagagtatatatatatttatatatataaaataaaaatatatataaatatatatatatttgaggcatagtctcgccctgttgcccagactggattgcagtggtgcaatcttggctcactgcaacctctgtctccccagttggaacgattcttgtgcctcagcttcctgagtagctgcaattacaggcacctgccaccacacccggctgatttttgtagttttagtagagatggggttttgccatgttgcccaggctggtctcgaattcctgagctcaagcaatcagcttgcctcggcttcccaaagtcctgggattatagacgtaagccactgcgcctggcctattttattttatgattttatgttatgttattttattttttgagacagtctcactctggtccaggctggagtacagtggtgcagtctcggctcactgcaacctccgccccccaggttccagcaattctcatgcctcagcctcccgagtagctgggactacagggacgcaccacgatgcctggctaattttttgtatttttgtggagatggggtttcatcatgttggccaggctggcctcaaactcctgacctcaggtgatccacctgcctcagcttcccaaagtgctgggattacaagtgtgagccactgtgcccagctgggactatttttttttttgagacagggtctcactctcttgcccacactggagtgtagtggcacgatcacagctcactgcaacctcaatctcttgggtttgagtgatcctcccacctcagcctcctgagtacctgggaccacaggcgtgagccaccatgctcacctactttttttattttttgtagagatggggtatcgccacattgccactgatctcgaactcctgggctcaaaactgttctcccaccgtggtctcccaaagtgctgggattacaggcgcgagccatggtgcctggcctaaggtgggatcttgagcatgtcttttttctggacctcattttcctcacttggtaaaatggcagtcagctctgccctgctgtcctgtgtgccaggtcctgggttagatgctgccaccaaaaggatgaataaggtaccacagaggatgaggagtcggggctggcaatgcacaccagcctgcactgccacacttccaccttgctcttcatcaggcatgaaggagagctgtcatagaagtttgctttgattgattggaacctgaacaactgcagatggggctgtgcccttgcctgcctggtggcttctttgatactgacagtggtgatcctgggagagaacaaatctgagtctacccgctgggtagctgaggctcagctggagaaggaacctgcccacaaccatgcagtgcatgagtggtggtgtctcgtctttgtaccctctagtactctaaccactaccccatactccctttctcatgccactttgctttctatctactggtatccccacttcggttttaagggtagggacttccttaatctggatctccagcctccagcacagcatcatctaattatagtaaaggacctattgtttgtcaaggacggctgtgacaggagtacccaccttgttgtccagtctggcctgggtacttgacacacattatttctgttctcaacaacccctgtaggttgttgctttccatctctgccccccaccattctgcaggtaacaaaattgaaagtcaggttggggaaataccctaaggccatacatgtattgagtgactgaccccacactcaagcctgggtctctgtgactccagggcttgttcttgtgggtttcttctgggctccatgttagaatcacctgggaagctttaaaaatgacggacacctgggccccactcccagcaattctgattcaagtgatctaggcattgctattcaaaatgtggtccatgggccagcagcattggcatcacctaggagcttgttagaattccagcatcttagaccccactccagacccactgagtcagaaccggccatttaacaggatccccaagggacttacgtgcctgtcaaaatgtgagaagcactggcccgttccccagcaggtcccatagtgcagtcaggacgaagaaccactgtccctgtcaatataggacgttgtatttattcttggagctctcacaccgctgctcagtggaaaagtgatagatttttctttactctgtaaaacacttccaccttgctttcatcaggtatgaaggagagctgtcatagagatttgttttgttgttgtttgtgtttgtttctgttttagactgagcctcactctgtcacccaggctggagtgcagttgtgcaatctcggctcactgcaacctccacctcccaggctcaagcgattgtcctgcctcagcctcctgagtagctgggattacaggcgtgcatcaccatgcccaggtaatttttgtatttttagtaaagatgggggtttcaccatgttggccaggctggtctcgaactcctgacctcaagtgatccacctgtctcagcctcccaaagtgctgggattacaggtgtgagccactgcgcctggcctttttttttttaattaataaaaaaattttaaagatgggctgcccaagctggtcttgaactcctaggctcaagtgatccccctgcctttggcctcccaaagtgttgggattacaggcctgagccactgtgcccagcaagaggttcgctttgagataacttgacaacagagtattattcactatttagtttttgcattaaacaattaataacaacaacaaaataccctttaaggcactgggagttttttagttttaattttatcattaaaattgacaactacaacaatatttttccttgcttacttttattccaaccttgctttgcaaccagaaaagtccaataaatttttttctttttttttttaaagtccaataactttgaacattttccagattagtacagacgaggggattgttctctgttttctttttttttgaaacggagtctcgctctgtcgcccaggctggctggagtacagtggaacgatctcggctcactgcaacctctgcctcccaagttcaagtgattctcctgcctcagcctcccgagtagctgggattacaggcgcctgccaccacgcccagctaatttttgtatttttagtagagaaggggtttcaccatgttagccgggatggtctcaatctcctgaccttgtgatccacccgcctcagtctcccaaagtgctgaggtgacaggtgtgagccaccacacctggtctgttctctgttttcattgttgccacagagcaggtctcaacaaggtggggggtggtcagttttgtccctagggcccatttggtgatgtctagagatatttttggttgtcataacttggctggggttggggcttactgttacccaatgggtaaccaggaatactaccaagcatcctacagcgcacagggcagccccacaacaaaagaattctgcggcccaaataggttcatagtgccctggctgagaaaccctgacacggagaaagagggcagaggtgaggttatgctaaaaagaattatattctagccgggtatggtagcccacgcctgtaatcccggcactttgggaggccgaggcaggcggatcacttaaggccaggagtttgagaccagcctggccaacatggtgaaacactgtgtctactaaaaatacaaaaaaattagtcaggcatggtggcgagcgcctgtaatcccggccactcgggaggctgaggcaggagagccgcttgaacccaggaggtggatgttgcagtgagctgagaccacaccacagcactccagccagagtggtgtctctggtgacagaggaagagactctggctcaaaaaataaaaataaagcgttctattctaagaattttttagaaggccaggggacttgctgggcgacttctcttccaccttgtgtctccaacagaaggggtctaagtctgttcttgagaactggatctgtgtcatctggagagcagagggacagatggatatgaagacccattttgtcatcctcagttaatcctcagggacattcaatgatgaacccatcctaaagcttcagcattgctgagcttttttatatagcttcaatcatttgcttccaaggtcttgggtttttaagcccatgtgctattttttgtctccctcggggcccagaaggaggggctgtgagtcattgcccgtacaccagccttggcggtgctgccgcaatcggcgcaggctgtacctcaggctagtgctgtttttattcatagagatgctcagagttgccagttggtctgctgttgccagcagatccagcaccttagggacctttttttttttttttttttttttttttttgaggtagggtcttgctctgttacccaggctggagtgcagtggttcgatcatggcttactgcagccttgaccttctggggtcaatccatcctcccacctcagccttcccagtatctgggactataggcacatgccaccatgcctggcttctttttatgttttttgtacaggtggagttgcccaggctagtctcaaaacgcctggactcaagtgatctgtctgcctcggcctcctaaagtgctaggatgacaatcgtgagccaccacacccagctgggaactcttactttgaagaggttgggtaaacttgggggtgagggactggaacccagcttgcagaaggaagtttctctgccatctcactatgcatattgatgataacagtaatgataactgagaaaggatgaggtggctcacacctgtaatcccagctcttcgggaagatcatgtgagcctaggagttcaagaccagcctggtcaatacagtgaaaacccatttctacaaaaataaaataaataaataaataaaattagccaatgtggtggtgcgtgcctataatcccagttactcagaggctgaggtgggaggatcgcttgagcctgaaaggttgaggctgcagtgagctacaattgtgccactacactccagcctgggtgacagagcaagaccctgtctcaaaataataacaataataataataataataataataatgaaaatggaacattcaccatgtgctggccctattccagattccaggtgtggagagaccgggtagattagcgtcaggagcacagccgtagggccacactgctgcctcttcgtggtccagctgtacccctcactggcttcgtggtctggagcaaagctactctgtccctctgtgctgcagcttcctcatctgtgctgtgaggataaaatgagttttatacatgaaaatacttaagataatgctgagctgaaagtaaatgctacgataacgctggtctctagtgacagaaagccaatcagtagtggcaaaggggcgggagggagttaaccaaggggtggggaaacttgaaggagagatggtcagtatcttgattgtggtgctggtttcacaggtgtatacagtgtcaaaacttagcaaattgtgtaccttaaatatgcagtttattgtatgccaattatacctctgtttaaagctgtttaaaaatgaaaggctatagaagtggaagctgttatctcatcccagtgcaagccctggtatttagagatgggctggctgagctgaggagagcagttgcttatcttgttaaatagtggtttcagtaataggtcaggtttgggcttttttgttttttttttgtttgtttgtttttattagagacagcatgtcactctgttgctcaagctggagtgcagtgatgtgatcagggctcactgcagccttgatctcctgggcttaagtgatcctcccgcctcagcctcctgcgtagttgggactacaggcacgcatcaccctgtctggctcattctttttttttttttgagatagagtcttgctctattgcccaggctggagtgcagtggcgctatctcagctcactgcaagctccgcctcccgggttcacgccattctcctgcctcagcctcccgagtagctgggactacaggcgcccgccaccacgcctggctaatttttttgtatttttagtagagacagtgtttcaccatgttagccaggatggtctccatctcctgacctcatgatccgcctgtctcggcctcccaaagtgctgagattacaggcatgagccaccgcacccggcctcattctgttttttatagagacaaggtctcactctgttgtccaggctgatcttgaactggcctcaagcgatcctcctgctttggtctcccaaaatgctaggattacaggcgtgagccaccacaccaggcccccaggtcagggttaaactcagagcttctgactcccagtctgaaacttttttcttggcctcaaacaataggacagagcctgtcaggtgtgggttgaactctgctcctccttaggaaggaagtctcaagcttggcctaagctttgagaattctggggggcagagcgtgaggtctgaaaggggctgttgtggcaggcagggcggccacaacagcccctttgctctgttgtgtgggtgcagccgggagtcagccggaacgttgagcctggcagggagagtggacccgcgcagagctcagtctagatggctgggaggcttgtggggagaagacggttgagtcctgacagggccggaccccagggcaggtttggactgccattttggctctgatgaggaagggaggggtggggcctccggggaaatggggtctaggaggaggaggagctgtgagaggccagtggcagtgacccggtctctgttcttgaaaactgacagatactcctgtctatgtctggagctaatgggcaaagtcttagtgtcatagttgggtagccaggcatcccaggcctgaggtgtggagggttgtagatggcggacagggtggacaggtgaaggggatgctggtcctgattccctgtgccttagtggggctgagggcacagagggaagtagcgaaatctagctgtgaacttggtcactctcctgagcctgtttcttggttgttgttaaatggctttcttggttgttgttgttgttaaatggcaggaatgatgagatatgcatgttgcggggacttagtaggaattacgatgctgggaaagccaggatcctttgaaaagaaccagcgctgccctcttgtgatgttgtcattcacttactcatcaagtaattgtggagcacctaacaagtgccaggtgctgcaggaggtgaggaggtggtgcagtgaacaggacccagcagtccccacccaagtggaacgttgaggtcctgagttcagactccctgtccctggccactgttgaggttgccacatggactgagagggagaggcagggcgggaggaggccgtgcagctagcaccaggccacccttctgctcttctccccacagactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggtgagcagaaggtggctttgggggtgggcaagtgggcaagactgggcgagaggcctcaccctcacactggagcaaaccagggcattgcctccaaattctcacacctctttggattggtctgcttttaaaacttgattttacttgtttctctttctaaaaatagcacttgctcattatgttaaaaaatacagaggaagcctaaagaaagaaaaaatcatccttgaccttaccacactgcaggtcctttttctgtcctgttggaggatgatgtggatcctgccaggtgctctggaaggggccatgcaggcctccctgtctgcctgagcagtgaggggtgcatcttagcatagtttgccagcatcccatttgcacccactcccgctctcctctgaccctccaaggaccctctccgggaggtaggcgtgctagggtcactatttgtaaatttgaggcggcagtggcatcatacttgagttctgtaactacatgagggcacgattagggctcaatgctgatcctggctcccactctggtgctctgtcactgaggagcctcctttgggggccattcttctgtgagttttgcttaactacatgggggtggctgtatgccatgctgaaggcttttcccccacccttctatgaaatcgagttcctgctccttctcccaggctcggcttgtgggacctttgtgtcagcctgctcttggcaacagcgggcctctctctcccagctctgggcctccccactctccagcccctgcagtgggagtgggtccccctcacggggaggggcgttggcaggagctgaatgctggcagggctgcggcctgtgggcatgtgattgaaagtgctccagctcccagggtcagcatggctcaaagcctcccagccccatgggaaacactcggggcggcgctctcactcagaccctctcttccaccctggccccctggtggtatcctggctccacagtggctctttcccctcagctgaaaggacagtcctgcctgccggccggcggtttccacattagcaacaacactggtgggggtaataatgttacaggagctcccacagtgccgggaactgcacatggccgggaacgtgggtcctctgcagccctggggacagctgcccacaacagggctgctaccttctggggctggctttctgcttgctttatgggctcagagtgaatcttctggagatgagatgcacactcatagcattcagagctcattccctcatgcgttcaacaaattgaacattctttatgtgccaggcactgggctaggtactgaggttcagtgtgaacaagtcaggcaggggccctgccttcagggatctgcttgtgggtgtggacactaaacaatggccgaggtaggtaactgcagatctgggtatgtgttaggaagggaaagtgcgggacttggtcagtataaaaaagaggtctaatttagatgctgggggaaagagagagcttctttgaggatgtgacagataacctgaggactgaacatatgagttgcattgactggaggaagaacatgctagaaagaacagcatttgcaaagaccctgagccaggaagaaacttgatgcttttgtggaagtgagagggggcctgtactgctggagttctctgtgtttggaagagcgggtggtatgaggtgggcaggggcagccaggaacgcgagggctgtgggaacgctatggtcaccatcctcagagtcctagaacagtttaagcggagaaagaatatggtctttttttttttttttttttttgagacagagtcttgctctatcccccaggctggagtgcagtgacacacaatctcggctcactgcaatctcggctcactgcaacctccgcctcctgggttcaagcgattctcatgcctcagcctcccgagtagctgggattacaggcacccaccaccatacctggctaatttttgtatttttactagagacagggtttcaccacgttggccaggctggtttcaaactcctgacctcaggtgatccacccacctcggcctcccaaagtgctgggattataggtgtgagccaccacgcccggcctagaatgtggtcattattacgtgtatttgtaaagtgtccctctggctagggctcagaggcagtgacctgtctagggtcacagaaccagagatggatccaggctgagtccaggccgagactctggcaccagtctggggtcctcccacaccccttcctcacacttaacacagacgtgtagtcacatgcgcccagacacgaccacagcctcctgtcctggataccaatttcataagtgaccgatttgtaaatgaaaaagctgatgtattaattattaattggaaagagactgctctggaaacccacgttctttgccattctcttacctgggggaacccagtgggccttcagagggcacacactggtctggagtttcagtgaaggggtgtgtggtttgagtgtatctcatcaagggtccgagggcactggctgaggtcccttctctgaagcatcgctctcccatgccggaggctggcaggtcccatttcctagttcctcctttgagactcagtagagtccactagaatcccaccgttttgttactggggtcagtctcactgaccccacacagggacctcccatgtcttccagataaaccctggcctcacatctgctgtgcagtgggcccttccctgtccctcaaggaagcttccttcagattataggcaggatggctacagcccgtgtcatcatttcgtttggctgaaacctccttttcagaacagtggtcccttcgacagccttccatttgggcccatcaaacacattaccaagaattcagcacttccgacagtcagacaccagtccagggggctctctcaggtgtcgtctaagcctgggatctccagcaagttatttcaaaaaaagcctctggggtttttgttttgttttgaggcagggtcttgccctgtcactcaggctggagtgtagtggtgcgatctcggctcattgcagccttgaactcctgggctcaagtgatcttcctgcctcggcctgcaagtagctgggaccgcaggtgcacagctaatttttatttattttattcttatttttattttttgagacagtctcgctctgtcttgtaggctggagtgcagtggcacgatctcggctcattgcatccttgtctcccaggttcaaccaattctcgtgcctcagcctcccgagtaactggaattacaggtgtgcactaccatgcctggctaatttttgtatttttagtagagacagggtttcgccatgttggccaggctggtcttgaactcctgacctcaagtgatctgcctgcctcagcctcccaaagtgttgggattacaggcgtgagccactgcacccagccactgcgcctaggccagggcctgcctctgcactgctggcctcatctggggacttgagtgccacaggcactcttggcaattatttagaccagtcccttctccagataaggaaactgagacccagaccagggcagggacttgttccagacccaccaccctggccaggtgtcacagaactggggctccatctctgctcccctgtccttctctctgacactgctagtggagactgggccaacatccaagctctttggaattatttttagaaggtctctaagagagggcctgtctccagtgccagtatttcagagtcagaagggaggctgatggggtggggagggcttggtgagggtcacctggacacaaaccatgttgctaacgcccaattattgatttgtctcaataggacatcaaccaggaagtttataatttcctggcaactgcaggtgccaaatatggcgtgggcttctggaagcctggatctggaatcattcaccaggtaaagctgggctcagtctgccgtcccaagggcccaagccagagaagtatgttccaggcctatggggggagggggtttgaggcccaggggggctgaggggaactggatgacatatccatcagctcttatgctcttcctcctttgttttgaaactgattttcattatgtcattatacgtgctcattttctgggtgagaagttaaaataatacctcctaaccacccaggtaaccagcattttaagtgcgacatgtttctttccacattgtcttctgggtgtgtactcaagcatctctattcccataaactctcatacagaacatggtattattttgttttttttcacaagtgtcaccccttgtggcatgcatcactgacatttgatgagcccatactgtgtctcaggtactaggctgagcacttgaaagatatttgccatgccctgtgaggtaggtgcttttactatccacaccctacagaggaggcagctgaggcacagagatgttaaccttcttgcccagggacacctagctggcttactgtggagccaggcctgtgggcaggagggctggtctggagcgagtgccccatgccaccgtgctgctctgccgcctccctcgcccccagagctctttctgcttctgcacgtggcgctcctcggatttctttttggctccttcatggtgttctgtagggtgaaggtaccataggtcatgtggccatgtcagccgggggctcctctgaggtgtcccaaggatggatcttcttttggtggacagttggacagttttgtctctggaagtgcaagtgtgaacgtgtatatcctggggaggtgggtgcttccctttcttccaagggcactgttagggaccactgacctagtttgtgtccatttacatccaccctgtatgtatgaaacctgcctcttcgcacctttgcaaggtggcccttccccccacctccatcccagacctcactgtcctggcctcctcaggatgtgctgagtcaggctgtaatctgacgccgcatgggctcccagcaccgccccgctctgaaaccagagccagcaggggatcactcctctgccctgcccaaccatcactcttgccaggaaggggctgcgtggaatggccgtttgcagcggcctgtggggactagaaagcccctctctgcagcagggttagggagtcaggtggacccagtcttggccttctgttacaaagggcactgcaatgcaggtgtctccctttctacctcagtacaaatgcccaggcctttatggcagctcctgggccaaagtttggagccgtgagtgatggcagctcacatctgccaccggctagctgctaagcatacagcagctcgtgtgtttgtttctttaaaaagaaaatgcccaggggccatgggagtactttgcagctttactttcttcccgccttgatgtcacgtcttcagcagcctcagtccattaggtccaacccaaacctgaacccctttccctctgggaagtgccctggccccacttggcccgcagaccttcctccacatcacagctttctggttcctctgtggagcctccccggccctccccgtgcctggcacagtggcttccagtggatcctctgtgggatctcttcacattatgttccagcatctgccaagtgctttctgcactggatcatgtgctctgtggggacagggactgtggcttatttattcctctctagctctgggtttgggaccaggtcagtacagagcaggtccttaatgtatgtgtgtgttgtgtggatggatggctgaatttccaggtgtagttctaggcattagtccttcttcccagccctcacccccatctgtccagccacacccacagaccggggagctcactgtcacggccagcgtcatcgtgacatcttctgcagtcctcatgtctgcctgacctctccccctggatgtggaccacaagtgtctacaccgtgtggaccacaagtgtctacaccgtgtagaccaccccgaattctgtgtgcccagccttcgtggatccaacttttacaagcttgaggctctttagggatgcactagtcttaaatccttgtacgtggcagcattggccagttcttcgcagccaggtcttccctctgcatccccaagagatgagacctttggaccttagagtctgctaggcagatgcttgtcctgaggcagaggccctggggtttctgtaagatttctgggagcactggtgggtcctgagagttcacagagcctgtcacacctctcatgtgttcttccccacatccccgggtggggcactaactccatctgactgatgagcggcagaacctcaggtgaaggctcttgctgcaaaacaataaataaaaatgttgcttcccgcaggcactattctgtgcctcatggacaggatctcatccagtcatcagtgaaccaatgatgtgagcacgattgttagctatttcttgatagggaaactgagctccgagagaagtgacttgtccatggtcccacaacaactagtagatggtggggccagacctcagaccccccgatacaggacgcctggctcagggcttgccaagcagtgtcctgcagcttcagggggccagtgcctcagaggtgcctggtgcctgggccacacttgggtgttgagcctatacagcacccaaggtgttgagcacttgggtgttgaggtgttgctgcctttcttaccaaatgttttgggggaagtgctccccacggctgggaggagcgcctcagtgaagggagtactgtgaaatgggacaggtgatgaggcagggtggcatcgcgccttgagcaagtcacatgggttctcagagccacctccagatgctgaagtggacgaggcatcacctattctttgcagttgaggaaaagttcatagctttgtgtacccactggggcctcccaggacttcttcctcaggggccttgtggggctggagccagctcctggaagaaccaccaaccccgatgagaagccaggtggggatgctccacacccaggatgaggccgggcctgggcccatcacaggacagtttctctggttcttgtcacatcctggggtcatggtggtatgggtgtttggttactgtgctacaaatgaggaaactgaggcatggggcagcattcaaaggcccaagacatatagcaggaaatatcagagctattcaagagcccaggccacctgtctcccaaggctctggctcttcttggccaccctggagacggcctggattaaatggggctgctcctaccagttccatcctgggagagtggctggacgtggttgggaggccccgggtcagtggggccattttttggtattctcggctgagggcttctaaatataacatcttggattatttttcagattattctggaaaactatgcgtaccctggtgttcttctgattggcactgactcccacacccccaatggtggcggccttgggggcatctgcattggagttgggggtgccgatgctgtggatgtcatggctgggatcccctgggagttgaagtgccccaaggtgagggtggggagggactcattctgggctggctgtggggtggtggttggtggggatgaacgggagacggtgggacccaggagggaaaagggaacaagttagactcgaatcttctgggagggaggtagagaccaataagcagcaatgtgaatggcagcagggccatcctgacttcgtggctggcacaggcacacacggcctctcacagccgcctcgccccctcctgtccaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggtgaggaaggcggccaggcgacgtggcccctaccctgtgctgggcctgatgggtctccagttgggagtagaagcggtgaatggccttcacttgagaatctgtctgttccatttggggacttgggatagacagaggtagaaggaaaattggagacagcattagagattgtctagtccacatcctcattaaacagatgaagagattgagatacctgtcgaggctgccggtgacttcctaactgtgtggccacacacggttaggagccaagtcagcttctgctgctgggcccaggccatagcactaggccaccttgggtgatctagacgaatccagagaggacagaggcagtggtgggaatgggcagagccagggcttcattcatgaagcagctgcaggcccacatcctcccttcgctgaagttcgagcctcactcacttcccttggattagagatcggtgcctgtccgcctccaagaccaggtaggagccagctgctccctgcctgtcactcctggtgacctggcctggatgcctggtcctcagaaatccagggagatttgtaacagtctagacttcccaggtgcctgcctgggctccctggcagccctgcagaactctggttcccctgcagtgatgggggctcactcctgccacgggactgctcagtcaggacgttggtaacaggcccatacctccgtcctagtggctcctgaggcaggtggcctggtagcagctgcagtacctgtgagccccaccagttctgtgacgctttgtggtccagacagtgtgtatcatttcagtttttgtttttgttcttgttttttgagacagagtctaactctgtcgcccaggctggaatgcagtggtgcaatctcggctcactacaacctccgcctcctgggttcaagcaattctccggtctcagcctcctgagtagctgggattacaggtgtgcaccatgatgcctggctaattttttttgtatttttttttagtagagatgggttttcaccatgttggccaggctggtctcaaactcctgacctcaggtgatccacccacctcggcctccatcactggaaaacttgagacacagaaaagtgtctccaccatggtatggctgaaggagggcaggccaccaggcagacagaccaagatccgaatgtcagcatctacctttatgtgctttatggcatgaccttgaatctctctgagccagttcctcccctgccaaaaagaatagcaactgggcagtgtctggtcaggtcagcctacagtacgtggtgcctgttcaatctcttgggcgacagtcaggccccaagctcgcagctcagtgtgtgggggctgaatcttcacctgagtcctcttcattctacccagcagccaccctgagctggggccctgagctctgatccccatggcctcccctcaccggcccaggtttttacccagggcctcaagggatgagtcggcccgctgtcaccacatctctctgagtgggaggagaagcaatgcagctccctggtgtgaagatgcaggtggccgcgtagcaggtgtgtgggaccctggcccggccaccagccaatgcccggggctctgttgctccacaggcatggcgacaatctgcaacatgggtgcagaaattggggccaccacttccgtgttcccttacaaccacaggatgaagaagtacctgagcaagaccggccgggaaggtgagctggcaggggcaggcccgtgtgggtggaacagtcacatgcccgctcctccccaagacagagctatgcctttccctgtagggcaggggttcttaacccattgtctccagacaggcgtccgaggctctgagaaagccctgaagaggtgcaatatgtttctgagtagattgtctggagctctctccagcttctcaaagggcctggcatctgagttcaagatagccccacctcaggatgggcatttcattttccctggaaggtggctgaatgcccgcccttctcggcctggtccctgctgccccctacaggaaactccggaaatgacatggatcgcttctgttgataattcctgacctagcaggggaacatttggaaggagaaccactttcccagcctcccctgacaacttccctgaggctctagcctggcttctttggagctcagagggcattggcacctgtgaagggtggtgcgttgtgggagtgaacgaggagccagagaccaggggccatggggagagccgtaagcacgtggaatccttggaaggctcctccctttccttattgagtgactgcttcttcaaaacccagctcttcacttccaggacaccctccccggctctgaaccttagctggcgctcctcctctgtgtctccgtgtccctgacagctcctgcactagggtgtgagctctgtaagggcagagacagcagccttggtttcttcattggcctagtcagtgcccagggtgggcctggtgtttggcaggtgctcaggtgggtggtgagtgaactctcaagaacagtttatgtttcacgtgctccatccccgtcccttgttgatttcagacattgccaatctagctgatgaattcaaggatcacttggtgcctgaccctggctgccattatgaccaactaattgaaattaacctcagtgaggtgaggagacaattaactgggttcaagaagtttctgagagtagtggggagcagggcgggtcctgcctaaatactcactgagggccgggtggtggctcacagctgtaatcccagcactttgggaggccaaggcaggtgggtcagttgaggtcagcagttcaagaccagcctgtccaacatagtgaaaccccgtctctactaaaaaaaaaaaaaaaaatacaaaaattagctcggcatagtgccatgtgcctataatcccagctattcaggaggctgaggcaagataatcgcttgaacccgggacgcagaggttgcagtcagccgagatcgcaccactgcactccagcctgggcgacagagcgacactgtctcaaaaacaaaacaagaaaaacctcagggtgactcgtgggcccctgggtccccagtgttcctgcaaactgcttcctgaagcagcctggagcagtgggtggggaggggggagacacagccacggggagagcagaggtagctctggctgctgaaccagaagtggatgtcagtttgccaccagctcagctttaggagaagccaaggtttcaccctgaagggtttttgttatctgagttcagagggcaaatcccagcagggttaggcaccctgagacgcacagatcagagcaggtgtttgcagagccagaggaagggcaggctagaggatcccgtctgcaggagttcacacctcggctctgccacttaagttgtgtggccttggtcacgcacttagcctctgtaggccccttgctccatcacgtgtggaacctacagcagtcgtgaggattgaatgaattcatgtaactaacactgacggaggtttactgcatgctgcgcacatagctgagtgcctcgcatttactgatgattatgatatgtaaagcgtctggccttaagtccatttttgtcatgattccaaaagcggccgggcatggtggctgacacctgtaatcccagcactttgggaggccgaggcgggcagatcatgaggtcaggagattgagaccatcctggctaatgtgatgaaaccccgtctctactaaaaaaatacaaaaaaattagccagacgtggtggcgggcgcctgtagtcccagctactcgggaggctgaggcagaagaatggtgtgaacccgagaggcggaggctgccgtgagccaagatcgtgccactgcactccagcctgggcagcagagcgagactccatctcaaaaaaaaaaaaaagattccaaaagcaacatcgaatgggagataatgaacttaggaagctgacagccttgatccattccatgcctctgctgtctcctagctatgtgacttcaagcacagcatgtcacttctgagcttcagttccttcatctgcagagctgagcccagccttgcagggctggagggagcccgggagcgggtgtgtgcagagccaactgctcagttcttccctgtgatgaggtttcagtcaagagaaagtcgttggcctctctgtggggacgtggtgaggcagtgaaagaggctgtccccgcttcaaggtttcttccctcctctctttcttctccttgcatgtttgtttcttcagctgaagccacacatcaatgggcccttcacccctgacctggctcaccctgtggcagaagtgggcaaggtggcagagaaggaaggatggcctctggacatccgagtgggtgagcaccttccaccccatctgtttagcaggtctcagggccagtggctctgcccagggctgtagacaatcacctatgcctactgtgtggcactttctaaggtgggcagtttctgaaatgggtttattattgaaaaattactttttcggccagaagtggtggctcatgcttgaaatcccagcatttcaggaggccaatgcaggtggattacttgagtctaggggttcaagaccagcctgggcaacatggaaaaaccccgtctcttaaaagaaaatgcaaaaattggccaggggcagtggctcacacctgtaatcccagcactttgggaggccgagatgggtggatcatgaggtcaggagatcgagaccatcctggctaacacggtgaaaccccatctctactaaaaatacaaaaaattagccaggggtggtggcaggcacctgtagccccagctacttgggaggctgaggcaggagaatcgcttgaacccaggaggcggaggttgcaatgaaccgagattgtgtcactgcactccagcctgggtgacagagcgaggctccgtctcagaaaaaaaaaaaaaaattggccaggtgtggaggcgcatgcctatagtcctagctactcaggaggctaaggtgggaggatcacttgagtcctggaggtcaaggctacagtgagccgagatggtaccactgcattccagcctgggcaacaaaggcagactcaaaactgcagactcaagcaacagagcctgcctccaaaaaaaaaaaaaaaaaaaaaaaagaaagaaaagaaaaattactttttcttggcagaaaagaaaaatatgtttattgtagagaatattcacaatcaagaagaatttttaaaactcctaatctcaacccccagccaggagcaagctcttagagctcttggagaggtgtgctgtgtttctgtgtattgtgtgcatagattttcccgttttacattttatatcacccatgctgctttatgtgacttttcatgctttacacatgcagacgccctggcatgccagtcactggcatctgctgctgctgggtacagtgtggctgtgaagagcatggagcctggagccagatggcctgggcttgaatcctggctctgccacctaacagccactaacagctgagtgaccctgagcaaactacttcactgtctatgtgtgggttccccatctgtaaaacaggagtcatgatcgtactgacacctttgaaggtggtgttgggcctactgctgctatcaccaatgagaaaaataaataaaaaataaagttgtctggagaagtgacaatatgtgaaaagagatttctataccgtctggccgaaaataagggcaatataatgtgttcgcccttattcattgaagtaattttaagaaaaaaaatatttggtggtttaataattagaaagtaaattactaaattaataaaagaaactatcttggctggttatatgggcttttgccagtaatcccaacccttttttttttttttgagacagagtcttgctctgtcacccaggctggagtgcagtggcacaatctcggctcactgcagcctccgcctcccaggttcaagcagttctgcctcagcctcccgagtagctgggactacaggcgcccgccaccatgcctggctaatttttgtatttttagtagagatgggggtttcactgtgttagccaggctagtctggaactcctgacctcaagtgatctgcctgcctcggcctctcaaagttgtgggattacaggtgtgagccaccgcgcctggccagtcccaacactttgagaggctgaggcaggaggatcatttgatcccaggagttcaagagcagcctgggcaacatggtgagactttgtctctacaaaaacaatttattgaattagccaggtgtggtggtactcacctgtgggtcccagctactcaggaagttgaggcaggaggagttgcttgagccccaggagttagagactgcagtgagcaagcctcgactgtgcccttgcactccagcctgggcgacagagcaagaccccatctcaacaacaacaaaaagagactgtctagacagaaagtgcgatgttattcaggttttatagactttttaaaaagaactcttattgccctgattataaaacaatctttaaaacccagaaaatactagaaagtataaaagaagaaaattagcatctcctgtcagccccagcccatcaaggatggctgttcgtatgagccctctgacgtgcctacacgtgtacatgatattgctgtaaaaggggtcatagtcctaatgtgttcagcatcatggccaatggctacagcatctttcttcaaatgacgccacgtcatgagttagcctgtcctttattgttggatatttcggttgcttgcaactggtctctgttaaaaaagtctctggcccagcccagatggtgaactcttttggccaagtctggataatttgaagtcaggtggagacctctgctcactgtctcctcctgacccttaaccccaccacccacaatgcaccaggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgtgagtgcccatatccccctgcccatctcccccaccccatgctgagtaatgcctccaggcggcacaagcccagaggcctgttgggccggggctggggcaggtcccagtggctgccctggggttccagtacagcacttcgtcctgcagccaccacatcaccccttcccatcagactctcacccacccttgacattctgtcttcctctctccctggcaggcacagatcttgagggatctgggtggcattgtcctggccaatgcttgtggcccctgcattggccagtgggacaggtaagaggcgtatcttttgacaagacagccccttgtgcacagggtacagagccccagaagttggagggggaattattggggtggagagaagagactccagccaaggtctctagctccagggactcttgcccattagaagcctctggcagacatgcctgggaagaggggctgggtgaggaagggccctgcagaggcactggggggcaacttggctgaagcctgggctggcaggaggaagccagcgcggcctcaccctgacggacacagcaggagccgtttgggaggaggcagtgccccaggtcaggaaactcaggccttgaccaaggccttgcctctggcttacgtgtggttgcaggctgggcccagtgatcctgaggttcccttctgctctgcgcgtggccccaggaggaggcaaccctggcagggcctcttcattttccctcggtaggagctaggctgggctgcgccacaggaacccagcttatctgtcctcgggacaggccaggtgacaaggccagatatccctaaccctgatccctctgacctggcaggaaggacatcaagaagggggagaagaacacaatcgtcacctcctacaacaggaacttcacgggccgcaacgacgcaaaccccgagacccatgcctttgtcacgtccccagaggtgagactgcccagctgcgcacaagcctgggatggcctctgggggtccctggcgggtcagaggaggaggcagaaggagatggggactggggtcatccaagtggtagccaggagctacaggccttcccagcctcaggcgcatgcttggtgcttcctgcctggggctccctgggtcatgggattatgagatatttatacagtggtttgtgcttatgagcatggaatttggaatctcactcactgcctaggacacatcccagccctgcctctaactcgctgtatgagtgtggccaagtcacttaccttctctgtgtccccgtaatcctcgggattacctgggaaagtgcgtgggacacatgcagtttccaaccccaggtaggagttccacaaaagcgaggcctttgccattgttcccgtggccagagtgagccttgcccttggcggtattcagccctggccgtgactggcacatggccaggctctcttgacttggttgtttatctgcgtgttctacaaatatgtcttgctaaatgggtgaaggaatggctccttccatgtttttagtgtcctgcgcactgagcaggtttgcatcataccagcatttctgcgccagggcccccactccctccaggatagctgtgaggagagagaacagcactgccggcccggccctgcagggatgggagaggccgcactgcccttggcttcctgagtcctctgcaggcccaaggccccgtggtcccaaagatcgtcctgcagctctggcctctgaggaacacaggggtctgggaagaacatggaaatttcctgggttcctttctcagttttggcctaggcttttggtaggtgcaggagacaggagtggcaattggtgctgaccaacaaactggccacctccatttcagattgtcacagccctggccattgcgggaaccctcaagttcaacccagagaccgactacctgacgggcacggatggcaagaagttcaggctggaggctccggatgcagatgagcttcccaaaggggtgagcgcccacgccccctgcttgctggttgctgtgtggccacgtcacttccttctcaacctcacagcacctcctgtgcaggcagggagggcgctgctagtgagaaggaagcagctctgttccctgggaggggaggtggggcccgaggaaacttgccttctgagagtctgtccttgtgggaactgaggactcagcaccccacgcatccccattccctgctgcaggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcagcagcatggggacggcaggacagccccaccctgccagggccccccgtcccctgagcatcgggaagggccatgaacctggaggaagtgagcacagtcaagacgcaggtgggagatggaagggaggtttggctgcagagcagagagggtatcgcaacgcagtccagcgtcccccttctctgtggccccgaactgggcagagctagatctggccagcctccgtctggggccctcagccatccagcagcagctgatcagagccacctccagtgggtgtgggcaggtgagtacagctcaggctgggctgggacagtgtgtgtgattgcacagcaggctccacacctggcacgtccacacaggctctggaagccatggacaactcctgcccccacagttgggcacccgtggatatgggatggcttgtgtttggcaccgaccaaaaacaagcctttttggtgtggccagaggcctccaatctgtgtcagatatttatttatgctgcttattaaggggtctccaggcacccctgtgacagaagagactaatcagtcatcagccaggacccaggcatgtcctgggctcctgtgtccagcatgaggtctgtggctgatcttgcagctgaggcctgaagggtgagcgaacattgacctgtcccaactttgggcggcctctgccccataagggagactgagcagccagaggcctttgaggggatgaaggcctggcctgagcccatgtggccttagggtggaagcaccaggaccacagaacacgtgtctgaagacttgcctgcctctcacccctctgtcacccctcctgggccccggggcctgctgcctgcctctggagggcttgtcatccacccctccagggccatgccctgacctctgtcctctctacttaccacccaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaaggtgggtcagagttgataggggcaatgccagtggtcactcctgaaggggcctgcaaggcaggtgcagggaggacattaggggagtggaaactgggaaggaggccgaccaagcccaaaggggactgctgtggaagggaggagaggcctgcagcccctccctgtggctgagaaggcatgaggcccaggtccggtggtacagccgggtccctgcaccaggaggagttagtgagagatatcttaggatatctggccctagacaaagacaaggaagggggccgactcaggaagtcagaggccaaaagctcagagagggggctacacggggcctcacagtgagcaggcagagagggtctgaggtgattggactttttctgctttgagaaacaaacagaaccagggctgaacccaagtcctggcccagccgggtgaaaggactctggcaccccctggtggctgggtggggcagagggtgctcccaggaagggggcgccttgagcttcacagatgcatcttgtgtggggcccggaggccgtccctgtctcacccaacctccctccacacacacctgcctctgccaagcaccaatgggtggcttctgtcttctttgccactgcaaacaaccacgtgcctctgtcccctcggggcctcgtttgggtctcattcacgcaggcttcacttgcccttaggcagcaggcgaggaagggcccctccagcccctttaccgggagcctcaggatgcccaggcgccaggtgggtgaggccaggcaggtagggccagacaggtgaggacggtgccctcctctgccttataaccttacccccgcttgcctgacagaaacatggcatcaggtgggtggtgatcggagacgagaactacggcgagggctcgagccgggagcatgcagctctggagcctcgccaccttgggggccgggccatcatcaccaagagctttgccaggatccacggtgagctggagtctgtacccaggccatcctcatcccatccctagtgatcaaggtcactctccctgcccgtggctgagttgggcctggttctaggctgtgtccactgcagcccacaggcccgtcagcctcttgccccttcttaggctcacacagtgcacatccgacgctcagcttcccggcttcccgcaggccctgcttccaggcttgtagatctgagccgctgagatctaggacatgtgccagggggttctttctgatcatgaatgtgcagcaggaaggcctcgcagacctcagcaccagcgcacacttgctaggggcacccctagtgaaagggagcagaccagggccccatagtcactgcccgggcattgtcccaggcagcaggattaggggcatctcccagagccccagatgggttcagaaaatgaagctctccaggctagtcaggcccccgatgaccgaatgccgcctgctttccagagaccaacctgaagaaacagggcctgctgcctctgaccttcgctgacccggctgactacaacaagattcaccctgtggacaagctgaccattcagggcctgaaggacttcacccctggcaaggttaggggcccgggtccccctgaggtggtggggtgaggggcagccaccttgtttcccctcctgcactggccccagggtagcttctcccaggaggcttcattccagctggaaaggcccccagttctccaggtggccccacagagaaagcaaagtggcttctcagagttgggggttggagtcaacccggggccctcacacctccccaacctccctttactcaccaggacctggcactcaggggacagcccacccactgcaggaccctctgggccccaggaatcccctgtaggtgccacctgggtctgacctgggccatcaggcacagactggcctaggatttggtttgcctgctgacctcttaggtccccaggcagtgccctgtctccctgacccccctgcggggccaagggcacacagtacccaccacttccacccacacccaccttctccttgcagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgtccagccccagggctagttgctggtccaccaggagagaaggcccaggcctggctcactgatggatccctgccagggataaagaacacgcacatttcactgacatgctggcttgaaccaacctggacaggaggtgaagggagcccagcaggcccagcacaggcaaagaagaggcggggcacacggcagccaagaggctctggagagatgtgggagccacagcagtgctcccaacgggcacgcagcacgcagggcgcagacccttctccagggactccaggccctgatagggtcagggacccttcctcacccttaggcctgccctccagggccacctaggttctaatcgtggcaggaaggctgagcaaacacaaggcccatgctccagacgcatccaacagggagcagccttgaaagccactcttccccggagccctcccttttatttcactgctgcaatgctgctcctacagggagccctaccttttttttgttgttttttttttttgagacagtctcgcactgtcacccgggctggagtggagtggcacgatcttggctcactgcaacctccacctcccgggttcacaccattctcctgcctcagcctcccaagtagctgggactacaggcgcccgccaccacacccggctaattttttgtatttttagtagagatggggtttcaccgtgttagccaggatggtctcaatctcctgacctcgtgatccgcccaccttggcctcccaaagtgctgggattacaggcgtgagccactgtgccccagcagccctacccttaatctcagggctttgatctctcccaagccccttccttgatttctttctccctcaaacccctccctaccccccaattttttaaagatagcatttcattgtgttgcccaagctgtaatgcagtggcacaaccttgaactcctgggcttaagggatactcccatctcagcctcccaagtagctgggaccacagggcacgccaccatgccctgctaattgttttttatagagacaacttctcacttttttagccaggctggtctcaaactcctggcctcacacgatcctcccactttggcctcccaaagtgctgggattatagatgtgagccactgcacttggcctcaaagccgctttatcagtggtcttgtccaccgtgagctctgtcccctttgcaagctgactcgcccaccccaccagcagccatgtacctttactgcctcacagccctggcctacagaaactcaggctctccagggagaagtgaccagccaagaccccccaaacaggatccctgacctgctgggggagatcccagagcagaagccccaggacacagcttccagccctgcactccggctctcccgcctcatgggggcttcagcaccatcagagccactcaccacaagcgtgtacggagcctccttctttggcagctcctcactggaagtggtggcatctgctgagctgggccctgtgggggacgtgtcaacaaagctctcgtccaccacccggaagcggatctcctcgccggtgtccatgtagaggtcgtgtgctccttcctccgtctcgtactcccacacccacacctgctccgcttcgtcgctgagggggtccagggtcaaggcagcaaccagatagtgggaggggcttccctcagcacccactccccgaccccgcaggaaaaaccaatctcagggtgagatcactgtggctgggaagtcacaggaaaagcaggtcccagccccatgcacaaggcctgggccaaacagagaggaacaagcgctcttggaggccaggacccaggaaggggaacatggggtccccagccaggcacca

SEQ ID NO: 16770 - DNA, 16411 bp, Human
ttggcttgagcacctaggagagttgtcattatctgagatgtggaaagtggccggtgcttggtctgggttatgtttgagacacccagtggccatctgagtgaaggtgctgttggggctcagaaagcgatgcctaaaaatatggcacttgggcatgctgagtactttgaaccaaaggacactggaagagcctcagaagcaaagtatctctctgaccttctcctgccccccttctttctcccgtttttctcctgcaaggcaggccatagaaactaaaaatcctcctccctaaggtgagttatagcaactacaaatattggctgggcacagtggctcatgcctgtaatcccagcactttgggaggctgaggtgggcggatcacgaggtcaagagatcaagaccatcctggccaacatggtgaaaccccatctctactaaaaatacaaaaattagctgggcatggtggcgtgcgcctgtagtcccaactacttgggaggctgaggcaggagaatcgcttgaacctgggcggcggaggttgcagtgagcagagatcgcgccactgcactccagcctggtgacagagggagactctgtctcaaaagaaaaaaaaaaagaaaaaaaagtaactacaaatattactggaaacatcccccacctttctgtgtcgggcctggccataaaggaattctctgatctaccttgcctgatactaggtcataagactctcattccagaaggggtcctgccctcctcccagcaggagggaatgccacacagagagaacaagaagaatccgaatctgaacagacattgctgggtttccacactcagctattaacattaaatcattcccttttgtctaatcgcgtttatacacagttgtccattccttattcctttttttttttttctgttgcccgggctggagtacagtgacacaatcacagctcactgcaacctcgacctcctggactcaagcaatcctcccacctcagcctcccgagtagctgggaccacaggcacctgcctggctttttaattttttgtagagacagggtctcactatgttgcccagactgtcgttaaatgtctggcctcaagcgatccccctgcctcagccttccaaagtgctgggattacaggcatgagccaccagacccggccagggctgtccattcttcatcaaaccgagacataaaaataaagatttccctgagtatttgtgtcttcattcctgaaggctctcaagtcacataaaacattgagtaaatcaatctattatgcttttctcttgctaacctatattttatttgtaggagtgtccgctgtgacctttgggatgagtaagggaaaatatcacacctttctgcccctacaatgcccagaacaaagcatttggcacttagcagtttctcaataaatacttgatgaatgaatgaagaaggaagtagcccagtctgtgcgagtagtccctgagcgtcaggcggggaaggagagccggctgcctttgcgggagctgtgaccgcctgctttggtgcctcccacgcaccctccttgtagagacgattaatcccagacttccattttcctagcagctcactaggcgggccttgcttcagagcagtctctcatttcctctgcacaaagccctcaaccgtcctctgcacggccgcttactgagcgcccacggtgagcctggcacgatccttgccctcttggtccccacagaggtggaaggacaggcctcgcggggtccgggccacgaaggacagccccgagtccgttctgccaatgccagcctcgctagcacgcagggcgggagcccaatggggaagggcttagggaggctgggaggccggacccatatgggcagggcacagcgttgctaggggggattctgataggttgcgcgaagggttgccttcgtgaggccccgccctcactggaacgcttcggacttatcaggttaccggattcgagtcagaagcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacaggtacctacaccggctggggtggcttggaagggtaggggtgagtgctacaaggagtgctttggcccttcttccctaatgtgggtatgtggagagacaggttcctctctcttttacttagagctgggcaggaagggaggagatgcttccccatacgggaatcatttctccttcaaaggggcccttcctttctcacttcctctccctcaagcacagaggccctaactgatggatatcagcatgtgcggagaaccgcctgtacagtccctacagtaactccatattacagataaggaaactgaggcccgagggggaaaggtctcacttaggtgagctgattgggtgcctatcctggctggcttacttcttaagcctctctgaggcctcttgagggtctgtggtagagagcaaagagctctggactggggctcaggagacctggagtctggccaatggtcccgacttaacgatttttcaactttactgtggtgtgaaagcgacgcacattcagtagaaaccacagtacgtatacaacctgtgtttcagtattcagtaaattgcatgaaatattcaacaatttattataaaataggctttgtgttagatgattttggccagctgtaggctaatgtgcgttgtcgcactttttttttttttttttttgagacggagtctcactctgtcacccaggctggagtggagtagagtggcgtgatctcggctcactgcaacctccatctcccaggttcaagcaagtctcctgctcagcctcctaagtagctgggattacaggcactcaccacctcaccccggtatttttttgtagttttagtagagacagggtttcaccatattgcccaagctggtcttgaacccctgacttacggtgatccgcccacctcggcctcccaaagtgctggaattacaggagtgagccaccgtgcctggcctgtccacatttttaaggtaggctaggctcagctatgatgtttgccaggttaggtgtattaagtacatttttgacatgatattttcttttttattattttgggatggggtctcgcactgtcacagcccaggctagagttcagtggcacgatctcagctcactgcagcctccgcctctggggttcaagtgatcctcttgcctcagcctcccgagtacagcgcatgccaccacgcctggctaagtttttgaatttttagtagagacaaggtttcaccatgttggcctgacctcaagtgatccactcgcctcggccttccagagcgttgggattacaggcatgagccactgcatctggctgatgtgatattttcaacttacactgggcttatgagaacgtagttccgtggtaggcctaggagcatctgtactgttaagttctatatatgggatgggaggagctgatgggggttataggaaggttaggacataaggtgttagttttgctaattccaggtgttagttttgctaattccagcaatgctgtggtgacggccagacctcaagccactgcctggcccaggcaccatcctcccacttactgctttgcaagagccagccattgcaggaagagccaattctaccctaaacccaggagtccagtttcccttatatataggcaggcagcctctgtagggctgagcaacatacagatggggtgggatgagggctggagctgtgggggcaactgatagtcaccatcccctcctcccttgccccctagtgctcttgctgggacatgtggcccaggtgctgatgctggacaatgggctcctgcagacaccacccatgggctggctggcctgggaacgcttccgctgcaacattaactgtgatgaggacccaaagaactgcataaggtgagtaaggtccacactcacctgatgagccttgcccagggccctgcagattcgggggcaggaagtggagagtccactagaaaagagggcaaggtcagagttctccatcccagagactgcagccagaagtcactcggactgtctgacacctagccccatgacctgtctggagcctctgcagggactctcaggccccaacctggtcacgaggcagggaccttacatggacccagcccctgagataactcttagaaggtcaggccaggccccctgtacttcccctgacccagtcctgccttttagcctggggccagccactcctttcaagccagcttgcttatggctcatcgcacaatctctggtggtcatttacactgatacctggcttagggctcagcaaggtcatggtttttatagcccagattcaatcagagctgaggcagggtgtgggtgagggccgggctgggtccctgagctaccccatccctctgcccctcactagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgtgagccgcaccccagccctgcccttggcctcagggctagaccactcctttcaccctacctcgcttagggctcacttacgtgattgagatctcacagtctagtgggggaaacagacaaatgaacaccgacttttggcctattctgttgagtgagagccagaaagggcatctcacacagcctggtattctaggaaggttccctggaggaggcatttcttgagctgagcccagagagatggcattggaggcagagaggatggcaggagcaaaggcctaggggcaagaaacagccgctgggaggtgtgtgttgggggagaggtgggccatcatgggcagaggccgggccagcatgctgggaccatctcctttggtccgtgggagccactggaggtttaatgggacagggtcagatatgccttgaggaggctccttgagggtcctgcttgagcccactgtgtcctcaaacccccacaggttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccagggtgagttacgcagctggctggggcacgtaggcaaacggggagggtggccatggagacccacccagcgcccacctggctgagcttcccaattccccctacccaggggttagggggattgtggctcccaggctccctaaatatgagtggcagcatagcccaccctggaagcatttgaggctctgggtatgtggggaggcacctactgtttggagcttgtttcttcacatctgttgggaaaaggtctgggctaaggccccagactgcctcctgcacttcctcaggactgaaacaggttgggctttctctagggtaccccaagatggctgctgccctgaatgccacaggccgccccatcgccttctcctgcagctggccagcctatgaaggcggcctccccccaagggtaagccattctgccccctgcctgatggcgcttcccacacccaggcctccttacctcctgagtgccaggcttcagggacggggccttccagagccagggctgctctcaccacaggtgcccatatggtgatttgtaggtgtctagagacctacattaagtagccgcaaagagcaggtgggctcagccagcccagagaggtgtgtgtgttggagggagtggcgggccttagagaagaggcccttgtgaagtgggctgaaggagttggcatcagaggcaggagagccatctgtgctggcacacagtgcccaggattccaggaggtgcccattaggcgaggagacccagaaggctggggaggccaggcaggtggggccaagcctcagaggagcctgtgggctcatgagggctcccttagcatgtttgacaccaaaaagggtgggctcaggcctctggagctgagaagaaagcagacagcagtttctcactgagagaacatgggggtgggtgggtgtcagggagggttgtttgtgggtgcaccagcctgggcccacaccctgggtttgacccaagctggcatgagaaggcagggtaggctcctggcaccagcatgcacagaagggagaccccggtagccccagagcagggccaccctctgaggccctcctcatcctgagcaagccggtggggcctgttctcttccctcttccccactctctgtctctcctgctgagcctcctcaactcctgtgtgggtccctgggctgcagcgtgtgattctggtgctggactctgccttcccctcgacatccaggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatggtaccaggatggagggggatgtccctaggcccaccatctgtgacgaccctgctccccactgccctgtgctttcttccttcttggaggctcactgccgggttctaggtcagcgcttctgaaatgtgtccctgaactggttgctttagacttgacttagaagctggtttccagggccccatcccccacgttttgcatcacaatgttcaggggaagaacactgttaaccatctccccaggcaattctgatgtttctgaaagctcaagaacttgggtctgtagtgaccctggaataagatgttattgctctgcaggttgaagatcacgaccttgctattcctagtgcctggactgctctcccccgtgtgcctctgatccttttgtcaatttcctgcctcatcctccacagggacaactggccctcacagtcctgcttctagcccttccattctatctcggtcattgccctgtgacattttgttgttgttgcaatttatagctttatagttatctgttagtcaacaagcatttactacctgattgatcctatgatgattataagaattacaagtgctaagccaggtggagggagcaacctggaggagcaggaactggcctgctgtggagtcccagctctagctctgccactttacctcgggcaagtaacttaatttgttctgtgcctcagttttgtcaattggaaaataagaatagtagctaccttatagggttgagggttaaaataactctgaaatgcttggcacagtgatgggcacacagtgcttaaattgttgtcactaagcctgtaattgtgtcctgactatggattgcttgccctggggtcaggagtcccccttggtccattcagctgtggctagggcaagtgggtgtggccagtggtaggtacagggactttgtcccgttctgtttcttaccactgtcaccttgggacatttattgacttgacctagtttataagctttttgacaacaggagcccatttgatcatctgaacaacctgtgatgtagccagggcatattaccacccccatcacccccatggggtttttgttttttattgatttatttattttttgagacagagtcttgctctgtcgcccaggctggagtgcaatggcgcgatctcggcttactgcaacctccacctcccaggttcaagcgattctcctgcctcaaccgcccgagtagctgggattacaggcgcctgctatgacacccagctaattttttttttttttttttttagtagagatggggtttcaccatgttggccagactggtctcaaactcctgacctcatgatctgcccgcctcagcctcccaaagtgctgggattacaggtgtgagccaccacgcccagcctatttatttatttatttagagactgagttttgctcttgttgcccaggctggagtgcaatggcatgatcttggctcaccgcaacctccgcctcccaggttcaagcgattctcctgtctcagcctcccaagtagctgggattacaggcatgcgccaccacgcctggctaattttgtatttttggtagagatggggtttctccgtgttggtcaggctggtttcgaactcctgacctcaggtgatctgccctcctcagcctcccaaagtgctgggattacaggcgtgagccaccgcgcctggccttttgttttttgagtcagagtctcactctgttgcccaggctggagtgcagtggtgcaatctcggctcactgcaacctccacattctggttcaagttattctcgtgcttgaacaagtagctggaattacaggtgtttaccaccacgcctgggtaatttttatattttcagtagaaatgaggttttgctatgttggccaggatggtctctaactcctgggctcaagtgattcacctgcctctgtagcaggaccagccgcagataaaactcctcagacaccagattaaagaaggaagaggtttttattcggctgggagtgtcggcagactcgtgtcttaagagccgagctccctgaaaaagaaattcttggcctttttaaaggcttacaactttaaggggtccatgtgaaagggtcgtgatacatcacgcaagcgtgggaaacatgactggaggctacatgcatcagctaacagaacaaaaagttttacaatgcttttttcatacagtatctggaatttgcagataacacaagtagtttaggtcaggggttgatgttattattattacttttttttttaactcctagggccaggtggtggtgccatggttgtctggctatttatcttacttttgtttatttccaactttttgctttttctctcctcctgtcttgtgaactaggcaaggttgggagaggagggcagcaggagtagtagtggtctccttccttacctcagcctcccaaagtgctggcatttacaagcatgagccgccgcacctggccatctgcccacccccctaccgccgactcctgttcttgatggaaaataaaaagctgaagctcagatggaaggtgacttaactcccccaaggccacagggctagggaatggtgtttgctgaaccaggcctcctccacatacagccatctttccctaatccctaattgctcttcctcggctacaagtttggggatggtccctgtgtctacctccttgaggagatgagagctgactactcctcttctctgcccccagctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggtactagggtgtggagggaaggaaggggagggctgaggaactgggttctcctgagagaaaggctgccagcctccctgggggcaacacctggcgaggtacaggagtcgcccagtccccaaccagggctaccccttctggttgcttatggttgaggactctgatgggagctgctccaactgtcctcctcttgctgggtgagagcagggctgagcaggacagctcaagggagtcggggatgagaggtgtcagccacataagtgcacatagcaagggtgaggcacagagcttctatacacccgtgatggcctgcagagagcttggacttccctccagagcaggaggagctggtttgtttgtttttgagacagggtctcactctgtcacccaggctggagtgcagtggcacaatttcgactcactgcaatctctacctgccaggttcaagcaattctcgtgcctcagcctcctgagtagctggcactacaggcgcctgccaccacacccagctaatttttgtatttttagtagagacaccatgttggccaggcttgtctcgaactcctggcctcaggtgatccacccgtatcagcctcccaaagtgctgggattacaggcatgagccaccgcactcggccaggagaagctgttatagccaaggaatactacgactactggtggctgctatttattgagtacctaccatgtgctgggagttttagataatttttctcagcaaggtagttatcttgccattttacaaatgagaaaaatgaaacttcgagagtctgagtaactttatcccaaggctacacagttggtacaaacaagactggacttcagtgtcacctcaaagcctttttttttttttttttttttgagatggagtctcactctgtagcccaggctggagtgcagtggctccatctcagctcactgcaacctctggctcccaggttcaagcgattttcctgcctcagcctcccaggtagctgggattacaggtgtgcgccaccacacccggctaattttttttgtatttttttcagtagagacagggtttcaccatgttggccaggctactctcaaaactcctgacgtcagctgatccactggcctcggcctcacaaagtaatgggattacaggcatgagccactgtgcctgtctgcctttgctctttaccaaatcctggattctggtaaaaagaaacctacagaactatggaaggcacctatagaactggtgatgcccagaggaagtaacaattccctgccagaggggctgatggtggagctgggcctggaaaaccttctggaggatgggagttcacatccagctccactctccaccctcctggaacagagttcactgttcccactggacagcaccctccaggccagcactggcagctgtttggggccagcactcatacgctgtactgttgttgcgcttccctgtttctgcgtttatccctcccgttgtcctatgagcttctggggcagggcctcatgcagcacttgtctcagtgtgctagcataggggccgggctcagagtaggtgttgatgagtatctgctgagtcagggaaggtgggcagatagggttagataagctggggtgctggaggcccgtggcatcctccctaaacctgtgtgacatggagctgtgaactgggggacccagaactcagggagggccagggaggcaatggtaggtcctgtctgagcaagggaccccagccagtagccaccttctgtgcccaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggtgagcacccggctgcctgcagccacccgcctgggcttcagatttctgtgggagggtattatggggggtggttgttcacatatggcctcccctgagccgtgggcttagggcctctggcaggtgcccatggggagctgcaggcactgagagctgcagccagtgccgtgctctgcaccagtattttcaacctatgcaaacagaactactgcatataaatatgaatcccattagcctctacggctgtactcctcccaagggtcagcccttgctggcacgttcctcacagttttccatgggctggggctttctccactgcccgtgcttgggcacctgctggatttgctggtggagaagtgatggggattcagggctcccacttctgtagggcatactggaagcccagcacagacaggccaaagtccaggcagaaggcttctacatcctctagcggggggggtctctgtgccgccactctcatggtggcattggtgatgtccctccccactgcaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtacagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattattttttttttcagttaaatacagacttgtttggacgcaaggtaccctttctctttttaaaaactttttatcatgaaaactttcaaatacaaaaataaaatggtagagtgaacctccatgtacccagcatccagctccagtaaccatcaatgtgtaccattatttcatctctcttcctgcacatgctcttctgatgtgtgagctagagtatctgaaaggaaatttcagaaaaccctaaaaaccactatgtctctaacagataagggctttaaaaatacatatatgagccgggcgcggtgactcatgcctgtaatcccagcactttgggaggctgaggtaggcggatcacaaggtcaggagattgagaccatcctggctaacacggtgaaaccccatctctattaaaaatacaaaaaattagccgggcatggtggtgggcgcctgtagtcccagccactcgggaggctgaggcaggagaacagcgtgatcctgggaggcggaggttgcagtgagccgagatggcaccaccatactccagcctgggtgacagagccagactccatctcaaaaaaaaaaaaaaaaaaaaaaaaaaaaaaaaatatatatatatatatatatatatatatatatacatacacacacacatatatgtgtatatatatatatatatatatgaccttaatacaattttcctatctaaaaaaacataattttaaaataatctaataaccaatctatgttcagtttttgccagttgtctcaaaaatctctatagtttgtctaaatcaagatccagtaaaatagtccagtacgaactactgaaagtttgctcccttcataaaagcattgaaaaacctgccacatactatcaaaatcaactttcacagaactctggaaattagccaaaagcttgcggcaacccagaaaacttcaactgaaaaaaaaaaaagttgaattctagtagaaacagcaagctatgtggtattttaccttattaccagattttaaatcagctattttaaacatgttcaaagagccaaaggaagccgggtctaaagaaataaaggaaagaataagaatgatgcccaaacagaataacaaagaagagataaaactgtagtggggaagaaagcacaaattctgaagttggaaagtacaatagttgaaatgagaattcactgaagaggtttaataatagtagatttgacagaaaaagaatcagcaaacttgaagacagatctgttgaaattaacctctctgagaaaaagaaagaaacaagaatgaagaacaatgagcaaaacttctaaaacctttgggataccaccaaatgtacccatatacacataaaaaaagagaaaggggcagaatattggaagaaagaatggttgaaaatgtctcacatttgatggaaaatattaatctacctatccaagaagctcagtgaactccaagtaggttaaactcaaagagctccatacctagacatatcataatcaaaccctcaaaagacagaattttgaaagaggcaagataaaagcaactcatcacacaagggagtctcaataagatttacaactgacttctcatcagaaaccatggaaacaagaaggcaatgggtacatttaaaaataactaagtataattggattgtttgtcacaaaggataaatgcttgaggcactagataccccattttccatgatgtgattattacaggaatgcaatgcctgtatcaaaacatctcatgtactccataaatatatacacctactatgcagccacaaaaattaaaaatgaaaaaaaaggcagtgggttgacatattcaaagtgttgaaagaaaaagactatgaaaaaatttgttatttggccaaactatctttcaaaaatgaaggcaacatgaaaacattcccagataaacaaaaacagagttcatctctagccaccctgccctacataaaatactaaaggacatccttcaggccaaaatggaaggaaactagtaacttgaatccacatggagaaataaagagcaccagtaaatggaactacataagtaaatataaatgattttggtttgtaactcattttttgtccccatctgatttaaaaggtaacttaaatg

SEQ ID NO: 16771 - DNA, 7872 bp, Human
ggagatgggggtgctgcaacttttatatattcagaactttggctacctcttcctcagatcttctagtgccttccttcacctcccaaagcaaccccaaatgactccagcttgccttgcaaaacccccttgctcatgccgtgctcagcattttctttcctggtgcccaggtccttggatttaattacacaaccacagagacctcctttggtacctttagacctttggttcttaaagcaggtggcatctccactcgggctggagatgggaagcccaggacagaatatggtacatcttcctgatgtatccatttctcttagagaattaagcaaagtatttgaaagtttaactggaaatttaaaaggggctttttaaaaacattaaagctggctgggcgcggtggctcacgcctgtaatcccagcactttgggaggctgaggcgggtggatcacgaggtcaggagattgagaccatccttgctaacacggtgaaactccatctctactaaaaatacaaaaaattagccgggcgtggtggtgggcacctgtagtcctagctactcaggaggctgaggcaggagaatggcatgaatctgggaggcggagcttgcagtgagccgagatcgctccactgcactccagcctgggtgacagagcaagactccatctgaaaaaaaaaaaaaaatatatatatatatatatatataaagattaaagccaacatggatatattatggaatatagggtcaattcatatgaagtttaaagatcaactacaagtgatttcaggccgtggaggcccctttgggctatctcctgactttcctaacatatccatctactctgttcggatactatggataaccttaggaaatgtttgacaaagacctccttattcctttctctctgcccctgaatatctttcctagattatttaaatgcattttttttgttttgttttgtattttgagatggagtcttgctctgtcaccaggctggagtgcagtggcaccatctcggcttactgcaaccttcacctcccaggttcaagtgattctcctgcctcagcttcccgagtagctgggactacaggtgggtgccaccatgcccagctaatttttttgtatttttagtagagatgggtttcactatgttggccaggatggtctctatctctagacctcgtgatccgccggcctcggcctcccaaagtattgagattacaggcgtgagccattgtgcccagccttaaatgtgttttttatggctctctcggtttgcacttttcagcctctttcaaaacgatctcttaccccagaaacttcttgttctccaactagttatcaaagcctctacctttaaaattctctcctctacaattttcttaagtaatatgtggtggtgggggggaagtattacacggacccgtaaaacacaaatcgctgtctaatcttttcagtcgtgtcctccattgattctaatcatccaccttaaggcttccaaggcacagaatgctccatcatttgaagattcttctctaaatgcagagggaaagacagtccactgtggcctcttaatgcaacttcttcctcaaatcaatccgtgtttctccctagaaacggcaggtggaccaggacatgagtatgtttatgggcctgcagaattatgtgacacaaaagaatgtcatcggatggatcaacacctcaattaatgagggcagatacttgggctggactgtgtagcctctttgaaggcctaccacagaactctgatttcatgggtggactgtctgcggaggagtcctgacttagcaagaagcccaagtaaagaattttatgggagaagggactcttcagaggaaggcaaataacagactgaaggaaagggcgtttgaaaagaagtgaagaaataaaaagaaaaaagacattacatactgtgtccacaccctctgcagtgggatataaatgctccctagaggaaggagacccacagctctgtggcttggagaatttagactctgtcttcagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgtgagcaactgcaactggttctgcgagggctccttcaatggtagcgagaaggagactatgcagttcctgaacgaccgcctggccagctacctggagaaagtgcgtcagctggagcgggacaacgcggagctggagaacctcatccgggagcggtctcagcagcaggagcccttgctgtgccccagttaccagtcctattttaagaccattgaggagctccagcagaaggtgagcggcattgctgtcatctccaagcaagagagtttgctgtgattctgtctgtgatagagaagtgtgtttcttgcttctgtgctgtcataattcttgcttcctcttttatttcaaaatggcttaagtcatttttaaaaagttgatgatttcatatttattttcagtcctcactaagccacctctcactccccagatcctgtgtaccaagtctgagaatgccaggcttgtggtgcagatcgacaacgccaagctggctgcggatgatttcagaaccaagtgagttgttcggaatttgcactagtgtcaattgcttctgtttaatctttaaagaaaagggatttccatctgaaaacagatctacccacttgttgtgaaggattctgcagaggactggggagaaccaagcaaagaaatgcaaaaatggatgaggactcacatcaatctgtttgttttgggatgaatattgggtattgatggagcctccagaaacctctgtctcctgggcctattcattacagaaagtggaaagataaggcacatgaggttatcaaaaatcattcctgtgagtcttgaagatctaccaggtagtactctgaccctgtccttgcgcaggtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggtgagactagaaatgagaaatgcacaaacctgtctcagcctctggctcagggttgctttagtgatttggggcagcagaatgcagagtatgagtacaagactgagggtttcctttgaaaacatcacggtaagagaaaaattggagagagataagacctgttcatgttcccagacaggaaacatctttcactttaaactagcacattatttgagttgcccggagcagctccatgtgcttgcagttgatcaatagttgtagaatgagtcctagcattgcagtgttattgctttgtaaagtcttttttttttttttttggcaaaggccaagaaaaaaaatatcaaaccttataaatgtgagtctctactctttcaaagtattggtgaagagtgtttgtgagattcttcctctctcttgggaggggccatgacatgctcttacctcttacttgacagcaagagttttttgatatatggtctgaaattgcacagcctattttttttggcattctgaggtcctcacagccaattgtaaactgggaaagttgaatatcaattagttcatccttcagtggcatccaagcaaacttttgggatttttttctgaagccaagtgccatggcacagcagatggtggggagggggctatgccacatggagtgccttgagctgtcacaaactgctccactcaaagtttcttttccgagaaaatagactaacagggtttcaacaagcaatgccattccttagagttcattctttgctgagcatagtaactcttgtattttctgcatccataggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcaggtgggcatctaagcacgtggcccctcaggacccaaggccccccagggccccggaggcagggtctgatcctttctccccttgggtgtttcagaccgaggagctgaacaagcaggtggtatccagctcagagcagctgcagtcctaccaggcggagatcatcgagctgagacgcacagtcaacgccctggagatcgagctgcaggcccagcacaacctggtgtgtattgttcagacctgctggtgagcgacgggaacttgggaggcagagtcccggggatgtgcttggggccacacactctccttagctcttggagcttgtgacttccttgtaatcctgtgaagaaaccctttgaaggagcagctctctgacattcccaatcttctccaccacagcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaagtgagtacatgggcagacgtgtttgatgaaatgatgcacgtgtgagtgtaacagttagacaccatgcaaatattgcataccttggaaaggaaattatgccttcacactagacatgctcaaacagaactcagacaacataatatggccatcatttaaaacataaatggtttggtagcaagagttgtttgatgtacaaactgaaattgcactgccaagtctttgcattctagtatgataatatgcatgactgcatgatatgtgatcaatgccttactttttacaatactgtattgcctagtgggtacattcccataggctacctgatttgatcttataattaccaccaggtgggctggatcagtattccctccattctacaggaaagtaaactggggcttggagaaggtaaatgactcaccccatgtcatcagtttggcatgaatggatttgagagtagacatcagagtttcagagtttctgtctaccttggtgctctatggcagggagaccattaacaatttgagttagttatctttgtagcaggggagtctgtgccttttctgttctaggccaggtcaagtcccttgacccaggcattcttacccttggggatatctctggcatatgattttaaaattgcccttaactcacttttccacatcattcttttgtctccagtctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgctcaccctttccttcctgggggtctgttccttcctatgctcacccagagaactctctgatgtgccagtgggcctcccttttaacctcctaataaatatcatttccttggcaaagcagatgcctttttcatttgtattcatttgtttcaacgtgctcatcacctgagtacgctataaaaagccacttgaaagacaggccatataatggcctgactcttggataccagagcagtttcatgcctcaggggaagatggtgaatctggtgccctggacccaggagcgaggcaggcaggccagtgggaaggagggtggaggtgctgagtgctgcagtccctatctccccttagctattcttggatttcccttctaacttggacatctcccagagctgcttgtatcctattctgaatggaggaggcatgagctgcgggctggaaagaagctctggaaaactcatgttctttcagcaggagtttcaggttcagtgctgtattattctgggttattggtggtccaggcatttcccagcgaagaaaccctctgacctgccctgctatacccaggaattcctcctttcccttgtgtgggttgatcattatcagcctgggcttccagcttctgtcctccctcctcgactccaggtcttagagaccccgtcaactctttatttgatcctttggcctttctcaattcaatccaaccagtacctgttgaatacctactctgtgcagacgctgggtggtgggatgggtagagacacatgaagaaacacacagttcctgactgcaacttactgataatttgttaaaaaactagtccccaagtagtgctcttataaggcccagtcccctggcactgtgaacagctggtgggtgctagaaggaactctgagtaccgaaagggacaatgctggtacccaatggcattggtgtttatcaagaaagggcatctttctttgactctcatgaagacccatggaagtgtttaagcatagacctcccgaaaacatagagggccattttgatctgaagggatcagaggtctctgacttttcccaccacaccaggctttcccagcgggtatcagactccacctgggtgaaacatagtcctgtgtcctaaaatgatcaagtgaatcggaattttatatgtatatatatatatatataaatatatataaaaaatatatttttgtttgttttcataaagcgatgattctctccaccataatttctcccttgattcttctttttaaaactcaagttccaggatggatttggatttgtgctttgctgcttggcttgtgagaaacctctgacctggaactctgtctctactatgattcaccctgtgtctgtgatttcctccaaacccaaggtcaagctcagtccagaggctctctctcatgttgcttgtttctttattccacatcctgcttatgtatattattttacaataatacaaaagtactgctaatagctcctgtggtagacagaataattgtcccctccatccctcatcaaaatgttcatgttctaattcctggaacctgggaatatgttagattacataaaaaaggaaatcgaagttgcagatggaattaaagttgctaatcagctgactttacgatagggagattatctcggattatcaggtggactcagggttcttaaaagtggaagagggaggcagaagagtgagaaggtgatgaaactatggacccaggtcagagtgatgtgatgtgagaagaacctgccttgtcctcgcaggatttgaagatggaggaagtgggtcatgagccaaagaatgcaggtcatctctagaccttggaaaaagcaaggattctcctctagaccctttaaagagaaacgcaaccttgccagacctctgattttatttttattgtggtaaaatatgtacaacataaaatttaccattttagccatttttaatgtacaattcaggggcattaagtacattcacattgttgaaccctatgcacagattcccactaatttttggcaagtctcttcaggaactgcctttagattcaattatgagtcacaatcctatggaggtggttttaaaaatgatccaaattgattgtctacgtcact

SEQ ID NO: 16772 - DNA, 14156 bp, Human
tctctactaaaaatacaaaaattagccaggcgtggtggcaggcgcctgtaatcccagctactcggaaggctgagacaggagaattgcttgaccccgggaggcagaggttgcagtgagccgagatcgtgccactgcactccagcctgactgacagagtgagactctgtctcaaaaaataaataaataaataaaataaaataaaataaaaaagtagaaaagagatcagagttgaagtgtcattatcaacatggctcttagctggatatcacatttaaaaattagataatttgggttttcatttgagatctgatttcttgagagtgtgaatctgacaatctgaagtagagcttcatcctgatatagtaacagctaaccggatggagtggtcccctttagatgggctgtgcattgaccacggttctggggtaggatgcagtgccctgggggagtcaacaggaaggggaatgggtggattatatacttccaggtttacggggtaaaggggttactgggaatgattcatttcccacccacggtgaagttctctctggagcagagtgattaagatcatagattgtggggaaaaacaaaacaaaaaccccaaacccatagatttgcaaccaaactacctgatttgcctctctgtgcctcagttctctcaattttaacttggggataagcacctaccgataaggactacgtgagataaccctcatgtagtaagaactattaacaatgactggcacataataagaacttaatagatgtttgctatctattaggaaacttaaagtttgcctggaagagcagaggaggtcaagtctaacaattgccgctttctttccccaggtaggaggctagtaggaggggtgggggggctgggggtgagggggatggttaagttcccacggtgacggggcagatatgggaactcagtctcctattcccttcttcagttctcagctccaccaaagtacccttttcctggatgacagctgtcatttatatggcgttgaactgtgtgcctagcgctgcacaagtgtttgcactttctccttgaatccccacagctaccatatagaataggagccattgatatacccaggtgaggaaacagatgcagagatgtggcttggtcaaaacacagctgaattggcagagtctagtttctttttctttttcttttcttttttttttgacggagtctcgccctgtcacccaggctggagtgcagtggtgcgatctcgactcactgcaagctccgcctcctgggttcacaccatgctcctgcctcagcctcccgagtagctgggactaacaggcgcccgccaccacgcccggctaattttttgtatttttagtagagacggggtttcaccgtgttagccaggatggtctcgctctcctgacctcgtgatccgcccgcctcggcctcccaaagtgctgggattacaggcgtgagccaccgcgcccggcaagcagagtcgggtttcaaattcagtcaacttgtcttcagggctcggctcctaacgcctgcgcgggctgtcagctgaactcagcgccgagccgtgagcttggctttgcccctccaagcttgcgcggagaacgcgccgcctgggccgagacggggaccccgggacgctcccgcctcccctcggaaagaggacggagatgcagattctccccgagcgttggtttgggagtctggactcttaggtccagtcccagcccagtgatttgttgggaggccctgggcctctgggcttcagtttctcgggcttccaggcgggtcccggggcggctaggaaggagccgcccagagagggaggcgcgcccgcgctgctcgcaagcagaaccttggaggcggcggctccgggagctggcgcgcgcggcggagcggcggacccggcggacccggcggaccggggggcggggcggataggcctgggcggagcgggaggcggaggcgccgcgtaggcccgggagccgggccggccgggctgcgagcgcctgccccatgcgccgccgcctctccgcacgatgttcccctcgcggaggaaagcggcgcagctgccctgggaggacggcaggtgagcggcggcggtgggcccgggccccgtcctcccgggcgccgctcccttctcggccgccggcggaatctgggaacccgaggccatcacgtctccatgtctgcgggtttctgtgagggcgtgtggttctccctgtgggtccctggcgctctgttccggtttctgtctgtccctgtgggtctctgcctcccccgccccctctccctttccgcggcactcgtccttcccccagcaccttccccccggcccgtgggtccgtatttctccattgacttccctttgtgagtttctgatcccctctttgctagtctctctcgttatgtgtttcgttgtgtctgtgtttctccaccagcctccctctatctgcatgcgggtctctgactccgctgacctctcaccatggatttgtgtttctcaatttgtctctgatccctgaggacgtgtattccgtttctctggtctctgccttcctcatcacatccatatagcctcagaccctacccttcctccttaacacttccccccatccttcgcaggccaccagcagaacccaccagacagaagctccgtgctctgcctggctggtcactgcctggcacgtactagacactccttatacacgcattagtccatttcctgtgcagctgtattggccctacgtgaaagatgcgagcttggcccacaccttagctaattttgtttctcactaaagcagaatggggaaagcgatttgactgcctccattcgtggggcacttgagatgtgtccctgtaagtcttctcacagaacacatgactggatctcctcctcgtgaatgacacctcatttccttcatgtttcttaagtccgtcaggtgccataagattctggaatttagtggccacaacttgtacttttggggatttttcagacttggtgttgaaaggggaaaacaggaatataatagaaagcgtggactagcgttcgacctgggcaggagtcctccgtaattatgtgagcagagacccctgcatctgtccgaccgcagcctttccgtcactgagccagttatgacagtattggctctgcagggctgtgtgaggattaaaggaccgcacacatgtaaagagcatggcactgcctagcacaacaggaggtgccagttgtcttcccgttacctttgcagttttgaggtcctgtaaccagagcagctgaggattcaaacctcgtagtacgaaggtctgtatgagacaagaaaggaaaggtaacagaggagcatttctatttcctgatccttttccatagctgtttccagagaaatttactgatgtcaattctgtgcttttgacacagggttggtgcaaagatccacgcaactgatgcaggctagtgtagctatctagtgtaggctctggagccagcctgcctgggtttgaatccgccttttactagtcttgggcagtgattgatgagggagacaaagcctcttctggactgcccctcagagccagggtggcctgggcctgggagccactgggactgcaaatctggtttgccacctggtggcaccaggaacaattgttctcggtgtccactgtcctgaggaattgggactctgggttcaatccagttgctctgcggtttgtgctcttagagcacaggatgatgcccatggggatgtggtcctcataggagaggggagcagggccgagggaattagcgtgtggacgtgctcggagtacccagtccacgccgttcccctggataatagtcactgcttcttttcatgaaggtgggatatcaccccatatccatctctccagtctctaccctgtccccagaaaaagcccagagggcaagggagaatctgtagaggttccagccttcccagaccactctcaggactgggctgtgctcctccccagctgaatccaccaccacaggataatggggggtaagtcagaagccctggggggtttcctaccaggccacctctcagctgcgtgtggaacctgggcctggctgcaaggctactggcttccaggttggcggtctctctagaaaaagggaggagttggtctggctttagcatgtgacttaaggcatgccctgactgccttacccctttctgtaactcacttggcaagctctctgctgtctggcctgtgcttgctgtgctggggccacagataagaatctgacacggcctgagaagcaaggacacaaggcattacaaaaaagtgggaagatgccgtgggaatacaaaagtgggagcattatgggggcagggggcagtgctggccatgacattggagttcggctctgaaggatcaacaggggtcctcaggcagataaagaaggacatttcaggcagaaggagcaggctgtgtgagggctggagcaggaaggaatatagcaagtggagaagctccgaggtgcccaacatgagaacatggggcgaaggcttgggagcacctggagttggggccaggtcatggagggctttgactgtcaggccaaagggcttggcctttgtctggcaaacagaggagggtcattcagaagactgaaggggtctgagcagggcaaggaacacatgagtgaggaaggatcagagggggacttaggagatagaatttatttatttatttatttatgagatggagtctcgctctgttgcccaggctggagtgcagtggcgtgatctcagctcactgcaacctccgcctcccagattcaagctatgcttctgcctcagcctcccaagtagctgggactataggcgcgtaccaccacacccagctaatttttgtatttttagtagagatggggtgttaccatatttgccaggctggtcttgagctcctgacctcgtgatgcacctgcctcggcctcccaaagtgctgggattacaggcgtgagccaccacgcccggccaggagatagaatttataagacctgatagctaatcgctgactcttaagattgtgaagtggattcctttgcagattactttggggagaaggtagggggagtacagaggaagcttctcccttcatggattcctcagctcctgtctcagcatactcaggaacttccagaggagcggcaaaggaatctggtgaattctgtttctttgtatttgctaaccaaaaggctgtctcctggcatcaccccagtgtctgtgatgttcagctgtttttccagtttctgaaatcagtgcctgtgctgtacccagccctcatctttctttccctctccatctcccatcttttatcatgagctgcctcttggactaaaggtttgaggctcgttcagtgaaccgccactgacagtttgggccttgcattgcttcggggggcacgtctgatcttcccagagtaaacattggtcattttacctggactaatgccagcacacacccgtgtctgggtggcctttctggtcattcttggaagcaggatggagccacggtttctgctggggtggatctgtagggcagcgggtttggaaagcagtgggttgcatctctaaggtggggactcctgtcattggctcaggacattgagccactatcgtggggaggagcacctgcaagtgacaggagcctcctcatccttgccctgagcagctctgaccaggactcagtcacagaaagtaagagagcattgaggagccggggcagctctgtgaactgggagtggttcagagggcttcccgagagcgggtggcatgggttgggtctagagaggcaagcaggattcggatgcatggtagtggcatgagcagaaacattaaagttgcttctgtactaattcccaggtgcttggggtagacgagttatgtgcagcctcctcgtggggaggccagagaacgggtctgtcacagggccagccctgccccgccctcctgaccctgtcccgcgcttgctccaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgcgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggtagcgcccgcccccaccctctcccctcggcacccctgcccgggctcaggcttctcagggcctgtgagaggccacctggggcaggggcaggagggcgggaggtggcagacccctctcactgggtgtgacaggaacctttggagagggccctgatctaatttccattttgaaaagctcactgtggctgccgtatgtggaatggattataccagggcaagaggagaagcagggagagcagttaggtggtcactgctgtggtctgcggtgacagtggcttgatggcctggtggggggtgggtagagagaggtgctgtggaggaagcccagacaggactccctggggattggcccggggattagggaaagggagggtcaaggccacggctttaaagttgcccacagtctggcgttgtcctaaaatccccgcccttaccaaaaagtgctcccttccatgaccacagcctgagatctcacccaccagcccccacctcctttccctctaggtaactcccactggaagatggattctcagccccaccagcctgatcttcccaccttttcaagtccccttgatccagatccccagaccccccccttttccctgccacccttcttgtctttacttcctccttacccaacctggagtccaaggtccatcattaaaaccctccctggcatactccctcaagcctctggtcccttgctgctggcgtaatcccagcctgatttactccagctctctgctccacacctgtgcctgggcactggagggtatggagaggaaagacaacacgtgaggcggccatgctgctgtccccatgccgatgatccccctgccaggaaggccctctgccctgctgggagcctcactttcctctggtctgtccactgcagcctttaaaactatctgttctcctcattcatccctcgtcctcactcatagctgacgactttgcttccaatttcagaaaacagaatgaaatggaagagaactttccccagttccctccacaactcacctgccagcctctgtgcacagggactcaaggctgttccagcttctgtccgggctgactcccaccatccccatccttcagtatttccccccaccccacagttgggcccttcctctccctctcgatcagcgttcctctcctggagcatacccatgagcacacacaccctgaagtggctcctctctcaaaggaaaaagactccctggatcccacatccctcgaggctgtcacccttctctgctttctggcagacctccttccctttctctcccctcgtctctcttgaaccccttccgctcagactcctgcacccaccatggcacagagcagctctcactgaggtcaccagccacctcctccactctgttggtccagaggccatgctgggccctcatcctgtggacctgccagcagcatcttctttcgtaaaatgcccctgcttggggcagcaccctctggtcctccctctgcactggctgggcctctgtgtctgtgggttctgctcatctccccgagctctcaccatcggggcttctctggactcggtgcttcggcagccccccttttttaactccaggtgttccttggggcatctcatgtcatctccagcattaaaccacgtctctgatgattcctgaggctgtttcctggagttctctcctaaactccaggctcaacagcccagccatctacacagtccctccacgtggtggcctcagagctactgcaagcttccatgatcacagctgaattgctggtggcctgccctgccccaaacctgtagctctgtcctcttctccatgggaatggaagctctttgctctcattgctcaagcccaaaagcccgggggtcatcctcagctgctccttctctgtcatacactgcgtcctattcgtcagcaaaatccatctagaatctgcccgcttctcgctgttgccactgccacctcctgagctagggcaccttcatcttttggtctctcacctaaatcattgccatagtctcccagctggtctccctgctttcacccctgctctgacagtctcttccagcacaacagctagggcggtcctgtccaggcataagtcacagcacgcctctaccctgctcagagcctccatggcacccatcttacccgagtcaaagccccgtccttcagtggcccttgggccttgtgcagtcactgtgtcacccccaacatccccacctctgccctcgccctgcccagctgcccgttggtctgctcctgcctcctgccgtggcagtgccatctctcctatgcagagccctaggcacccactgccctgtgggtcatctcttcaggccttcaggtttctgtcactcagttcccctggccctccctgacggccccaccgaggacaagagccacctccacccccagcaagatcgccctccttgcctgctttgcttttccccccagcacgaaccactgctggccacgctttgtgtttgcttgtttctgtttccttctattggaatctcagttccttgagaacagggcctggtttttcactgctgtacctcccgtgctttgaatggtttctggcacatagtgggtgcttagtaaatatgcgatgagtggagggactgccccacaggctgagtgaagtcagtgctgggccagagggcagcataggcaccatggggacccccgggtgggtgctgagccccaggcagtgagcccgtgtgctgcccctgcccagccttgcccaccctgcacaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctggtgaggcccggacagcctgctctgctcagagccgggagctccctccaggctgcgggtggtgggaaggatggggcagtgcctctggggcccagcagatggagccctgccctggcctagcaggagaacttgggagcagccagagtgcgaagagcaggcgagccagtcagccgcagcagcagaactgcttgcacgggggcttcagaaacctgggtggttagtggcccttaacactgaagagtgtaggggcggttcaggtgtaccttgcccacctctcagacagtgtcaccaggaccctgtttctctgtgcatctcccagctctccttccctgcactgggtttattggcaaggtggtggttgttactgcagtctgtatccatctaggccccgggctggtgggagatggggcccttcccttgtagctcaggcaggagtcccgcagtgagctgcactggctcttgattggccggcttgagtgctgagcccacccctcagccagtcactggctggtggacgggcaggcaggaagaaccacttgtggctcaggcctgggtgtcctcctctccaggccatggcaggggccagctttatgtaaatgaagcccctgagccaggtgcaagaatgggtgtctgtcatggaaccctgctacccctctcacacacacaggaagagatgagggcagggccaccaggagaaaggggaatgggggaagcagaaatcaagtaggagctggcgcttctgcccatcgacagttccccacagagatcccctctgggcagccagccgtttttgagaaggtgagcctctcacacaggttcaaggccccgtgagaacgggagagggcccgggacgcgctgcttcctgccgcccgcactgcagaagtgcaggagcctgcaagcacccggggcttattcagaggcgctgggggagaggggcactcccgagcggtaggagaccaaaggcccccccccccgggaagatgggccgagtgacgctgcttgtctctgtgtcagtgcaatgggatgtccaaccgcttctggggctggggccgcgaggacgacgagttctaccggcgcattaagggagctgggctccaggtgagattccccgggccccgccgccacctcagctgcggtggctgccctgagattttcttctgtttcctcagatgaagctcctggggtctggagatggccctgattctgatccctgccctaaccctgccctgcatggtcatctagccagttccttgccctgtgggccccagtctcctctcctgcaggctgggagtgcaggtcccttcctgtgggacctcgggagctggtggtgagggctggggctccaggaagggcagcctgaccccgacttccttggacctccctagcttttccgcccctcgggaatcacaactgggtacaagacatttcgccacctgcacgacccagcctggcggaagagggaccagaagcgcatcgcagctcaaaaacaggtgctggcagggctcctcattggggacggataggtggtcatgtggggagccagcaggcccgggctttcaccaagttctccttggcccaaatggtcccatcctcccctgcttggcccaggtcagtcgacgggcattctgcttgggcaccgtgccctgctctggtggctgctgtgggcaccctgggcactgtgggtcagcccagacctcagggtccatgcaggctggcagggtggggtggcggaggcgtagctgaaggtgccagaatcccagccacacccgggatgcagggatcccaccctcaaacagccccttctctaggaggcttatgcatccaactggagatcccggctcgcctgcttcctagtggggcacagccctgggcaagaggcttcactgctttgagctctgggttcttcctctccagtggggaccacaggacctctgatggcgaggttgtgtggggtcagtgggtagctggcacccatgcagccctgagtccgtgctctttcctctcttcctccccaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaatgtgtcgtggaccgctcacatgtcacttttggctgaggggcaaggggaggggtgagttacaagctggcaaggaattggggtggggcggggacgacaagtccagggggaggagaagccaaaggtgtgagggttcctgtactacctccaccccaccaaggcttctgggcagcccccgaatgcccttctgagcagtcttaccaccttcaggctctctctgggtaagcttcctccggcctcactgagacacggaggagggagagcggctgaggagattcacccacaggactggagagaggcaggcagggcactcagccggtgcctcgggtcatggcttgagtggggaggagaaggggagaagtgggaggatccctgtggtgttccctcagcacagagggattacagtggtcaccgaatgcccaggagcagtgagaagacatgaactggggagtgctcttgggggaatcacttggagggaagcccagagcccatgagagtgggaggcaagggaccctgcatgtaggccactccaaggcatttggctgccaaagatgcaaggcagaaggcagaggagaccatcaggccccagtaatgtgggtttgttttaacaccaggacacctggagtcctgaaggaagggattcctgagcaccatcccagagctcaggaaggtggaatccacagctctggttcaaaagacttctctgaggatgatcagggctgctgtgtgcagttgtgtgggttgcgcactgtgtaacctgtgtataagccgagggatttaagcagaaagggctggggtaaagcttcaggttcaggtgtttagtccagggtctttgtgatcctaaattgaccttccccatcgattcagccacacccactattgtgatgggcagacaggcctcgactctagtgcaggggtggtggagaggggactgtgccagttccctggacaatcccagctgcttcatcttggactgacatggacaccaggcagtaacaccagctcttgggagttggtgggaacaggtgtaatatcaaagctcccagctctgcactctcctgtcacataggaagacctcagaaaatggaggttccttcctttccacctgcactgggggagtgcaatgagcagaagaaaagcgaaggtccctccaccttctgagatcagctgacacctgagcttaggtgcatccctagccctgcagcctgttgcttcccttgaccgccacccccacctccatcttcaaggctgtgctgggcactccaggctgggcctgacgcgttccaaatctgcagctcccctcactctgcatcctgggcctccaccactctccaggagagtgggagacgcctgagccatgggtggcgagaagcggcagtcctgtgccgcctcagtgccccacttgcctccttcgtggaatggacttgacatccctgcctcgctggccagggcgtggccgaaacctacccaggatgtaggagcacctggcacagcgcttggccagtgaggcggtggttgcaataataataaccatcccttgttgaacattcaccagataaccaaattctccacaccgcatttcacttaggcctccctacctaagagctgggtcctaattcactggttctgtacatcaggaaggcaaagcacagacaggcaagtagcttgcccaaggtcgcagagctgtaagggatggggggctgggattgggaacccctggaatccactttcagagccaggtttcttcccctttgccctgtacagcaggtgcccatgagcaggtgttccttccctacaggcctccctcctctcccctgctggaaagggcagatggggagggctgagaggaaaacaggggcatggtggagatgcagaggatctgcctcaggctccgctgcctcgaggaagacagggattctgctgctgggtgctgaggagcgccgatggggcattagtgggacccagagtgtggcactgtaaatgaga

SEQ ID NO: 16773 - DNA, 23901 bp, Human
tccagactttgccgctccaccagctgtgtgcctccgggcaagacacaacccttctttgagccttggtttccccatctgtcaaataatagcagctgggcacagtggcttacacctgtaatcccagcactttggaaggccgagatgggtggatcacctgaggtcaggagttcaagaccagcctggccaacatggtgaaacctcatctctactaaaaatacaaaaattagccaggcgtggtggcgggcgcctgtaatcccagctactcaggaggctgtggcaggagaattgcttgaacccaggaggtggaggttgtggtgcgctgagattgcgccactgcactccagcctgggtgacagagtgagactccgtctcaaaaaaataataatagcaaccacaagctgcaaagatcacagtgttccgaagctggggtgcaaggctgtgcggggggaggccatggggaccgggaagtaaatgtcttcgtgccaggcaggagaggccattagcacccttggagggggcagagcccatggcagggggctgagtgggtaactggagaggcagcaggcaagggaggggtttttcccagctcagaatggcttgagctcatttggatcagcagggagagaggcggtggagggcgaggaactgttttgccagagtacagaggcaggccctcatgattctgccactgcctcctcagtgcagggccccacatggccttggtacacacataaggtacacacaccatcctcagactctccaggtggccctgccacaggaagggagctgaggccctgggctaaagggctggccacaggtcgccctttgaacttgagactgcctaaatccaaagctgaccctgagactggaagaagaacccctcccaacggaggccttaaaggaaggaggggaggggaccagggttccgggggtcatggtggaacaagaacaagctcgctgactgacagcctgggggaactcaggacaccagcaccagccacttgggagattgtgcggggggagccacttctgagccagtgaggaccccaggaccagcctgggccctcccgctcaggtttttggagtactggaagatcaactgagatttcacccaagtttcttgccactgacaaaatgaccactacttgggtacgaggcagattaggtaggcctctcagctgcaattcaagctagtgtaagcaaaaacggggataattgaactgaaaaagtgaatggcttcagacctggctggatccaggtacccatggcggctaccgggaccctctctcatgctctccacctctcggctctgctgtcctcaatgctggcttcattctcagaaggctctccccactgttggcaaggatggcccccagcagctccaggcccatacctggccagctcagcagccccagcggacagagggagcctttcttttcttttttcttttattttttatttatttatttattttgagatggcgtctcgccctgtggcccaggctggagtgcagtggtgtgatctcagcccactgcaacctccgcctcccggattcaagcgtttctcctgcctcagcctcctgagtagctgggactacaagcatgcaacaccaggcccagctaatttttgtatttttagtagagacagggtttcaccatgttggccaggatgatcttgagctcttgacctcgtgatctgctcgcctcggcctcccaaagtgctgggattgcaggcgtgagccaccgctcccggcaagggaggctttcttaatggcgccagcgaaagtccgagggccaacgcccattggactaacttgggtcatgtgtctgtctctgaagtagtcactgggtctgacccttcctggcttggacgacatactcctgtttagagctgaaagtggaaagtctgccagaaaacgggaggcggagcaggcctggcagggaggtccatggcacttcctcccctcatgcccagggccccgcccccgactccactcccagacctcagagctggagcatctgcaacttctgatcagactccagcccacctcacccctgcatgcagaaataggggtgctacaaggggaagcggggagggtgtgtggggtaccgaaatgacctgggacagacctgggttcccattcagactttgtgtctgaatgggacacaaagctgtgtgtctccgggcaagtcactgactctctctgggcctcagtattcccatctgtaaactaataataacaatcaacacattgacagcacctactatgtcctggtctcattttaagcacttcctagatactttttgaaaatcctcaaactgaccctaggaggtaggtaccatcactatcacccccatattacagttgaagatgagtgattcaagataggtcaggcaccaagctcaaggtcacaccattagcaatagactcctcaggagcagagctaatgtgaatgaacgtggctggcccggcgccgggggcagatacctgggaacagccatgagctttgtgatgatcaaggggcaatctgtgtgtgtgcttggtgggatcttgcagaggttggaagaggccagagaagactccaccagctcttgctgaaaaagtcttgcagcctcccctcagccctaaaaccttcccggagaggtgtgggggagcacagaacaggaaggtgggggtggagggaggagggtggggctgtgaggagggagggagggagggggttctccttctaagcctccatccagtcccattttattctcacaacaggttatcaaaaggaaactcagagaggggaagtgtttcagccaaggtcacacagcaaaggcccagtttctggatctcagtcctcccttgtctcatcttttccactctggggatccagaagtcattggcccagcctcccgctgtgtgtagggggagctcatgctctgggggtgggagagaccgacctgtcagtgacttgaagggtgatcggtttgggggtggcagacacgaagtcctggtaggaggaacccaccagcctcccacccaccaaggctgagtgtgtgggcttcaggggcaacagcagctgaaaggaggcaggttctcagaggacagtgaccagtggccacccactcccaccagtcagggcaactgagaactatgggtccactgagtttggcaagttaggggttactggtgaccttggccagagcagtgccagagaaaatgcggggaggaggagacagaggacagatgtctgtctgcatcctatagaaatgaggggatgaagataacctggaagggtgacgggtgcggagaccaggggagtgggctctagggcatgccagcagggaacacccttgcttccctgaaaatagggaaaactgagtgcagggtgtatgggaactctctatactatctttgtaacttttctgtaaatctaacactgttctaaaatagaaagtttatttaaaaatgttgatggcaagaggtgagagtgggcgtggctggagagtttgtaggtggctggtggggaggcaggaatttgaggaaggaagagcttagatgcatttagggcttctgttttttggatgcaaaattgagtgtgcaggaggctggggggtgaggggagcggggggggcgaggagctgtgagctaggacaaatcaaaggaagctggaagaggctgaggccacagatgctcatggccagccatctgctgcccctccccggctgcagggtctccctcctcaccagaatcaggctcttcatgcctaagggtgggggatggctgaagctctgtccctccatggctctccccacttcccttccccaccatgtgtcacccactcccttagggatccccatggcaggccaaccacacctactggccagttggtctagggcacagggcctggctgtgtccctgcctgggtgcctcactctagtggtggccatggagaaattgccatggcctgtggtccctagacatagtgggcactgacttcccaaggcaggggcctgtgagtattttgagttttaagagggttctcccaactccaaagcgccaggaacactgccacataggcagccctgctctccttctcttggcatagccaattacccaacgcagaactcggaggcctggctagaaccacctcctcctccgcggtgcggttgggaccaggtgaagtttgctcagggaggtcgaggttggaggctttgtagtggtggaaaaggcttctaagcgctgtggacggtttcagggtcccaacctagcaaggaacggagttctggaaggccctggcatggtgtccactcccttgcagggggtacttttctgaggccccctcccgttctgtgcttagagctttaggagataaaggtgccaagaggctggccctgagcgtccttggaggagccctgccgtgggagtctggggttagatgctgcttccggaactctacttgggactcctctgggaggcgtgaggcttgagagagaatgcaaaggatctcctagctggccccatctgagagggcacaggcgtggaggggaggagaggcctggaatggagggataatgagctgggtaggggctgagaatggcctggaataagtggtcatggagccgagatggggggctgtggttgggaattgggaactgggatcaggatgagactgggatgggttggactgaagatgtgccgtgacacatgttgggggggacacgtgctaagcatggggctgaagctgggatgggaaagcaactggggtggatttgagggtgggatgcagatgacagtggatatgatgggatagactaggcaaggacctctcagggaaaggagacgggccaggggtggggtgttgtgtgagctgggttgggatgaaaatgggtttaacttgaggtgggacgcaccaggaatggagatcaatgaagcaatgggtggggcggaaccggattgggacggggggtgggcggggggaggtggggacgggactgggtttcgggggcttggaagggaggggctagcgccgaggttacggacggggcaggtgagggttcgggacgtgggtggggctggccctggagcggcgccaggggcggtgggtgaggggccccggggcaggccgggaagggggggcgggctcccctgggccgggccggggcgcgctaggaccgagcgagcggagggagcgagccgggcggagccagcgccccccgcccccgccggcggctcccctcccccggccgctgcgtcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcgccaccgcctggagctgctggcggcttacgaggaggtgatccgagaggagagcgcggccgactggtgagccccccgcccccgcccccggcccctttgtccccgcgccgccgccgcgcctttgtttctctcccgccccgccgccccgccgccgggaagggagggggaccccgaaatggtgcagcgggccgggagggccgggaggggctgcctttgtgcgcgccgggggaggggccggcgggccaggcggggcactgcgggccccgagcgcccggaggcggcccaaggcgcgcggtgggagcggcggccggacgcggcccggaggcgcggggtcccgatgtggggcccgggccgcgtggcctgcgggagcccatcccccaccctaccccccgggcccgggggacaggtgtgcacggggcggccaagggcaccttcgccaccttcgagcgggcgaggtccgggcggggacggggcggggaccgagctagcggagccagcgcacctgcccggctcagcccggcccggccacagcacaaaggaaagcgagggcgggggaggagcggagcgggctgggggccgggcgccccgcccaccggggggcctctcggagtgggccgccctccccccgaaacctgggctggagtgaggtggaaggatgtttgctgccacatggcgaccgcgaagtgactcccttaccgccgcgggtcgcggaggaggcaggggtgagctctcctcccctacctgaaggggactgcggggactaggcagctgggctggggggcaccgagctgcctaaggggccagctgagatccctgggaggaagccctctggagaacaagtgtggagggagcccccaaagacggctgaaggggtgaacagatccaccggcccccagcaaggggcactcggtccctgatgggggaggagctgggccgcccctcaccccgccccccagctgttgtctcccgctgagctgggggaggggatggaccacctgctctggggctggcggcccagggtggtggaaaaaggaaaccgaggggttcctcacagccccatcctggaatcctttaacccccccgtaatactcttcttctagggaaggtgcccatctggttcctaggcctcctctccctgctggcagatgggaacaggttcttcttgaggaaactgaggcaaagaggagggcaggtctgagggaccccgcttgggctggcctcacccgcacactgggagggcagccaggtggggactctgacctgggggcttctggaggagaggatgagatggctgggcatccatggcatggtactgcagcactggccagcagccaggcctggagggatggacgcgagagacaagctctcgtgtcctgcaggtcagtcacaggagaggccggcacaggctcagcaggcaggcggcccacccattgtcccagccctgccccaggggggctgagatcatgggaggagctctgggcaagtggccggcttggcctggtgaaggagctggctttgggataaggccccgcctggggagaagcacagctcaccccagaacacctcctttgccctccagcctggaggggtgttgtctaccaacaccccattttctcctaaaagcagagctctggtggcctattgccaaggccacacaacccctgttgccccacatcctgctcaacacaggcctgcccccacccaccccagcagcatccgtgtggccaaagcgagttattcatcactggtgtgcgtcagcccccatctgggttgtgtgtgggacacacacagatgcacacatgtaccctcgcacatgcacacattcgttcactaagggcccagataacattttgaaaaaggggtgtgaggatcactttctgcacaagagaatatgaataccccagggcccagcatggaaccaggggtgcagtgaggtctgaagactcagaggcagaccctgcacataggtccagagggaggggtgtcttgggtaaattgctgtctgccccccgacccttaccttgcctccaatggggaggggtggttgggggagttcactcctaggtggcagggcctctgaagtgcaccactactctggcacagggagcaggggacccaggaaatgaggttgtatggtgggaagggccactgttgtcctggttgtgatatgactcactgtgatcatacacaagttcctggtcctcttggaaagaaaagggattgggcccagcactacctcggatactgaaggcctttctagcaccaccatcctgagagtgatggtcctgcggggtccacctgccctcagcccccgactccagctcaccctccaccccagctcaccccccatcccagctcaccccagggtctctggaactgccacattccagctcccacctcacgctagttcagtttatctggctagatggcttttgagttggtgtcaatatcacacatacttctggtatgcggtgtgctggaccccaggacccagagagcaggatgtgctgattgactgagtcagcgttcctgccttcaccaggcttacagttgggggcagtgtctgtctccaggagttggagctggtgagatgtgtagatgcctggtcgcctaccccatcctgattccctgtggtttcgccagcttccacctggtgcaccaccaggctcggggtgcctctgatgtggttgagaagcactggtctttgtattcctgctgggatatggtgggtgctctgggaggggcagctcaggagaggctgctgggggccagcactgggctctgaagaacggaagcattccactgggaataggcgtggggtagaggagcaggtcttgccttccacgtgaagagaactacataggcagaggcttcagggtgagccctgtccagaaccctgcttgggtcagggagccgtccagtgtgtcccaagtgtgtggtgtggacagggtggtccaatggaaaggcaggctggagggtttgaactggggtatggtttctgctgggggagagctgcggctggagcaggaagaggtggccggaggtggggagccaggggctgaggatggaaggcaccccggggagcctaggcaggccaagacaggtcctctcagagggaggcttgatgtctacagcagtctctaggaactagggtccctgggctctgcattagtttctcatcagtgcatggagagagacagagcctgcttctcccagggccctttgttcccgtggtgggttagggcagcaggacaggtggtgggccagctgtgctggaagcatctgtcagggccaggctggggctgggggtaacagttggaccaggagctcccagccccacagcccacctgtgttccttcctggaggtaggaagccgggaatccaggaaggggaggggctgaggccatttggccctggccacaacctcctgagacgtcccctccatccctcccgccttcatttcctttgtcccttcacttctgtcctttctcttcttcctcctctcctggtttctccctctgcttctcccctcctctttctcttctcccttgccctccctttctgcctcccctcctcacagccccagcctcctgccttggcacctggggaataggagtttggagaaggggttgagagccctttcaaacttcagggacaaggcccttcctcctaggccccggctctcctccctcccagagggtcctcagcctgggcctgcatggggtgatggaggaggcatctctgccttcccttctgtgcaatggttgctctgtcaccgcagcctatcaaaaggagccagggcacacaaagctagggaggaggaggaaggaggaaggccaccaggtcagctttctgttagagctcagacagaaggaaaggccagcagtctcaggaagcctcagccaggactgaggcagcctaggggctggaaggcctggagctcaggcttggccaccccggggccagagtctgggcgagagtgactgcagtgacctcatccccatttcagagaggcggagattgaggctgagggcgggtccccagggtcctttgtgttcaaggagaatgcagttggggtgggccagtcgtgtgccaattgcagggttgccatggttactgggggatgcccagagctgttgggagcaccaggttctctcttctcctcctccctccccgggggaggggcagcggggaccaaggcacgtgccaggtaagttcctggcactagccaatgggggatgaggatcctggtagccagggaacggtaaccaaggaaccgtcgccttggaatctccatcacacacccgctccactgggttgtaggctgccagggccagggccgggatgctgcgcactgagctcgaccagccagcaatttctcccctcactgcctgcgcccccctgacccaggcctccagcagtaccctgctgggctcccgcctgaaccgatgcctggccctgttgtcatggctacagcaggagccctccccgttcctgtcctacccactccatgtccctctccctccccagagccgtccccacccagaattggcggcctgggccctgacagtttgacagccacccctccctctccccagggctctgtacacatatgaagatggctccgatgacctcaagcttgcagcatcaggaggtaggaattccagccattccctcgccttcttctccaccccctcctcctggttgttttcttccccacccacctggctgtaggccacctccctgcctgcaccctgcagccccacacttgtctggatctggcgggtgtccttcctccagtcatccctgtgtccccagggtggggaggaatctcagagccttgttgaatgttggacttctgaggctgagcctccaacagggaaagtgacttatctgaagccacacagctgggacactttgggggaagggccctattcaccgccttccccagagccagaaggcttgattgtgcctctgggcactggcacctggtgagacatgatgatgtgtgaagaatgagacctgagtgtgaagaacaaacacttcctcagtcctacccccaaatcaggccctgcaggagtcacaggcaaagctacatccctgtgcgccaccacccccacacataccaacacaaaactgggacccacagaccccagaggccagaagacccctgggggtgcctgtggaggcctggaggagtctttgctttgagttccaggctctttttgggaagggtttaggaggcagagagacctgacactctcctgattaccctagaagggggcttgcaggagctttcgggacactttgagaaccagaaggtgatgtacggcttctgcagtgtcaaggactcccaagctgctctgccaaaatacgtgctcatcaactgggtatgcggccggggctggggaagggggctgagggcccagagctgctcatcaactgggtatgcggccggggctggggaagggaactgaaggcccagagcagtcgccctccccgtcggccctctgacacccgtggagagggaagcccaccctcttcccaccccggggaagatgcaccctatcgtgtagggccccccttgtcctttcctgaccccctctttgctgggtactttgcaggtgggcgaagatgtgcctgatgcccgcaagtgcgcttgtgccagccacgtggctaaggtggcggagttcttccaggtgcgtgtcaggggccagcgctcttgggggtggggacagccaccagggtctgcgtgctggggtggggatggcgggaggatggtgccgcctgagcactgccgtcttcttgcggaagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtggttagtgtgtgtttggcacccgtgggctctgcctgcgtggcctggtgcccgagtctggcctgcccggtccctcttagctctcaccctttaggtgtcgggggttcctggggcattcagcctgcttatgctgggtccttcgacactgcagggcaccacctaccagaagacggatgcagctgtggaaatgaagcggattaaccgagagcagttctgggagcaggccaaggtatggaaccctgagcccggcctggctgagccacccctcatggaccccatggggcaggtctgagtccctcactgcagtggcatggcccatgccacgtgccccgcccccagcgctgggttagggaggggctggaggggcagggtccaggcgcctaggctcggggcctacccttgttcgcaccggggcttgcagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggtgagcctgcccgcccggagcgctccaggggcccccgggcgcaccctgacgggtgctggctgcttatcgttccaggaggaaacagcagactttagaagcggaagaggccaagaggcggttgaaggagcagtctatctttgtaagttctttgccaaggctcccggtctctgggtcagggaagtgagaatggtccctgtgttcctgggccttgtggggagatcagtggctcagggacagtggtggctgttctggggagctgcatgggcacagggtgccatggagcatgaggcctggcacctcatcacgtggggctctggcctctggccgtggaaaaagactactttggagaagcttgtgctctagattggaagagaaactccatctagacccagaccctcactgaccaggctccccctcccctgccctggggtttctcggcgattagacactgttctgcactctgaggggccacaggagtgaggcaggcggcatgggtgagcctgggccagtgctgagcatctgcaggcagtgtgtaccatctccttgggagcagcatctccctgggagcagcccctttgttccaggggtactgtctgaatctccacacattgggaatggcccgtaggtcctgtggattggtccctgagaatcacagcagagtcacatctccatgctttgaatttagtattttggaaatagctaatgtcattcaggactgagcatggctcagttcaggaagggaggtgggttgatactcatctggattgggactgtaatgggcagatgcatggctgtggggactcaaacgggctccggagtcacccacaggaggctgagagagaggaggcaagacagtcctgcaggcagcagcattaagtcactccagtcacatctgcccttggatggggtggggatgatgtgtggctggtaagctccatcctcagtcattcattcaacacacacctgccacctgccacataaagaacatggtggagaacgagctgggtaagatctttttttcataagttgattcatgtattttttttttttttttttgagatggagtctcactctgtcgcccagggtagaatgcaatggcgtgatcttggctcactgcaacctccatctcccaggttcaagcgattctcctgcctcagcctcctgagtagctgggattacaggcgcacaccatcatgcctagctaatttttgtgtttttgtagagactgggtttcaccatgttggccaggatggtcttgaactcctgacctcggttgatctgcccgcctcggcctcccaaagtgctgggattatagacgtgagccaccgcgcctggccacatgtatgtaactgtggcaaaatacataaaatgtaccatttcagtcattttaaaatctgcatttcattaagcggcattaaattcattcacattgtaggataaccaccaccaccatccattaaacacaaattctgcccttccccactcgccagctcctggcaacgaccattccactttctgtctctatgaagttgactactctggagactgcctatcagtggaatcgcacggtgtttgtccttttgcgtgtggcttatttcacttagcatgatgtccttaagattcatccatgttgtagcatgcatcagaatttccttctttttgaaggctgaatcatattccattgtatggatataccacattttatttatcctttcagagtgaggttttttaaaatttttttattttttaaatttttttgagacggaatctcgctctgtcgcccaggccggagtgcagtggcgccatctcagctcactgccagctccgcctcccaggttcacaccattctcctgcctcagcctccaagtagctgggactacaggtgcccgccaccacgtccggctaattttttgtatttttagtagagacggggtttcaccatgttagccagggtggtctcgatctcctgacctcatgatctgcccacctcagccacccaaagtgctgggattacaggcgtgagccactgcacccggcctgcctcccaggtttaagtgattttcctgcctcagcctcccaagtagctgggattacaggcgcccaccaccacgcctggctaatttttgtatttttagtagagatggggtttcaccatgttggccaagctgatcttgaactcctgacctcaggtgatccacccgccggcctcacaaagtgccgggattacaggcatgagccaccgcacccagcagataaagtttattatttatttatttatttatttatttatttatttatttattgtctttttagtagagatggggtttcaccatgttggccaggatggtctcgatctcttaacctcatgatctgccctcctcggcctcccaaagtgctggaattacaggtgtgagccacctcacccagccaagtttatttatttatttatttttatttttttgagacagagtcttgctctgtcgcccaggctggagtgcaatggcacaatctcagctcactgcaacctctgcctcctgggttcaagcgattctcttgcctcagcctcctgagtagctgggattacaggcgtgcaccaccatgcccagctaatttttgtatttttagtagagacagggtttcaccgtgttggtcaggctggtctcgaactcctgacctcgtgatccacctgtctcggcctcccaaagtcctggaattacaggcgtgagccaccgcaccctgcctgataaagtttatttatttatttatttatttttatttatttatcttttttaagatgaagtctcactcttgtcccccaggctagagtgcaatggcgccatctcagctcactgcaacctctgcctcctgggttcaagcgattctcctgcctcagcctcccaagtagctgggattacaggtgcacggctccatgcccggctaatgtttgtatttttagtagagacagggtttcaccatgttggccaggctggtctcaaactcctgacctcaggtgatcctcccacctcggcctcccaaagtgcactgcacccagccctgataaagtttatttttttgctaacatttcaaacatacacacatgcaggtagacagaatagtgttgtgaaccccctgagctgatttattttcaccagttatcaacatttcaggtaaagtctgaaggagcttaccattattttatagtcccatctggcccttcaagtatagttcacgtgagagtgacagtggacattctagcaggtcagtgcggtaccctttcaatttcaggtcctctaaggaagggaatatgcgagagactttgggatttagcactgtgaaatgctttctcttggcttaaggagctgttgctttctctcccctgttacgaattgtgttccatatctgagttccctttttgcctggcctgcaggggagctcccgtgtatctgaaaatgctttaggcacagcagtggctttgacccatgtggttagtgtgttgatctctctcctccctctgggccttacttgtttcagtgttcacatggttggtagtttattaaagcctttgtggagggctgggctcagtggctcatgcctgtaatcccagcactttgggaggccaaggcaggcggatcatgaggtcaggagatcgagaccatcctggctaacatggtgaaaccccgtctctactaaaaaatacaagaaattagccgagcgtggtggcgggcgcctgtagtcccagctactcgggaggctgaggcaggagaatggcgtgaacccgggaggcggagcttgcagtgagccgagatctcgccactgcactccagcctgagtgaaagactccgtctcagattaaaaaaaaaaaagcctttgtggtagttgcctctggtcctttctttgaacaaggcagaggaaccaactgagattacagcaggcagtgggcagagcagcaaaggctggtgggacacaggctcatgggaaggtgaagagcctaggctgactggaaccccgtgggctgaggagtgggggagatttgattgggaaaggagagcaagggcagaggaggagtttagacttcattctgggggtcacaaagttatcactgaggtgatagccctcctgaggtgggatactacgaagggcccttctcccagtgctcctgacataagctaaaattttagattataggctcaaaaacagagcagccctgggacttcaccaccttagcagcccctcctgcccaagctgccacctgagcagcaggggacaccgactaagaagcctttggtgtgtgagtgcagttgagcaaacatgcgcccgccttgtgctggccacccacccggagaccccggtcctcatcctgcgttgctcacagcggaggggggaggtgcctccggaaacaggaacttaggatgtggtgtcatcgtggtggaagccaggagcaccctgtggggacccagaggaggaaatgacctgaacaagcctcttgttcagaggtccttccccaggaagcagtggccacgctgcagctggaaaccagagggcctggcccccgggtggggagcaggcatttgggagggaggccagtctcccatgctgaggcttggaggtgggaacgggtgtgcctgttctgggaactgactgcgtcgtgctgaggacttgatgtctacatctcacagtatgtgggagccttggggtgggggccggcagggggtggtgttggagaggtgacggctaggtcaggcaggggtgggggacgtaggccaagtgcgggcgctgcccacccaaaacaacgtgtgcagtgggcaggtgaagccagtaggcgatggtggggccgggggtgagcgggtggcacacgcctgtcttaagggggctgcggcgaggccccggtgatggctgctccgggcttgcaggtgatgtcgccagggctctgtcacctcaagagaaactgggaccctcatctcagtatgaaagttcctggtttttaagtggtggtaactaatgaacatggtttaaaaatatcataccagcaaaacaaaagccatctgtgggtcatatttagccagtgcttgctgtggctcatgggaacccctgagggattttaagctcaggaaaatcatggtctgatccgcattttggaaaggtcctttcagggcctatggagagcaaataaggcaggtagcagtgaggaaggctggaccatgatgccacggtccaggcagcaacattgggagcatggtggccccggcactagggtaggaggtccaagaagttatctgcaaaacaaggagcacttctggagggccctaggcacctgcttagatatggggatgagcaagtgagtgagtgagcctggtgcccagaggcctggcaggtcagagatgaggtggctgagggccctgagggaagagaggggctgtgtgacagggtttgacggggcagaggtaccacctctgaaacccttcctgccagattgcgaaagaagcatgggggctgtaagaaggccagaaggggccgggcgcggtggctcacgcctgtaatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaaggccagaaggccgggcactggtggctcatgactgtaatccatcccaacactttgggaggccaaggcaggaggatcccttcagcccagaagtttgagaccagcctgggcaacatagggagaccccatctctaccaaaaaattaaaattagccgggcatggtggtgcacacctgtagtcccagctactcgggaggctgaggtgggaggattgcttgagcccaggaggcagaggctgcagtgagccgtgattgtaccactgctccccagcctgggtggtagggcgagaacctgtcttaaaaacaaaatcaataaataaaatacagtaaaaaagaaggccaaaagcccctgtggggggtaggtgcaccagacactgtccctttggtttctagggtgaccatcgggatgaggaggaagagacccacatgaagaagtcagagtcggaggtggaggtgagagctgggggcaccagccaggtgaggcagacagggctatctcagcttgcctggcccagccccaaccttttcctcgtgccctcaggaggcagcagctattattgcccagcggcctgacaacccaagggagttcttcaagcagcaggaaagagtcgcatcggcctctgcgggcagctgtgatgtaccctcgcccttcaaccatcgaccaggtagtcctaggccccaccccccgtccggccccactcctcaggttgcggccctgagcctctctgggactctctcagaagggaggccttgcccaagcaacccttggagaaggcgagacccttcatccagcgtgcatccgcccaccacttcccaggtggcaggaccccaagaagggccagggatggtggtgaagtcgcttgtggctgaacagtggggagtgctagggcctgtggggcagctctggcatgggctgaggcacagcgctggccacggggagcagctcggctggggtgaattaggtctggcctggaaggccggaatgcatgcgggctgggctcttgccccgggcctgagggagcctcccggagcttgcacccaggtgtccccgttccgcttctcagtgtgctgcttccgcctctcctgaagctcttccctgccctgtctgctggtctgagtgtgcttgccccatgctggggtcccgccacaggccgtccctgctgtactgctcccaggctggctgtgtgtctggggctggtgtgaggctgcggctggcttggctgattgtgcccctggctgaaggcagcttggacatccagggccaggccctgggggcgggagaggcctcgggcaggggtgggggagactgaccctctcttgtcctctgtctctttctctgtctgtctctctcggcaggtcgtccgtactgccctttcataaaggcatcggacagtgggccttcctcctcctcctcttcctcctcctcccctccacggactccctttccctatatcacctgccaccgcaccccaaacctctcttcctccctcccatgtaggtagcagccccaggcctcggcgggggtggtaaggagggccccgcttcccagcagccccccaccctcactcccccagtctgaccgctgatctctggtgtttgcccccagggcaggcactgcctgcctcttgcccctggccttatggggcactggcctccaggggcctagcttacagggtctggagctgtagtctggcccctggtggggctggagagctcccagcccccacccagattccagagaggaggtgctggccaggccccaaggtggacaatcctgtctcacccggctcccccgccctcactgacccacctggggtttgttccacaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaaggtgagagagggatgctacctgcaccaggcctcccatcatcagtccctggctgggagccccaggttgccatggtaaccgttctccagggatctgggccacccatcaccaagactgcactgccctggaggcggctgtgtggggaggagccctggtgtacagtcagacctgccctctctaaagcttagcacccgccctctcaagtgggaatcgggccttggccttcctcccggagctgccaaggggcttaaagtcactggggtcactgggtaagggggcagtgggacacctgcatggaagtccctggctccctcactccttagtgggtgggcagggtctccatcctccccgaggggagccggttacatatctcctctgcctgtgctgtgacagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggagatccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggtgcggcagggactgcctggtgggagggatgggagggagtgggggctgagcagggtgctggccctgcattcctcatgcttgcaccagtacccccttctctgtgacccacattatttgaggggaagtccatcccaccctccctccctgggccggctctgcttttgttcccaaggcaggcatccttgtttccctggcaaccactgatggaatcattggttgctggggaaacgggctcaggcctgataggtcagccccagtcctgctgggtggggccaagtgacctgatgctttcccctgcaggccagtgaggggtacttcagtcaatcacaggaggaggagtttgcccaatcggaagagctctgtgccaaggctccgcctcctgtgttctacaacaagcctccaggtagtactgggctggatgatggggaggaatttgggtgcgggggctggatttgagtgtgggtagccaccccaccactacccaccgctcacagaggctggggacacaagcggtctgctaggtccctaactcctctccctttctaacgccacagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgggaccccctccccgcccttcttttgaccccttcctgtctggcccaaaggaagtagcaggcccagctggggcccctcggctaccccccgtctcctgccgggcaggtcccaggttggaggccctaggcgcggttcaggtcagggctatggatggggcccaggggctttggtggcccctccccaactccttcctctttgcttgggttcctttttcacgtttagtaactgttttttttttttttttttttttggaaagcacaaacttctgtaacgggtcgtgctcatgtctgttaataaagaaatccagatcccttcgggctgccgcctgccctgacccaggttcccaactcctcccacctccgaggccgcagcacctccttgccaccagggggcgtcctcaccctaattccaaggcccgccaggcgggggcggggtgggggggcggtgctaggggctaaggctcccaggggaagccgcttggcacctacaaccaccggagaagggttggtcttagacttagtgctgtacccttaggttctgttgtggcggaaacgcacgttgagggtccttcccgccaaggccccggcttgtctggtcacacagaaccctgggcgaaagcagccggtgcaccctccgcttgtaccaaaccagatcacacacctttattatcctcaaaatgtaacaaacgggataagaaatccctccctccccccgcccctccccgcagtccagggaagcatttaaaaagccccgcagtcaggccaggagtccgccggtggggcccggggcgccgggcgcccctctatacggctgtagtcctcccgaacaaggggatggagaccggcagacgccaagctccgtgctccaggggctcgcggctgctgagctctgagtcggtccagctggggaagacccggcggccacggtcggcctgcaggcagagggctgggcagggcggcgcgggccgaggggcgctgggcaggtgcagcgccgaggtgtagccccggtccaggaagagcggcttgtagctgggaggcggctgctcctgcttctccgcgctgtcgcggcgactcaggaagggcgtgacgatcttgcggtagaggccgcgcgtgtccgtgagcacctcgctatagggcggcggcggctctgccatcagcaccgcctcttcgtaacacggtggtttggacatgtccgattccgctgcggagtgggaggcggtcggaggaggtgaggccgccggttcccagcctctcgcagaggccccggccaggggccgcccgcgccccagccctagcccgaacccgagcccgccgccgcccgtgttctcccggaggctgcggatggaagccctgagggtaagcagcgagccctccaacgcccgcccacttccggcggcccggatcgccccctggcggaggtcggtactcaccttggcgcgggtagctccagggccgtggcggcaccgacaggtgcgtaggcggcgggtgcgggagcgcgtggtggtgcgggtgtgggtgcgcgtgcgcgtgcggctgcgcgggcccgtggtgcagcagcgggtgcacgtgcacgtgcggatgcgagtgcgcgtgagccggcgcctccaggcggctacggtgtggtggtggctgcggcggcgccaggcccggggggctcccggccagactgccctcgagttcgaggggctccagctctagggcgcgcaggttctgctcgcgcagtcgctcctcctggcgccgtttgaggcggcggcgcaggaagctgcagaagcagcagagcaggacgatgagaccccagatgagccagaagccggcgaagcacgtgaggaacgtgtaggtgccctgggacatcaccatggcggcggcacgggcggcgggtcctcagacgcttcactggacactgggctccgctgcgtggccccgggcccgcgccacactctcaggtgccgccagcgtcactcggggacccgcggccgggggctgcccgtggcaggtctcaagtcgt

SEQ ID NO: 16774 - DNA, 17146 bp, Human
gcacctgtcctccccagcccctccgttcccatcggagttcaggcctcatcatctcctgcctggaccattagcctcttaactggcccctccgcttccaggctcccttccatatatccgggttccaccccgggggccattctaaaaggcagatcaggcccatcccagtctggccagcggctccacattcactcagactcacatcctggacccatggtcgggcattagagacctgccacgattcaacattccacggcctttccagcttaggtcctcatctcacactccctctcctctgagctccccctgggagacttacagacaccccgacgcttggcaaggccataggatgtttttgtttggtttggtttggtttttctgagacagtctcactctgtcacccaggctggagtgcagtggcacgatcttggctcactgcaacctccgaaggccataggatgtttgggtcattccctggggagtcctgtcaggccaggaacgaggggaccctgggaacaaggtgctgagtggcatcagggtctctgcctgcaggcgggggatgtgtctgggtcgtggttgatgggaagaacctgaccatagattccccatgcagagctgacgattagcaattaactgggaggaatctcaggggtgaggttaattgggggacagagggagggcagctagggttccagggactttgcccttgacccaagagtataaagaggagggtctcagttctcctcagggtcctggaggcttcattgagctgctgagcagaagctgaaacacagaattctaaggtgagcccaggaccctcacatcccaaccccacccccagctctgagtaggaaacagcccagcaccccagccccttcatctgtgtcctatctgcgcccacccccaccgcgccccatataacatgtcagtccagccaagcgcggtggctcccacctgtaatcccagcactttgggaagccgagtgggcggatcacctgaggtcgagtttgcactaaaaatacaaaaaattagccaggtgtggtggcaggcacctgtaatcccagctacttgggaggctgaggcaggagaatcgcttgaacccacgaggcagaggttgcagtgagccaagattgtgccactgcactccagcctgggcggtaagagtgaaactccatctcaaaaaaaaaaaaaaaaggactcctgctccttcaggacttgaattcaactcttcacacccctacaacagccaaggacgctgggacaatgcggggagtgctgaggcagatcagggcactccaccccaatagccaagactcctggggcagtgcggggacaagggggggctgaggcaagcctgtcagtgtttgttcattgccccttgagggggtggatggggaaaggaattcattgtgaggggaacccaggaactcgggatccggcccaggggatctccgtgtgtgcccagctgaccccatgagaaggcaggtgtctgcagctcctccttgctctccaggtgggcaaaactgaagcccggcccagccccagcccacacctgcagccactgccaacaccacgtattccctggccccctccagccccaaacaggctgggcgtcctcagttctcagtgtcttttatcaatgctatatccaagcctctggttcggagcctgggctagagctcaataatactcattgaatgagtgaatggtgaatgaatgatcacctcaccaccaccacacacacccctccgagactcacatgcaggtgcccagcacagatgtgcacatgtgagtctgcatgtgagtctcggagggctgtggtggtgatgatggagggtgtggtttgctgggtgtgtgtttgtgcgtgtgagtctcggaggggtgtgtgtgtgtggtgaggatggagggtgtgctttgctaggtgtgtatttggaatcatgcgccatgggggtttgtgcaggtgagggtgtgtgggcatgagtgtcccggacacagctattgtcattcagcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcagggtaagtgctgctcccacaccctggaccctggttgcccacggttgcccacatcccggatgaggccacttcccccgcctgttcctccccgcctccccactttggggccctggggctcctgaccaggctccctccctagtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccaggtgggcctgggctgggggtggcagaggcggcagcagtccctgccctggcctctgcccactatgctcatggcttcccccatccagagtccaggctggtccccaagctgcgccaggctggcgccatgctgctcaaggtgccactgatgctcaccttcctctacctcttcgtctgctccctggacatgctcagctcggccttccagctggctggaggtagggcccgggtggaggagacctgggaggggttcctgaagggccttggacaacgctggctcatgctccccagggaaggtggctggtgacatcttcaaggataacgccatcctgtccaacccggtggccgggctggtggtggggatcctggtgaccgtgctggtgcagagctccagcacctccacatccatcatcgtcagcatggtctcctctggctgtgagttggcccaccagggtggggaagagcttggaggggcaccccaggagctgggaagggtggcaaatggggagcgtgaccccagtaaggctggcctccattcagcttgactcctgtatcagccagggacatgagaggagcccaactgtagctgtatgtgacccagatgatttatggcaaggaactggcttccccgatggtagtttgtctgggcaagtcaggaatccgtaggccagggcattggaagggcaggcgggaactctcaggtgggcgccgacactgcagtccagacagggcagcgtttctcctttctcagggaagcctcagttctgcttgaggcctttcattctattggattaggctgacccaggttaccaaggataatctccttttcttaaagtcagctgactgtagacgtgaattgcatctacaaaacaccttacagaacacccaggctagtgttgggttgaataactgggtaccacagcctagctaagttgacacataaaactaaccatcactggccgggcgcagtggctcatgcctgtaatcccagcactttgggaggctgaggggggcagatcacgaggtcagtagatcgagaccaccctggctaacacggtgaaaccctgtctctactaaaaatacaaaaaaaaaaaacaacaaaaaccaaaaagcattagccaggcgtggtggcaggtgtctgcagtcccagctactcaggaggctgaggcaggagaatggcatgaacccaggaggcagagcttgcagtgagccgagatcatgccactgcactccagcctgggcgacagagcgagactctgtctcaaaacaaacaaacaaaaaaactaaccatcacactctggggcatgtgtgcacacacaagcacaaatctctatttgcacataggacatgagcccacgagccctcataacgaaggcctcacacgcacacacgttcacatccatacaccatgtgcagcacgtgtacatctactcgcatggatgaatgcacacacctgtaaacgcacagcccgtgcccacatgcacctgtgacgccaacgttaggcagactcagcagcatggcaggagcggccactggggactgggacgtgggtggggggcctgacaggagttgtggtggtgcaggagctgggtgaccgtcaaattcattaggacgtcttctcttctaccagtgctggaggtgagctctgccatccccatcatcatgggctccaacatcggcacctctgtcaccaacaccatcgtggccctgatgcaggcgggggacaggactgacttccggcggtgaggggggctgggggttgggggctcgtgcctgggggaggacagccccagatgccaggaaccccaggcgtgactgtgcactggctcgagcctgccttgcaatgtggcctccctgcccagggccttcgcgggggccacggtgcatgactgctttaactggctgtcagtgctggtcctgctgcccctggaggctgccactggctacctgcaccacatcactcgacttgtggtggcctccttcaacatccatggtggccgtgatgctcctgacctgctcaagatcatcacagagcccttcacgaagctcatcatccaggtgacagcagggcctggcatggggtgagggtgggggtaacaagggacccagcctccttcactccccctgcccacatcttgcccacagctggacgagtctgtgataaccagcattgccactggtgatgagtccctgaggaaccacagtctcatccagatctggtgccacccagactccttacaggtgagtcccaggcctaaccccaggtaagaggactccctcttcagactcttggtttcattgtctgttcaaaatgctccagatagaccttgaagatcatttagccaggagagggcaaatatgtggcccttctactgtgcttacagttaacattgctaattcctcccaacttcccacatcgccttaggcagacatcaccaatcaattaaagttgttatgtaattgatctagcccagtggttcttgaagtgtggtcccaggccagcatcttgtgtgccgtgtgggaacctattagagatgcaaatcaccctgcccttccctagacctactgaatctggaaacccctgggagcggggccaatggcctatgcttcagcagttcctctaggtgtgctcagtgctcaagtttgagaaccgctgatccagcgcaacccttgggtttcacaggtagagacacaggttcagagaggctaagaaacgtgccagagcttatcctaccatgtcagggcctgagcaccctagaggggttagtgactcagctgggccatgttttgggacccaggtaacgtggggaagaggcagagtgctataaggataccaaggaaagtaacaggaaggtgagctgcgtggagaactccttggagatgttaacagccgcttgtgctggcatcgggggttccttctcctggagactgccacaggcgggagtcccttgtccttctgcactgtttctgctgcttctaatactgggaagatctgtttgaatcaagtggatgctcatggaccacccattatgccaggctgatgaggaagcaggcaattagcacacttccttactcagctgtgaaaaggcaaatgcttcatccaaaccacaatgcaccatatttgcttctccctgatgcttgcatgtgagacataactccatttacaatgagatacgaggaaatccaagccacagcacagcacagcacagcacaagcccttccccttccccttccccttccccttccccttgctgcttcttgtgactggacctttaccctggtgcgaacagaaaacactcatctgactcgccctgcgatgctcctttgcatctgaagttgctccagctcagcctctgagtgttcaaagcagccttacataaaaaaaaacccctgcgggcagcttttacgctgacttcatgacctctttaatacatcaaccactttctcacgagctctctgagcactcttagtgctctctgactcaccacaagcctctctacttcatagcaaaatctggaagggagagaaatcacacactttgatcttcgcaaaaagcaagccatggaagacagctctgttcctcactgcccctgagctccctgccggccacctactgcagcttccggcagatctcaaccagcagcctccacgtcctcacttgaagtcatcctcacccaggttcactctggggaggccgcccttgggcctttctctacggctgcagctgacacttgtccagctggtttctcttcctcactctaccaggaaatgctttccttaaacgctttctgcagggcagggtctcatttcctcggcttggagagtagctggtgggtgggacccaagctctcactttcatcccctttctgggacagcgccccgaaggagtgtgactcacacagcagtggatgtgcttggtcttgcaaagtgtgaagtgcgtcctggctcttcctgcccaaagacgggccacagagtctccccgtgctcccttccaacctgttcccattgacgccaactttcaccatgctggacctgaaccagcccgaaacagtctccagggaagctatgcaccagggagaggaggcaagtccaaggcctaccagatggggaaagcagcagcagcggcagttgagtgatcagacacttgagtctcccgggaccctgacaccgtcctgggaatcaccttcttatgtggccacactgtggactgtcaactatacctgcctggattaaacaagcatcttttgaggacttgcaacctgggaggcagggattatcacgtccccattttacagacgaggagcactgagccccagagaagtgcagtggcttgcccaagtccatgtaattgaggtaggatacaaatcctggtagaatcctgactatctcgttgcctctctcactcaccggtctgacattctactatgtatgtctgcttcccatgctgcccatcaggcctgaaggccaccaggtgaccatagccacgtggagacgactccagagatagcgggtgttgctctaaggagaagttctccttttcgccaccaggtggtgctgctggcacagtgctctccctcggcttccagaagaacaaaggccctagagctccccttcctctgagggggaaactgctgcgctggcccacatcctgacagtctcctgtgagcttaatcacctccttcagtccccagaaggggcctctttaatttagggtgtccctataggcacttaaatcccaactccctcttccaaaatgcttccaactagcccctgggaaaaggtgggtagcattatggacttcatgctgcagaggaggaaactgaggcccagagaggctaagtgtttgctctggtgacacacagctgggaacggctcagctggggtatgggcccagggctgtccacaggcccattctgttcttcccacagagcccaccacccgcttcaggcccctccagcctctcctaccccaccccaggcccaggcagggatgggcacatcttgggaagatgcccccagatcctgggcctcccagctcttttatctaagctggagtttccatcttctccctctgccccacagggaagccccagggcctgctccctcccggcagttcactctctgcctggctttgtccctcctgccagctttaccttcctctcttgtactttagggtctctgggctcccagccagggccacacagtcccaggcaagaaggtcaaggttctaaaaacccagagggcttggccctgctgctgcctctgccagccctaagttgggaccccagtaaagttccccattctcctccagccttcgcagggtcccacagtcctccccacagagaccactgggcccagcccaggttaggtcagtggggcacacgttgaccaggcacctactcattcaaggggttgtctgctacctcagcatccaggctgggtactcccaggaaggtccagcaggctcctccccaacagggctagggttctcaggttcatctgcaggggccactggtcctgacctaggaagtcagtcacacacacagcctcccaaccatgtgatcctgaacgggcccagcgagggagagggtcactccatatcagaagacagtttaccgaaggctcatgatgagccaagccctgtgatgagcgctttaaacacattccccctgtaacctttacagcagctcctctattatcctgcgttagagaaaacaggctctgagaggtggcatggcttacccagggtggttggtataagaagcaggatttgaactcagatctgcctaacagcaaacacctggctctctctctcccttaccctcgcagcagttaccgttgctttcccagcctggttttctcatctagcccatcgcagcctattttttccaggcttcttggcctgccattcaggcccagtcttgatgggtccccaaggccctgatgtggcgaactgggagcacagaagagcacattgccccattcaagggagcacatcccgctaaaataaacccggatgttacaccagacgccataaaagttcttaccttggccagcatggtggctcacacctgtaatcccagcaccttgggaggccgaggtgggtgaatcacctgaggttaggagttcgagatcagcctggccaacatggcgaaaccccatctctactaaaaatacaaaaaattagctgggcgtggtggcaggggcctgtaaccctagctactcgggaggtggaagcgggagaatcgcttgaacccaggaggcggaggttgcagtgagccgagattgtgccactggactccagactgggcaacagaacaaaaactctgtctcaaaataaataaataaataaataacttcttaacccaacaaggctacaaatgagttgtccacaggccagactggcctgcttctgctgaccttcattgaattgtaaaagataactcaaagtggtcgccaatatttacagattgggagtttgttgctttcgggagtttttcattttttgagataaggtcttgctctgtcactcaagctggagtgcaggggcatgatcatagctcactccagcctcgaccacctgggctcaagagatcctcctgctccaacctcctgagtagctaggactacaggtgtacaccaccatgccctaattttctttgtggagacaaggtcttgctatgttgcccaagatggcctcccactcctggcctcgagtaatcctctcacctcagccccccaaagtgctgggattacagccatgagccacactgcacctggcccagattgggagatttcatctagaacttcagagttgtggcttttctcatagaaattgggcaatttagccacactaggctgcgtccctggatggtgacagtgatcaggagctgagtagctactgctgactctacaggcccagcagaaactctccccacctcttccacacacagcccgagctgctcacttaggttaccggcccggacctgtggccttctgaattgtagggcctccctggggagcccctttgtctcactgacagtaggtgggcagaagagacgtgtgggctgggccctctgtccccttacaccccctgaggataaggaattgatctagaggagaatggagcttgagctaagggtgtcttggaggagaggaaggagccaggatgctggggaaggggcaccgagaaagggatgggtaataaaagatgaggaagggggagttttcagaaaaagaggaacatgttcagcagcacccaatgccactgagagagggaggaaaagaaagacaggaagccactggatgtggccccagggagagctgggccagtggagtgacagggcagaacacacagaggaccagattcttgtgtggcaggcactttcatccacatgtcctcagtggaagagacaggctcagagagggcaagagacccatccatggtcacagagcaggaggcccatctccatcttccccatctctccctaactcccatctcagccccaacctcaggctgtgttttcctaattcactaagtcaccctcctcctgatctaggctcccacctccatgtccagagcagaggccaactccagccagacccttggaaatgccaccatggagaaatgtaagtgcctgcaacatgggaggtgtcctgcatggcaggggcagagcctagcagtggcagggcaatcccacacagccactattgtgtccagccccaggaagcatggctgtcaactagcccagctcctgagcctgggtcaagctccggtgttgaggctcaaggagcctgagatggggccttaggatcagagcccaactgggtggcaaaggtggggacctgggagccaggtgtggggtcagctgtcaggagctccaccccctgcaggcaaccacatctttgtggacactggcctaccggacctggctgtggggctcatcctgctggcaggatccctggtgctgctgtgcacctgcctcatcctcctagtcaagatgctcaactccctgctcaagggccaagtggccaaggtcatccagaaggtcatcaatacgggtgagctgcgagcagttgactgggcagggccacaggatgggcctttccagatcctgctaagtcctgtgactgccttgatctgggtaaaccctaccatctctgagactcagtttcccgatgtgaacaaagaaggtggtttctgaggccactgaggtactgacagctggagacctgtggccgcctctggctgtggttccattttagcaggtggagatgctcaaggaccattgtttgattcaatcaacaaagagtacttaagcccccattgtgtgacaagggaggtgtagtgccaggtatacagaggtgagacaaacagagttgggtcctgccctgaggggctcacagcccagcagggggaggaaagcaatgaaaaatacatgagattggcaaatggctcacacctgtaaatccagcactttgggaggctgaagcagcaggatcacttgagcccaggagtccaagaccagcttgggcaacatagtgagactttgtcttttttttttttttttttttttttgagacaatttcactcttattgcccaggctggagtgcaatggcatgatcttggctcactgcaacctccacctccagggttcaagtgattctcctgcctcagcctctcgagtagctaggattacaggtgccggccacaacacccggctaattttttgtatttttagtcgagacagggtttcaccatgttggccaggctggtctcaaactcctcacctgatgatccacccgcctcagcctctcaaagtgctaggattacaggcatgagccaccgtgcccggccgagacttttgtctttacaaaaaattttaaaattagctgggcatggtggtgtgctcctatagtcccaggtacccaggaggctgagtgggagaatcgcttgagcctagcaggttgaggccgcagtgagctatgatggcaccactgcactccgacctgtgcaacagagttcaaaaataaataaataaataaaaatagaaaaagaaaatgaattaggaataggaaggaaaatgaattagggggataaattcagagagaggtacctgccaaggacatagcaaaaatggcagtgcagtagggtgtggaagagacggtttccaatgcgctgtttgaggccgctcagtgcagttggcatttgaacagacacaagtagccacgatgcggatgaagagcactctgggtggaggaacagtatgtgcaaaggctcagaggcaggaaccagcatggcaggtccgtggcacagaagggtggccagtagctggcaggagcagggtaagggattgcctgagtggggtcagtgaggtggcacggaaggggccagagcatggggtctccaggctctgctcagagcctggactttattgagggtaacatgagcactcagaagacttggggtaagggagcaacaccatttgattttcattttcccttttttgttttttgagacagagtcttactttgtcacccaggctggagtgcagtggtgcaatctcagctcactgcaacctctgcctcccaggttcaagtgatcctcccacttcagtctcctgagtaaactgggattacaggtgtgcaccgccacactcagctaatttttgtatttttagtagagacagggttttgccatgttggctaggctggtcttgaatacctggcctcaagtgaacctctcgccttggcctcccaaagtgctgggattacaagtgtgagccaccatgcccagcctcttcctattaaccataaattttttttatagagatgggctctcactatgttggtcaggctagtctcgaactcccagcctcaggtgatccacccaactcagcatcccaaagtgctgggattataggtgtgagccaccttgcccagccttggttttcattttaaacttcatgcactgggaggggctgcatgacaagtactagaataaggggtatcatggggctgtgggagctcagagaagggagaaaaagtctgctccagagcagggggtcagggaaggctttccagaggaagtgacatccatgctgagtctgaggatgaatattcagatgctgagtaggatattcccagcagagggaacagccccatcaaaggcacagttgcctgacggagccaggctgagaaaggccttcaatccaggagcaaagaggccaagtggaagcaactgcagtgggagcaaacccccatggaggtcgtctctcccagtgcccccgcggagatccgctctcccagtgcccccgcggaggtccgctctcccagtgcccccgcggaggtcctctctcccagtgcccccgcggaggtcctctctcccagtgcccccgcggaggtccgctctcccagtgcccccgcggaggtcctctctcccagtgcccccgcggaggtcctctctcccagtgcccccgcggagatccgctctcccagtgcccccgcggaggtccgctctcccagtgcccccgcggaggtctgctctcccaatgtccccgctctgaccccagcctgctgggatgcggtttccttgcagacttccctgcccccttcacctgggtcacaggctactttgccatggtggtgggcgccagcatgaccttcgtggtccagagcagttctgtgttcacctcggccatcaccccactcatcggtgagtgcccatgtagaggtggagtggggtgggccagggctggcagggaaagggccgaaggagacgctgggggtcccacttcctctccctctgtccccaggtcttggtgtgatcagcattgagagggcctacccgctcacactgggttccaacatcggcaccaccaccacggccatcctggctgccctggccagccccagggagaagctgtccagcgctttccaggtgcgctgggagtgtagcctcgcctggggcaggatggagctgcctctggggtgtggggcctgacaaaggtgtgacaacatggaacaaatattttgactgcctactaagggccacctaatatgctcaatgaaaccattatgggcaaagtagacccaataccaccctcgagaccttagcatctaatagggagacactgctcataattacaccaataaatagcagtgagtcggatttgcaccataaggaagaggaagaggaagaggcactacaaaagagggcctggagcagtttggggaatccattgcgggggtcaaggccgcaaatggcaaaggggaattattctaggagcaaaggagtaactgacaagccaaggcactgactgaatgagggtccagaaactgacatcaatcctttagctgctggattttggcagtatctgctgggggattcctgtgcgaggggtcagtggggaaaatgtggggagctcagggcagtagttatttaccaactggtctagaagtatttcaatatttgcatagccagcatagccacctcggggtgatctcggggcagggggcacatcacccctaagtggaaactttcctgctgcccagaccagatcggggttcctatcatctacccctgctggcctgacacaggacctgggagccagtgcccatctcagcccctctgcctcatcccctgcagattgccctctgtcacttcttcttcaacatctcgggtatccttctgtggtacccggtgccctgcacacgcctgcccatccgcatggccaaggcgctggggaaacgcacggccaagtaccgctggtttgccgtcctctatctccttgtctgcttcctgctgctgccctcactggtgtttggcatctccatggcaggctggcaggtcatggtaggtgtgggcacgcccttcggggccctgctggccttcgtggtgctcatcaatgtcctgcagagtcggagtcccgggcacctgcccaagtggttacagacatgggacttcctgcctcgctggatgcactccctgaagcccctggaccacctcatcacccgcgccaccctatgctgtgccaggcctgagccccgctcacccccgctgccccccagggtcttcctggaggagctaccccctgccacaccctccccccgtcttgcactgcctgctcaccacaatgccacccgcctctaggctgtgggcccagactacagcctggaatggggaaggcctggggtggaaaggcaggggagggagggtgtgtgtaggtatgtgcatgtgcctgtgccaccctgggtgccagtctctccttctgtagctccgcaaagctctgggcttgtgtgagagtgtcggtgtgtgtgcatgtgtgggggtgagtctgcatgtgcacctgtcatgtgtagaagcttgtatttgtgtacaggtgtgccagcccatgcaggtgtacacagacacacctgtgggaggctgtgtgcaggctgcaggatatctgggtatgatttcaggtcctctgcacgtgtacacatgactaggataggcaggagtaagggtgggtctgggtatatgactgtgcagctgtttgtgcatagatgttggtgcctgcgttactgaatttgcacacctccttgccaccttccttcctccaagataccatctcctcatcctaacccaggtcttcggcaccaccacaattaattcccttcccaacacttgcctgatggaaaaaaaacaaaggaattaaaactctcctcaggcattcggaagtctttttgctctccatcaatggcaaagggaagaccaagccagggggttcagcagcaccatctcccctcaaagactggctgcaagagcagcctgccctgcccaggccaggtgcagttccagagaagccagccctgcaggctcaccccaaccatctgcctggccctaccttagtgagtccaaaccacaattcaaactccctggaagcccctcctaggcctggggccacccccaaggcaagtgtaaggaggattctgcacccccaccccctgacccccacctggctgaacttcctctggtctccctctgccctctaaattcacccacctcagccacacatcactccttcctgctgggataagatcagggctccagaataagtgacaggtggggtctgccatcagggccgctgggggaggggacgggaagggtgggggtgggcaagagaggccatgccctgggccccagcacatggagggcagggaccagacaccctccctcccacttttgtccactatctttgggcaataaaccaggcctcaaacttacccaagcttttcaattccccctcctccataggtcaccctgaaactgaggcctgcagagtgagactcccgggtagggatgccagagttcctccctctagtccagggactcctgcggggccttttcgaaggcctggggaaggcaggatgtaaggtctcaaacccaattgcgatggtcttggacatgagccctctcagtaggctccccttggaggaatgtgggcagagatgcagaggcctgtgagccccagaactgctttacaagccaccaagcccatcctgtcacccactcacaacttgctagtgcttgaggtatgagtggaggggggaggagcaaattggcctccagcctgacaccctgatggggagaggtgttcgcgggatggggagggggctccctttacttgtcctgcctaatgtgtgggaatatctctgagaaaggacgctaaggctgaaacagactttgagaagcccccacccttggactcttcctcagctgcggagtccctaggaccctgggaacgcgccaaggagcagcagtcaggccaggagcctctgcaaggcgtccatgggagagcagggtgtagggcacaggggcctggcagcctctagactcaaaatcccggctccaccaggtaaccgtcttgcaaagaccagtttccttatttacaactccccccaccgcgcaagtggaggaggagccagccgcgcccaggtcacagtttatttggcccgcgctaccagtgggcggcctggctggccggctaggcgccctgcatgcgcagcccgcgtatgagttcgtgcaccgtcttgttgaggatgcccccatgtacgccgcgtcggcccattagcaccaggagcgcgcgcggcgcacggcccacgcacacggcgcgcgcgtccagccccttggtgcgtgcgtccagcacgccgtcaccctcggccagcaggtggtcgcggatgacgcagcagcggcggccccccacgctcaggcccgcctgcaggaaggtgtgcctgtccggccccgtgagcacgcccacctcctgcggcgagatggccgccagcaggcccccgggccgcgaagcccacacgcagctgttgtccgcatggcccacgatggccacgtcgtcgatgcgctggtcccgcagcactgcactgatgtagaccttccagtcgcccatcgcgctccgagtgcgcccagccgcctcgcacctctcggggaaatatagaggcgccacgcggggaaggcctgcggcgctgtgaggcaggctgggcggggctgtgacgtcacacaaggcgccgtcccggagcgaccacccaggctggggcacgtggggcgtgggcgtttagtgctgtcgcagttctaaggttatcctgtaggatgggtttggcagagcgcagcggctcactcctgtaatcccagcgctttgggaggccgaggcg

SEQ ID NO: 16775 - DNA, 12695 bp, Human
ggggtggtcggtcagcggtcagcagccacgggtgactcgactaaggactctgatatcagggcagcctggggtaggaataaactccccgggcctccccacccactcccagcccaagctgtgtacccaaagagctgccctccctgccaagccgagcttggtagggagttttaccaaggaggatccgactggattcgagagttgaggtgggccagagacagcagtatctgagtcaggtagagaagagcaatgaggggcacagagggatgggcaagagagcacatgtgcccagttttgaaagccaatggcttcagcgctcctgaaggggcagacggtgtgaccaaagagataggcagcggcagagagggagccctaggatgttgagctggatcctgctgggcacaggtagccattaagggcttgcaagctggggggcatgacatggcagacttgcaggtttttttgtttgtttttttattttattttatttttttattttgttttttttgagacggagtctcactctgtcgcccaggctggagtgcagtggcgcgatctcggctcactgcaagctccgcctcccgggttcgcgccattctcctgcctcagcctcccgagtagctgggactacaggcgcccgccaccgcgcccggctaattttttgtatttttagtagagacggggtttcaccgtgttagccaggatgttctcgatctcctgacctcgtgatccgcccacctcggcctcccaaagtgctgggattacaggtgtgaaccatcgcgcccagccgacttgtagttttttaaaactctgctggaagatgaaggttgaagagccgagggagaggatgtttccagaggcccatgcaagagatggccatgacctgccttgagaaggggcaggggaagccagatggactggaagtggagtggcagtgaccaaggaggaggaggtgtgataggcttcccacgcagggtagatccagagacaccagtgccacccataggcccctaggactgcagtggtcacccgattcctttgtcccagctgagactcagttctgagtgttctattttggggaacagaggcgtccttggtagcatttggaagaggatagccagctggggtgtgtgtacatcacagcctgacagtaacagcatccgaaccagaggtgactggctaagggcagacccagggcaacaggttaaccgttctagggccgggcacagggaggagaacattccaacactctgtgtgcccagtgccgacgcacgttctctcttttatcctcaaaacagtcctatgaggatataagccagagagagacagagacaaggaattacaagttggtgagagtcaggatttgaacttggctctggcagatggaaaattagggtctgtattctttacaaaaccgtgtgtgcctcagatggagttggtgcataacaagcagaggtatccagggtcgcggtcctgcttgccacggaaggggccgccttgtcagttgtgaccacccagccctggaaatgtcagtaatgctgtaaggagtggggatcggatcagatgccatccagatgctgaagtttgaccttgtgtcatttttcactttcttttttggctcttctgcaatcaattcatttatttagcaaaaaagaaattatgtgtgccgagagcatgcagaagatatgtctccgttctctgcttccctccaaaaaagaatcccaaaactgctttctgtgaacgtgtgccagggtcccagcaggactcagggagagcaggaagcccagcccagaccccttgcacaacctaccgtggggaggccttaggctctggctactacagagctggttccagtctgcactgccacagcctggccagggacttggacacatctgctggccacttcctgtctcagtttccttatctgcaaaataagggaaaagcccccacaaaggtgcacgtgtagcaggagctcttttccctccctattttaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttggtatggcttctgaggtgggagagggtggcaggggtgggaagagtgggcaccaggagggggctgctgggctgagcaaagctggaaaggatccttgcccaggccctgagaaggtggcggcagggcagggctcaaccactgagactcagtcagtgcctggcttccagcaagcattcatctatcactgtgtctgcgagagaggactggccttgcagggcgcagggccctaagctgggctgcagagctggtggtgagctccttgcctgggtgtgtgtgcgtgtgtgtgtgtgttctgtgcactgggtgtgtgacctaggaggtccaggcagcatgtgtggtataagcattatgagggtgatatgccccggtgcagcatgaccctgtatgtggcaccaacagcatgtgccttgtgtgtgtgtgtgtccgtatgtgtgtgtgtgtatgcgtgtgtgtgtgtgtgtgtgtgtgtcttggccactgtcatgtgcactaaatgctgtgtgtgtgacatgccccaagagtgtggcatttgccctgggtgtggcatccgcagcatgtggctgtgtgggtgtcaaggagtggtggctccttcagcatgcgttgcgaagtgcttgtgccctgcatgtgcggtgtgttctctgtacacaggaggctgcctcagatggggctgcggggtctgctgacctctgccctctgcccacagagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtggtaagagactctagcagggagtgaagggatgcctggggagacagacctgcccctcttggaccttagatgcttccctctgtccctgatgtagactccttgacctccagcaacgatgatgaggaccccaagtcccatagggacctctcgaataggcacagttacccccagcaaggtcagtaggtctccaaggacttgtgtccccgctgctgctcatctgatcactgagaagaggaggcctgtgtgggaacacacggtcattctaggggccttcccctgccctccagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcgggtgagtctctgggttccaagaccgtctgctcccccattttcattccttcatcagtcccctcatacctacaagcatacctataaatcaatcgaatgagtgaagcgattgcggggccccggaaggagccctggactgtggacctgggcagctctggttccccttctgctactctctggcaagtgacttaacctctcagcctcagcaactccctttgtaaagggagaagaatcactgactggttggtctgcataagccttagcatctcatcgtcttgatgagaccctgcagggtcggctccatgctgtcatgaggcaactgagcctcagagaaggcaagggttggctcaaagtagcacagctagggagagggagagctaaaattccaaaggctcaaacccaaggctcaagcgccctggggagcctactcctttgtgccatagtccttggcctgggcctgatgttctcagggcctagagagcttgacaagagccctgtgggcaggatgaggatctagcctcctggtcctctggcccccttggtggacatggtccggtggtcccggacactctctctgcctgcagctgcgccatcagcactggagtctcgtgatggagagcgtggtgccctcggaccgcggcacatacacctgcctggtagagaacgctgtgggcagcatccgttataactacctgctagatgtgctgggtgagcgcggggctgggaacaggggaggcctgacccattttgggctcagttgtgccctcttggtggggtctagtctggcaggcaggatggactcagatgagtcaggcagcttggtgagcaggtgggtcaggggaaagcacaggggttagtgtggggctggaggagcagaggtctgccaagaggaaaaacaagaaggacatccaggcagagggcgcagcccgagcggagggcctgagtataacaaacgccctgcacttgcaggccagcatattcgtagggcgtggcgtttatatggggagccaggtggtggagggttttgaatgctaggctgagatgttgtccttgacccgaagcaatagggagccagggaaggtttaagcagggtaagcaggagacagacaagaagctgcagaaaggtccctcccttgaacttgaggaaggctggagggaggcaaacagggtgcttctatgggtgccagtggtcagggttgactgtctcgcccggtccccagagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaaggtaaaaggtgcaccctgctgcagcctgggccccattcttctcccaccttgggttggggggctccccagcttccctgttggccacagtgtggccccaggccctgctgtgaccccagagcatgtcccccaccccagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccaggtgagcacctgaagggccaggagatgctgcgagatgcccctctgggccagcagtgggggctgtggcctgttgggtggtcagtctctgttggcctgtggggtctggcctggggggcagtgtgtggatttgtgggtttgagctgtatgacagcccctctgtgcctctccacacgtggccgtccatgtgaccgtctgctgaggtgtgggtgcctgggactgggcataactacagcttcctccgtgtgtgtccccacatatgttgggagctgggagggactgagttagggtgcacggggcggccagtctcaccactgaccagtttgtctgtctgtgtgtgtccatgtgcgagggcagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacaggtactgggcgcatcccccacctcacatgtgacagcctgactccagcaggcagaaccaagtctcccactttgcagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggtgcgctgagctgtgtgggggcagggacgcgggcgccgggttgcagcccgccctccgcaggagtgactcggaggtctgaggctggactttctccatctccaggctggtgcttgggaagcccctaggcgagggctgctttggccaggtagtacgtgcagaggcctttggcatggaccctgcccggcctgaccaagccagcactgtggccgtcaagatgctcaaaggtgagtgtggcccggtgtggtggctcacacctgtaacgccagcactttaggaggctgagggtgggaggatcgcttgaatccaggaattcgaggccagcctgggcaacatggcaagacttcatctctacaaaaaaaaaataagaaaattagttgggtgtggtggtgtgtgcctttagtctcagttactagggaggctgaggcaggaggatcccttgaatccaggagttggaggttgcagggagccatgatcacgccactgtattccagcctgggcaacacagtgagaccctatctgaaaaaataaataaataaataaaaataaaaggtgaacgtggcagcctggaggaggtgctatggcattgggactaatagaaggggctcacggtgccaccaggtgagccctggagctgggagaggctgtgggatcccacccttaaacctgcaattcacctctgctcctgaccctggcaagtgacttctgagcctcagttttcccttgtgtcatatggggtagataacagtccctactcccagcccaaggattgtggaaagtgcctggctcatagtcagggctcaataaatcttcaccactggggtgatgatgatgagaagaatttggtgtgacaggcttgatatcctgtgtcagcattagtctgtgtcagctttgacttcacatctccttgtcagcctcacaggccctctacctccttccttatggttccccccagacacaccctcagcctcccttggaccctccctaggtctgccccccacgtccactgctgtaggaggacagcccttctgcttgcacccaggcccagccccggggtgctcttgctgggcactcctgcaccccacccatcagggcctctccttgcagttccccagccccctctgcaagaatggcctccactgctcttctgctcctcccctcctctctacacagctggggccacctggtgctccctgggaggcagggattgagaaatgcacattgtgtcattggcccagggccacaggtcagccccaggggctcagccagagaagccaaagcagccttcttcccaagctccccggctgcacccggcctgccgccagctccctgaattcccaggccagttggaagccaggccctggtcaaacagaccccagggcgccagcctgctttccgcacccagaagctctgaccccatgcggggactaccgctgacccctccagcggcagcttccttccttccttcctgctccgagctcttcccctctctcctgtgtcctgggcctgcccgctggaaggcctgcctcttagatccttgatacagttgcatccttgcaactgctgtgacaggcagggtgtgacccactgctctgtttcccacaagacgaacctgaggttcagagacgctaggagactttttcaaggccacacagcctagcaaggattcagccctagacctacgtagccctggtccagtgctgcttgtcctgcacctgcctctgcatgctccctcgtgcagttggagggcagcctcttcaccccgtctgctgcccttacagacaacgcctctgacaaggacctggccgacctggtctcggagatggaggtgatgaagctgatcggccgacacaagaacatcatcaacctgcttggtgtctgcacccaggaaggtggggccgaggcggggctggctgcacgggccgttagggtgcagagccaaagctttggcagcctctccacgctccctccactccctctgcagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaaggtataggcgctagggctctgagcccctctcagtctctccagctccactctcaggcctgtggcattcaatgtcccgacttctccctctctgctctttttcatgaccccacctcagtgtccccaggcattcacgctttcctgcattccccactcgttcctcacccttccccagaggggagaggggacgcaggagaaggcactccccgtttctaaaccttgacctcctcctctgtaaagtgggtggagggcccctgcccccgggcctgctggggggtggtgtgtgctcaactccaggccaggtgtcctgaggcacccaagcccccgctccctgcagtgtatccaccgggacctggctgcccgcaatgtgctggtgactgaggacaatgtgatgaagattgctgactttgggctggcccgcggcgtccaccacattgactactataagaaaaccagcaacgtgagggagatggggcagaactggatgggggtggaggggcactgggcccggggtggcaggcacgaggacctgtgggactctgcactgaggccctctctcccctccagggccgcctgcctgtgaagtggatggcgcccgaggccttgtttgaccgggtgtacacacaccagagtgacgtgtgagtcctgccggcggtcactgtcctaccccacaaaaagggcaaggcactgcccaaagtcacgtggccccaggagtcatgcgctcgagggctccttcagatttggtctgggacccgagtgggcccagactccaggaggagcccattccccaacagctgtggtgggtcatgtctgtggggtcccccgtcctagccccggtcgtagggagggcgctgagccacactgagccctggccctgcctccaggtggtcttttgggatcctgctatgggagatcttcaccctcgggggctccccgtatcctggcatcccggtggaggagctgttctcgctgctgcgggagggacatcggatggaccgacccccacactgccccccagagctgtgaggcctcaccctgccctcgaccccactttccagtcctcctcctcctctgccctgaccatggcctcagggtgtgtcccggccagaaggacaacactaacaacaactcctcgtcctcctcctcctcttcctcttcctcctcctcctcttcctcctcctcctcttcctcctcctcctcttcctcctcctcttcctcctcctcctcttcctcctcctcctcttcctcctcctcctcttcctcctcctcctcttcctcctcctcctcttcctcctcctcctcctcctcctcctcctcctcctcctcctcctcctcttcctcctcctcctcttcctcctcctcctcctcctcctcctcctcctcctcctcttcctcctcctcctcttcctcctcctcctcctcctcctcctcctcttcctcctcctcctcttcctcctcctcctcttcctccttctcctcctgctcctcttcctcctcctcctcttcctcctcctcctcctcctcctcttcctcctcctcagcctagtggagtgtcctggcctggcttctactgatgaccctcctatccctcatcaaactccccaccaaactcctccccacccagagaacccccggtcctccccttcctcctgaaggcctgaggctccctgtgaccctccgccccacctctcgcaggtacgggctgatgcgtgagtgctggcacgcagcgccctcccagaggcctaccttcaagcagctggtggaggcgctggacaaggtcctgctggccgtctctgaggaggtacagcccctcccacccaccacctccctctgcctgctcccctccaggcctcatctggcctgaccgcgtggacatgcgccccgtcccatcccgggcgctgcagaggctgaccagctccgttccccacagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtcttccctgagcaacatggagtggggtgaggtggagggatccctccagcagagttctgcctacaggacacggactgagggcactggaccaggccatgggctccgccacctccactgccccaggagccagtgtgtgcctatctgggtccgcctgtcccaccagccccatcttgtgtctgcgacagtgtgaatgagtattaatgggctgagtccgcattgcactatacacggtgggactcctgtaccctctgcacatgtgtgtgtgtgcatgtgtgccctgcagctgtccccaagggagctggcagcccccctcccccatctgctcagcattaaccaagctgaccgttaacacagcatgaaaatctgagagccagccttaggccgcggcccgctcccacgctctgccggctcaggctgggggcttgtggaggccatgcccgccccgccctggccagtctcccgggcagcagctggttgccgcccgcctgggctgcagctgtccctgcctgcctggtcttccactgaggagccgtcacagccctgtactcagagctcctcagagtgagcagcttctcaaggctctgagcctggaacctccttccctggccccatcctggcacgtactgctactccccagcccctgagccttgagtgggccatggggggcccaggcatggtgtctgacccagcacttggcactctcctgtccttttccttacaggcctcaggctgggacaggactgcccaaccaggacagccttcatggaggccatcgggattgcccccgtctgcccccagggagtggtggctgaaaatgcatatgcggtcagaggggtcagacagagggattggaggctggggcctccttggaagactgagcgtcagctcatgattgtttatcctcactctgggctcctcccagctctcagcatagcctctccagctgacggtatcccacacagaactcatcttacccccagaactgtacctcctccagggcaggaaccagggagtcacctgactacttccctcaagaaccctgttccaggccaggtgcggcagctcacccctgtaatcccagcactttgggagaccgaggcgggcggatcacctgaggtcaagaattcaagaccattctggacaacatggcaaaaccctgtctctactaaaaaatacaaaaattagccgggcatagtggggcacacctgtagtcccagctactcaggaggctgaggcaggagaatcatttgaatctgggaggcgagggttgcagtgaaccgagatcgtgccagcctgggctagggagcaaggctctgtcgcaaaaaaaaaaaaaaaacaaccctattccctcatgcgcttccacggtccagcgtggctcctgaggccagcactgccacctctctgataatactgtctttgcccatgagtagggtgcacctgtcccgcctgcctcctggggcgtagggtttaggaggaagcacgtgcagatgcacataggcttgggggagggtgtgatgcggaggcccatgggttgggctgcggtgcttccctgggagccggtgctggggcttttgtgtccctgagtgcccccctccgagccctaggtatccagcctcccttttgctccctcccctgcaggtggctccagaggtagcttccaaaagcagactgggtttatgctccctcctgctctcaaagacccccactaactcccgaaagcccccagactgaccaactttctttttccttccttccttccttcttttcttccttccttccttccttcttccctccctctctctctttctttctttttctctttcttttccttccttcctttcctttccttttgctccttccctcccctctctgtcttcctttctctctttctctctctcctccctccctccctccctcccttccttccttcctctctctctctccctctctttttctctctcttctttctttctttctctctcttt

SEQ ID NO: 16776 - DNA, 19326 bp, Human
aaactagaagcagagctatcagtttaggaggctgttgtaataatcaggccggaggatggtctggtgcagtgtgtgggaatggggaggaggggatgcagaggagagctcttagagagcctgagatccaattgcatagaggaggtgagggtgagggatgcgcgcaggcagcccgaacggccgtgtgagtgagcacacttcgatgtctccagtcaaggtggagaacagaagagctttgtgggggtaaggtgatggaaaaatgagtatggctttgttgaatttgaggagcttctccaccatccagatagtgatgtctaacagaccactgggatttaggatttggctgaggccaaaggtagatttgggagccctgacacagctattaatgaaaccttgggaatgggcgagataaagggagtgtagagggagggcatgaccgaaacttgggaaccccattgtctgaaggaagagaaattactgatgaagactacgagagactcaggaaggagacctaggagagactggccgtgaaagccaaggacagggggaattctgtagcaaagagaatgactactggctttgcatgcctgagagagggcagcagaggtggggactgaggaaaaggcttgggattgggcagttaggaggtcaccagtgaccacgtggagggcaaattagtgagcatagtgggagtaggcaaggaggggagtgtaggggtgggaaggtactatatttccagaagttctgctgttgcaaggaagggaggtaaagtgactcagtggacagatgtctcttcccatattgggccctctgctgtgtttcccttttcccccacccctaaagagcacctgactcactgagggctcccttgggactatggaaacagcaataccacctccagctcggatgagcgaagtatctgacatttctacagttccttacagtgtgcaaaggaccactaactcctttaatcctcacaagaactgagcttttcatgttatagaggaaatggagaatcatagagtttcagttcagattcaactacataaatctgaatgcacatctgagcaagttcctttgctctcgtgatctcatttgccccacacaaccctttgatacatgttggtcccatttcacagatgaaaagcctggaggttgagatggggtgcagctgccttgtggagagcagggttcccacctctgagtacagggctctttctgctctgcatcacttcactgttaaaacccacctgatgtttatgttgcacactacatctcataaagcatttccccaggtgttattctatttagtgctcacaacaaccttgtgagggtagatattatttcctcctgttttatggatggaagctgaaattcaaagaagtcataaatgacgtccaaggtcaggtcactagtggaacccctttctgaagcacagatccacccctgtccatgacccctgttgccttcaggatgaaattcatgtgccttagcctggcacaatggctgtcccttttccagcctgcctgcttctctggcaggtctttggttccctctttgttccaagcctctagcatgtccctgacctcccaaccacagcagcatgtccatctattacatgtggccatcttgctcactgcctgtgctaatcatactgtgattgttgatgagactgtgaggtccctgagggcagggcctaggtctgcttcatctgtaccacaacgtccagcatagcaggcatcaggaactggtgaatgtcaatgaatgacagaattaacgaatggcatttggactgaaatcagcctttccagtgctctctcattagacatgcttgtgaaaaacaagggccttctggttgactgctacaggatctttgatggttggaggttctgaattctgctcccagcttccttcctggtccccttcagaaggaaggaagttggtctgggttacagactcctagggcctatagagtaaatggttgacccaggttgtcccttttctcccataggtggccaccttccactgtggaagctcatggactccattgggtcttcagggttgcggcagggggaagaaaccctgagttgctctgaggagggcttgcccgggccctcagacagctcagagctggtaagttcagcactgggttcctgtttcatgcttgtctaaggccttcaagagcagcgtgactgaagctgccatggggccctgggctctcacccatgcagcccctttccactgagcttttcatatctgagctggtaacgatctcctttcatgctccaaacaactgcaaggttgggctgatcatcttacaggtgatgaagagggatatagagaagtgttatgacttgagtttaagacatgacaggagcttgagctgaggtgtttcagctccaaacatgtcatttttgccaccttgccacacaggtgccgctcccgccccaagtgggtgacacagtctagagtggactttctcagggttatctggtcaaaagttgtgttcttgagacctttcctttcccgcctctccagttcctcctgcatgtctccctcaatgtagccgctacaatcaggcacacagacgattttagtgccaaactcatgcctgaggcttgctcagaagtgagtttcttctttttctgtcatcttgaccaagatttagaagctgtctcataccacacccttgagcaggaaactcttgtgtaagccatttcatatctcttagtctctgtttcctcatcagtaaaatggaggaaaataaagtctaatcctccccaccccctgaaggctaatggagataaaggacttgcctatggccgggcgcggtggctcacgcctgtaatcccagcactttgggaggccgaggcaggtggatcacctgaggtcaagagttcaagaccagtctggtcaacatggtgaaaccccgtctctactaaaaatacaaaattagccggcatggtggcacatgcctgtaatcccagctacttgggaggctgaggcaggagaatcgctcgaacccgggaggcagaggttgcagtgagccaaaattgtggcagtgcactccagcctgggcaacaagagcaaaactccatctcaaaaaaaaaaaaaaaaaaaagtccgggcacggtggctcaggcctgtaatcccaggactttgggaggccgaggtgagcggaccacaaggtcaggagatcgagaccatcctggctaacatggtgaaacctcatctctattaaaaatacaaaaaattagctgggcatggtggcgggcgcctatagtcacagctactcaggaggctgaggcaggagaatggtgtgaacccgggaggcggagcttgcagtgagccaagatggtaccactgcactccagcttgggtgacagagcgagactctgtcaaaaaaaaaaaaaaaaaaaggacttgcatagaggaggtgcccactaaagggtacttgagtcattctctgcagtttctttagttttctggcatattctgacatccacttgactaggcttgttgcccagattgtggaggcattacccctcgctgcatttcatgctcccacttcccccttgtccaacctgtaccccagaccctgctgcagacagttcttctgtgcctgacccacagccgtgcctcaggagtgacagcggtggctgggccacagtgcctgcccagccaggactggctctagggcctgctgtcatctcctccctcgcttcttgcccctccctgatgacactcctgtgcaggcccacatctgccctgctggctccatcacatacacctgcggttgaaagaatccctttcggctttgggggacttcacagggacaccaaatttcccatggtcctggacccccaactcagcaccacaggccttaccctgtgctccccttgccatgaccttaggttgaaaaaagttagttaaccacgtgtggccagttcccagtaccatctcagaggcccttccccaccccttccaccaggcttctctttgtcatcagagagggtatggagtcaggctctccaggctgggtgtgctttgtgctctgaggacagggaatccgtgttccactgagcatctcctatgtgtgacactgttcctccacttcaggtttgctgtcgtctcagtcctcatggcatctctgagaagtaggtactattgttcctgctagatagaggggttgcttgctcagagaggtgaggtgatgggcccaggccagcaacacagcaagttggtgacaagagccagtgttgaaaccacattggacttcacatgctctctaatgcctttctccttgctcttctgtctgaggtctctccctgctcttcctggggtgtcaggggtggctccgatagcttctcctggcttgtgtgtgcctcaccaggatctgccagggaagtccttctgtctttcttgcagttctgctgtcttctagtctctcctcccgaacatctcaatatgcccaagaggaaaaggaagaaaaacaatttgcccaagccattgacttctccgtgactctactgttttcatgaagcaatactaaaacgcccctcccatcccaatggcacttggcacttccacatacattacagcctttaattcttatgccaccacaaccatccaatcaacaaatcctgcttccagctggtgctcctcgtggccctcagatgtagccttgagcaagacatagtccctggcattgggggacttccaagtactattattttctcagttttgcacgaagaggtgactgaggctcagagagaggtgtgactttcccaggactgcagagccagaaaaagggagtgcgaggactcagctgtaagttttctcaagccggatcatctggggtttctttccagcaactttcatcagccttgagttcttttcaagggaactttctaggttttataaagcttcacattgacatagaaacatctctgcattcaggtagatatgggttcaaattctcccctgccccttcacagctgcttggccctgcagatgacttgccctctcggagtctccgtttccatatttctaacacttgggcagctggggctcagaggggcaaggctgagaccccgcctgtcctgcagctctttgactttgctgcccactgcctgagttcctggatgtgcagcctgtgagcaaacagggtctgcagcttggcttcagcttctctttcccttgtcaccagataggcctggtcagggtgagatagagtgggcatgggcacccctagcaggcatggctgctggaagcatgtgctgtaaggcaaacgtgtaagtggacatctggcaccccagttaggatgattcgccttcttagggatctgtttcccattctcttcctaaagcaagaggtgggactgagttgtccttatctccctcaactggcagcttctcctcccagcctctcctccctggagcggccttattatccaggtgcctgagttgttattccaaagataagtgtccagtttggggcaataggtcattgaaatggaactcctgtgtgacaggaagtgggggctttggaaagtctgagcctgaggaggatggagttgccaggctgtgacccttcaatgaatccagggaggctgttggggcttctttgaaggatgggtgagagagtcatctaggggagggtatttgctcacagggatgaggtccctggggctcttaagctactgggcttctggtggagtgacagcctggggtgtcctggcttctgccttccctgccttctcacctgccccttcagactccgatccactcccggatcagtcttctccaaatccatccccttgctcttcccctggatcttcgaatggcttgttcccttccttcatttagatcacctcctcagggaaaccctcttgaactcatatctaaaaatacctctttctaccctggtcactctctaatttcttatcctgcccccctacgtttaatagccaccatcactactggaaccaaattgtatgttcacgtgcttaatttctgtctcccaccctggaatctaaagcatttgttgcttcttgggtggttatgtgtgtgcggtgcttagaatacagctgggtgcatagtgagggctggagcaatgttttgggaaggatgactgactgaaaaaaggaccatcctctgcagtgtggtctccaaatgctctcgtgctgggctttttcaggcttcagagtctgagagtggattaggagagggaaacacttgaagtttgttcgtgcatttgtttattctcttgttcgttcaacaacaactcactgagagactcttgctgtgggtcctggggagccagagagcaatcattagtggtatggcaggaagaaggtcttgccaaaccctgaattcaaagaagaggaggggtagggtagaggatgtaagaaattgagaaggagccgtgaggtaatggggcaggaggaggaagaaggtgggttctctttccaggacagagccttctgaggatgccagagctgggtgcaggctgttggcaagagagtcagggtgtatgaagagccgaggagtgggctgggcagggcaggcctctgccttgtttggaggtggggagtctggccagcccaatggtgctccttcccagatgttggcctgtttctccccaggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactggtgggtatcatagattgagatgcgtggccaggcctggaagagggtactgatctaggggagggaaacgttccttattcctgtcccccatctctatggccccttgaccagactttgcaggccttaggaatttgggaagtgggcagagggctctggtcttgccagctgcatggctttctgtgacctgcttgccctccagagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcaggtaagcactcactgcccagcctctggggtctgggggcctggctgggtggctagggctcagatgggcaaggctgagcccccccacttctcctgcagctctttgactttgctgcccactgcctgtctgagttcctggatgcgcagcctgtgaacaaacagggtctgcagcttggcttcagcttctctttcccttgtcaccagacgggcttggacagggtgaggtggagtggacatgggacgctgggtagagggtggctgcagccccatgaaggccgtcagaggagtaacccagcttctctacctccagagcaccctcatttcctggaccaaaggttttaggtgcagtggtgtggaaggccaggatgtggtccagctgctgagagatgccattcggaggcagggggtgagtggagggaggggtgacaggagggctgcccatgttggcctgggcctggcacacatgcgttgggtctgggcttctgagagagttgctttcctcttctcttcatgtcctccatccagtttaacctccatccagtttaacctatacatggtacatgttgctaccattcccattgtataggttaaaaaacactgaggctaagaaaggtcaaataaacattcaggacctggggcaaaaaaacatgaatagactttgacctcctcctcaaggttttcacagtctagatggggaagcattctaataaaagattgtccgtgtcaaggaggagtgcgtggacaactctgggagcactacggaggaagcactggctctttgatcaggggcttgaaggaggagtttgcctcccttcaagtcaggctggggctggggcggatgatctagtctcagagaaggccacacacaagagtctggatgctggacaaaggctgatccgtctgggctaacctcttgtggtgagaagccagtgctgggaggaacaggcttggggagccaggcaggatgacagtgaggctggcaaggcgcagagttcaaggaggtgctcagtctcaggaaactcatcctggtcctgggagatggtgagggtggacgtcactgtgacctgggggcgcaagttgggggttagggaggagctgagggtgggattggaggaaaagttcctataaggtgggagcccagagcatctgtggcacaaatgtgtgtggcatgcagacatgtgtttcatggactctatgtatctccttcaaagccagggccccagccctgcccatcccctggattccctcctctggccactcaggccagccttgacctctgccctcttcatcatctaggcctacaacatcgacgtggttgctgtggtgaacgacacagtgggcaccatgatgggctgtgagccgggggtcaggccgtgtgaggttgggctagttgtaggtgagccatggaccatttgtgatgacaggtggagggtgtgctgcctggctagcaggccttgacagggttgtctctgccagacacgggcaccaacgcgtgttacatggaggaggcacggcatgtggcagtgctggacgaagaccggggccgcgtctgcgtcagcgtcgagtggggctccttcagcgatgatggggcgctgggaccagtgctgaccaccttcgaccataccctggaccatgagtccctgaatcctggtgctcagaggtgacctggcagggggccctgacctttggttccaggccctgtctatgactgctctgctcccaaccccttctgtccctgttctcaggcccttaggcccctccctgtcactctgagggtctccagggagcaacctgggggccctggccaggttcaaagaaggaagggcccaaagttctagaatccagaattgtcaacccttgatcttccctgttcctgactctggcctgccctgacagtttgggggttgagggctggaagtggttgagcaaactgctctctgccttcctttgggtccttcttgttctccaggaggcttctgaatgtaacctatgtcagagggggcagtggggtctgggcatacacccacctgtcctctgggaggctattcgttgcttctggagtctccagtttgggagccccaaagaaaagaatccttctttgggaactcttggaggtagggccaggtggactgagggcttagaaaaggcttcctccagccacccttcccccctgcaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggagtgagtcggggagatggtggtttagtgggggattcttggcttggaggaaggggatgatactctgttcccaaggtagccatggggctttagtgggatggggagcttctgggctgagccccaaaccacttccctttcccctccagcccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggtattgtggaaacgtgatccgcatgattagttggcatgaacacgtgtgtgtgatacacacccagagggccctctgggatcacatgtgcaagccagtggacacgaagggcacttaggcagagggagggccagactgagctatgggaggccagaagacatccaaggagagaaacgatgcttccctttgtgtgtgcaagggtggaggccatggcgacacgggggcgtatggctggtgcacagaacagatttcaaattgaagtgataggggaggctggctatggtggtacacgcctgtaatctcaacactgggaggctgaggtgggaggatcattggagcctgggagtttgaggttacagtaagccatgatcactccgtggcactctagcttgggtgagagagcaagactcgatatctacaaaaataaaaaaaaaaaagtgatggggccttgggcttcaggagaccctaggggtctggggccaagctgggcacacctgtatgtatctgggggtccagggccaagccgtgcacacctgtgtgtgtctgggggtccagggccaagccgggtgcacctgtatgtatctgtaggttctgcagcgtcctgcaggggacagtgatgctcctggccccggaatgcgatgtctccttaatcccctctgtggatggtggtggccggggagtggcgatggtgactgccgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcggtaaggacctggcctgagtgtgggaccgaaacatgggctcctgggggtcccagtgtgtgctggggctggagccacaagccctatcccggcactgagggtctctgcccccacagagcgaggggatttcctggccctggacctcgggggcacgaacttccgtgtcctcctggtacgtgtgaccacaggcgtgcagatcaccagcgagatctactccattcccgagactgtggcccagggttctgggcagcaggtacccacagcctgaaccttgatgtcagaggtggggaagggctgagcagtgcctacgcctgacctgtcctgccccacagctctttgaccacatcgtggactgcatcgtggacttccagcagaagcagggcctgagcgggcagagcctcccactgggttttaccttctccttcccatgtaggcagcttggcctagaccaggtgagggagggccaagagaagtgattcccaagggcctcctgcccccacatacccttcatggagtgggcaggaggcaggggaaaaggctgggcggtggcgggtctggggttggtggtggtggcagcactgctgggctgggcttgcacacagcctcagtttccccagacagggtaggcccagggttagggtctgaaccatttgggagcaggtcaggcctagactggggctgatcagaggacagatcgtccattttagctatagcactggtgtgtgggcctcagggtcctgcaggaaccagcatttgttcctgtctctagcaggggcttgaggtcgcttggggtttttttggcctctctcctcctcctttctttgtttccttctcagtgcctggctcagtgttgggtgcatgactagggtggcagagtgccaggcacaggctaagacacacatccctactcagcacacactttagcttgttcttacacaaggatgagggacttctcaatgtgcacaccggaagcctgtcacggaaacaatacctcccgggcctctggtccaaactcccaggaatctccctttcaacatacccaacttctgcttgaaagcctcttgccaaggagctcactgcccctgaaggcaacagttgcattcttagacacctgtgatcaatgaaaagcttcatctcacctactccaaccagcctccatgtgattttcaccccctgctcctgctctgacctctctctgatatgcaactcatttttttttttgagatgaagtctcactctgtcgcccaggttggagtgcaatggcatgatcttggctcactcactgcagcctccacctcctgtgttcaagcaatcctcctgcctcagcctcccaagtagctgggactacaggcacatgccaacacgcccagctcatttttagtagagatggggtttcaccatgttggccaggctgatctagaaatcctgatctcaggtgatccgctcacctcagcctctcaaagttctgggattacaggcgtgagccaccgcactccacctgatatgcaactctgtactctgctttcttttacacggtggtcctttggatggtgcagtgggccagtcttgctgcttggctgctctgctccaggctaagcctgctcagtccttttgattattccttgtaagatgtgagaagcaggtgagactccatgtgcaaatcggggggcggggtgggggcaagaaatatagtcttattaattttctgtaactgaacttaatttctgtgctgaaggctgggcgcggtggctcacgcttgtaatcccagcactttgagagtctgagacgggtgaatcatgagatcaggatttcaagaccagcctggccaagatgctgaaaccccatctctactaaaaatacaaaaattagccgggcgtggcagtgtgtgcctgtaattccagctactcgggaggctgaggcaggagaatcacttgaacccgggaggcagaggttgcagtgagctgagattgtgccattgcactccagcctgggcaacagagcaagactccatcttaaaaaaaaaatgttgggcccacattattttcaggggtgaaaacttaaccagtgtggggattgccttccccaggagcccctttggctctgcagcagcctttgctgtgcagaatttgcagggatgtgggaactcagggaggtgccccgggccctgctctttgggcacttgcctctgccacttcctctcttgagtctcgacaccttcctgtgcattatctggggaaggagggcagaggcctcctctgttctcagatttctcagatcccttctgaacaggggttcagcccagtggggagggcataggacacctgtctcaggaagtcatcagcaacctgggtctgacttccccctttgcctccccttccccactctagggagagcagcccacacagggctcttactcatcatctggtctctctcaaacgggttctttctctcactctatcacattctctgctttctgtttttgagacaatgagcctaggacaataaaaaacgggataaaaggacatattattggaggaaaacgttgcttactatttctaaaatcttctgccccaaagatttcctgacctaccctccatgctcctcctctgagcaaagcagtaattttctcccaacagctgtagactaattcctgctccccctgccccctccctcagaggacgcacactaagaaaacagcattcctttccaggtaaagttgagccccgtgtcactaagtttaagtcccttttctcacaatctgggcactcagccttcatcctgcccaggggcctgggttctggcttttccattcctcctgcccctgcatttggaacacatgagtgactcgcccattgacacggctctatccctgaagctgagaattccttcctctagagtaacttggagttctttctgaaagggtgggatctgctgtcatctgggcctctgagccttctctgtcctcccctgtctcacacacagcactcactttaccagctctgttaattcctaacccaattacaaagggccattccttccgggcacacgtcttaaaatggccagaccctctgactgtctggaactaataatggaaaatgtaggttagatggttattaataggtttttgcacaccgaaagcctcctggggagtagggagcgggcagagggcaaggccttcaaccatacagcaaagtaggcaaggaattgtgcttggggagggtggaaagcctaggcttgtgatggatgcaggttttgcagaggcagagtgagcctgaaggggcctccagcttcctgccacttcctctcggtctcaccccagggcatcctcctgaactggaccaagggtttcaaggcatcagactgcgagggccaagatgtcgtgagtctgttgcgggaagccatcactcgcagacaggtaggagcctgttctaggggtgctttggggctgtggcaggccttgaggggagcaaagagtctcctactttctgaggggggagccctctgcggtagagacctctgggtccagtgctggttgctgtgacgaccgcgttgcccagcaactagcagcatccttttgtgtgcaggcagtggagctgaatgtggttgccattgtcaatgacacggtggggaccatgatgtcctgtggctatgaggacccccgttgcgagataggcctcattgtcggtgaggagggccctgccctttcatgcccctactgcttggcaatttgctgccttctgttgattcctctggttggatgtttccttggcggtggggatgtgggattgctctggtctgacccagtagggctctggaacaatctcttgggctggcagtttggagcttgggtgtatagtccagctcagtgactgactcatggtcatttaagctctctgaacttcactttgcccatctgataaatgaatctgagctttggagttgtacagatttgggtggaaatactagctttgtgtttccacctgtatgaccttgggcaagtcaccagagcctcagtttcctcatctctaagatggagataagagtaacaatgcctgtctcaaggcatcatgaggatgaaatgggaggggacaaaatacagcatggtccctggctcatggtacacacctggtgtttggagctgggcgggggcaggggaccaatgagcaatgagggtccttcagacagtccaagattccatccttattaagcacctaccctgtgtccacaggggactggacagaggaataggaagacacataaaacaagaggcaatttctgccttctcagaaccgaccactcagcaagggttaagcccagaacaacacgtagcggtcagagagtgacttgattctacacgtgggcagcagcgaggccaagatcaggaaggagtgggtcccaggatgagtggaacttgaaagccctgaaagaaaggatttggctctgttggggaggagggatcccacagctcctggggcattggtctctcaacacgaggcatgtggcagcctctcttgagggggaggtttttgaacccagcacctggcacggttaggcacttgggagaggcatgcccaggttgctgtgtgcataaacagctggacagaggagctccaggtggggccagcaaggagcccaccttcctggagctgaagctgtgtcagagaaaggaaggagacgccctcatccagggtgcgtcctctgcctggaatgcctttttctttctgtgcttcttggattcagtcacttcctctctgttgctttcctgatcctgttggcagagactcgccccgtggtctgggctcccacgatgctctccttggtgcttccacgggggcacagaggctctgtcagagctggctattcattgcctgacctctggccagactgtggggctcctcgtctctgatttctctgtgtcccctgctcttggcccagcacctcttagttggattaagggcctggcaggccggtccagggagcttcggcctctcaaccgcagagagctaggggcgagggcgggggatgtcacatgtctcccaggggaatgacaggacagctgggcattgtaggagcacttgggggtggcatggtggatgcactgatggtgatgttggtgggaaaggcagtgaaggtccccagggcttggagctggcagggtctgcacgagggatgtcgggaaggaagaaggaccaggaccagggacaggctgtgagcatgagaggtagagagagtgagcccgaatcgttgccatctcggtatgggaagtgctcagagggtccttgtctacatcagtaagtagcttccacgttgtctggcctctctgcaggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtgtgggctgggcccaggcagtggtggctggctgtgaccggtgctggggatggtggctggtggggccttctgccgagtgcacacatgttcatgcaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaaggtgcctgaggcctacattgcctcccccacttcagggggtctttctgtccactgtgggggattgctggccatgggtggtgacgaggtctgctctggaggatgaagtgggagaagtcacgacccacctccctgtgctctcttccttcctggcccccagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggagaaccggggcctggaagagctggcagtgtctgtgggggtggatggaacgctctacaagctgcacccgcggtgagtctgggtgtgcgggctggggagggaggtgtggccaggtggggctggtggcctgggctcacctcagccctcctctcacagcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacattcacgcccgataaaacccctatgtgccccggcggccgggcaaggctgtgtacataaggccaagagtaagtgcgtgaatgcacttaagacaaagtcaggacacgagcttcacatgacaggccccgcgtggggcaccagccagccctggggacgggcacgccacgccacacacacactcaccactgtacagcctgggactcccattgcatattcacaggccccgccgggcagggcacctcaaggctgggggaggggcaggggcagggaggagccgtggggtgtccctgggtgggtggagagggcagcatgtgagaggcaaatgtgcaccaacactgggcgtgagacgtgagcagcctcaggtgtacggcatgagatgtgtgtggttggggggtgtctgcgtgacccgggaggggggtgtgtgtgagatgagcacacgaggcatgcgtggcacgtgctcgtgtggtggtcgtgtgcctgaatccaggggctaccccctgtccggctgtggccctcggtcctgcaggcttggagcagggcccctcagacgtgcccctacccagcaggcacagaaatgtttgcataaggtccagctcaggcaggagctctggggccctggcccaggcccagtgtgtgcgtgcatggccgtgtgtatgcggggcccctggagagggacgggaggagaggtagcatcacacgcacatacacacacacagatgggctgggcctggcccaggctccaggcactgtccctcctgggccctggggccgagtgtgagtggcagtgccagcctggctaggcaggccatggagaggtgggagttcgggcagggtctgaaggaccagcattaagggacagcttcggccgggagggggcctgtccgagcagctctccccggtgtggggaagggcccctgtccggcttctgcctgtccttggtgggtgccaaagctggtgagagtgtaggtgtcgggcctggccggcctcagcactcagcctccgacactgtgaagaggccagcgtctggctggcccagtccagccactgctgcagccagctggctgaggttgccgttggggaagtgccgcgcctcccacaggttgaggatcatggctgtggggctgggcttggaggcaaagaagctgagatggctgtggaggggaggggggccgtcagcagcctggcctggccccagctgacacctcctgccccccctggcccaccccagggcagggcctccccgaagccaaacacaatgactgccccggccactagtagatgcggcacaggccccacagggcctcctgtccacctcacccaccccgccgccgggcaggactgtcggtggcctgcgcaggccctctctgcccctctcccgcccacctgtccaggtggagtttctgggccagagtccgccagtcggcaccccgcctacagggtgggtccaggctggaaattatcttctgccgaatgaggaaggggatcttgaaggcactggggcccaccagggctgggacccccgcttcactctccagagccagcagctcagcaaaccttgtgtcctggaggtgggagggaaagaggtgcctgttagaactttccccaggcccgggtccaccgccacctcctgctgggggagctcccagactcccccagagcatgggggcggcatgagcactggtacttcctgggcacctcccatgtgccaaggcccttcttactggggctcggaggtgcagcgacctgcccaaagccacatagccagagagcagaggagccctctgtggcctccctccctctccgcccttctcccctccaagtcactctgcccagcctctgctgacactcaacacacacagctctcttcacggcctgagtcccccctgcccagctctcaccgccagaaatgctcttccccttaatgccgcagccaaactggctcattctttggggcccagtacaaagcccctcctcagggaagccctccagggtctcccctcctgc

SEQ ID NO: 16777 - DNA, 9364 bp, Human
cctactgaacctgaatctccagaggtggggtcctcccactctgcactgaagtttgagaaccactgctctgtactatagaccagcatcttgtgccctcccacggtggtaatgggaccctgggcccaataggcaacacgtgcgatagtaagatcactggctgcagagacacctctccttcctcaaagacagcacatgtttatacagcccatatcacatgctggcccatgttctagatgctgtggatatatttttatttgattttcttttattgagacggagctttgctcttgtcacccgggctggagggcaatgccacaatctcagctcactgcaacctctgcctcctgggttcaagcgattctcctgcctcagcctcccgagtagctgggattacaggcatccacaaccacatccagctaatttttttttttttttgtatttttagtagagactgggtttcaccatgttggccaggctggtctcgaactcctgacctcaggtgatccacccatctcggcctcccaaagtgctgggattacaggcgtgagccaccgtgtccagccaatgctgtgaatatattaaactgacttgatctttacatcaagatggaagcaaatggtttgcctccatttgtaaataggcattatctcctatttacagattacagatggaggcaaacaagttaactaacttgcccaaagttacacagctagtaagtggcagagactaaagtctgttcctacccaccatgctatgcacacctggctcacccagcaggggctgggggaggagggaaccaggggctgctggaaggtacctgccataagtcccagtacttagtggttggcacaggatggaaggggagccaggggcagactgaggaaaaccctgaccaagtagaacctggccggggatgcccaggtggaggagaacgcagttccagctcctgggagtcgggcccagaactgtcccctgggaatcctcactgggctcttctgactttctctgttgggtctcttataggttctggctgtgtcagatggaggtaagtgacagaatgtgtggagaactggctgagtgggagggaggagggaggtggagatgggtggggacacccctgccacctgctatctttccagggaacatggctgcagagtggatgcatgggggagggtgggttgtgccaggggctggggaaggcaagcaaggctcaccccaacttgtccatccccctgcagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgtaagcctggggtagggaaagggaaggggggacacgggagagggcagggcgtggatggagcttcaggctggccagagtggggtcctctgtcagcttcctcatctagccttcctgcagcaccctcttcctcttctcccagctgggaacttttcttccttctccctgtccttgtctctgcctctcattttctctccctgtcttcagatcggtctggctccgtctgtctgtctggccctgtctgtctggcttggtctcttggccctgtctctgtcccaatctttttgatcacatcccccagtttggtctctgtgtctctgagtctctgcctgcctccccctccttcccctcccaggagttcctgaagaaggagttcagcgcggaaaacgtgactttctggaaggcctgcgagcgcttccagcagatcccggccagcgatacccagcaggtgggggaagggggagctggggccgagggctggggagaggggaactgggccacgctccctgaccaactcctcctgtccctcctccttcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcaggtgggcgatcctggggggattggccttgaaagggagacaaaaggagcaggggcggggtcggaccctggcggggagtctgaactacaaagcggagggggcaaatttggaggcggagacagagccaaatgccggggcaggcagggcggagctcagagagcggtatcagaggcacggggaaggacagttagaggcggagcctagctgagctcggggcgggcttggaccccgggggtgggtataggaactgaggtcggggcggggcttgggaaatccagccctaggtttggggcggggccagccccaaggacccggcctgggtgcaggcagcccagcgcccccaccccagccccggctcacctgttccggggtcgccccgcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaaggtgcgtgggactgggcgagggactgggcgaggcagggggtcctgcggaccgcgtgcaagaggggacgcctccgggtgcagatctgcgagtctgtgcccacggtctgcatgcgggctggggcccagcccggtgccagcgcctcccctgtacccacagaagccgaagctgaagcccgggaagtcgctgccgctgggtgtggaggagttggggcagctgccacccgttgagggtcctgggggccgccctctccgcaagtccttccgccggggtgagggcaggagcgagcaacagagatgtggggaaggcgggagtttggttaaatttggggagtgcccccttcctcctacgtggcccacagtctgtaagtctgtgaaaattgaaacccaggtcccagtgaccaccacactcccctgggtggttcgggtcttgggctagacctcagacgtttggaaatctccaacggtggtgtcgctcccagggatttacacctgggcccctgcaggatggctccaaacaaggcccaccagtggggaacaggcttccgcagaggatgggtgagggcggggggctgttcgcgttcatcgctccctcttcactagagctgggcgggactgcaaacgccgccttgcgccgagagtctcagggctccctcaactcctccgccagcctggaccttggcttcctagccttcgtcagcagcaaatctgaggtgagccgactgttggggaagacaagatgctctatgggctagagtcactactcaggcccatttacgtggtggccctcattccaagttgctgtccttactgcgtctcccagcttgctctgcgtagccaacccttcagcctccttacttgtctcactacattggtccccatatatgtcatgggtacacatcctcagttggcaaatgtgtgcacatgtgcagcacccaggtgtgtatacacagcacgtgtgtgggaatcagcgggtggacccgtctctaggtgcccatatgcctgggtgtgcatacatgtgttcctgcaggaggacgtatctttgcctgccttgggagtgcgtgtgcatgcttgagccccagcaagcttacctatctctgtgtacctgtgtgcatgcccttgcatgtgtacacataatctcccccactcctgccatgaatcagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacaggtgggaacgtgacctggctccaactctaacctccttcctgatcctgaccccaactccatttctgtctctgctcagtcatggctccaaccccaattcaagttctaaacccaactccaaagcaccctcagcaccaactttcactcactcagacatccacccaccccccacctcatgtccttccaggtttccaccttcatccatcatcctattgtggtgaccttagggaggtaaaactggagagaaccactgttggagctggggtttgcccctcatcattcccagagtccagactcccatccccacagacccatcctggaaatggccatccgtggggtgccctcacctccttagcctctaggggcacccaagtgcacctaaccaatgaactttttcctttaggtgcaaactagcttaaactttaaagaagacctaggggaaaactggctttaaaggaaaccattcagtcaggggaatctcaaggaagaatgctaccttccagggggccatcgggatttcatttacctagtagacaagtcctaaggccttgccaggtgtgtgggggagaggaacctagatctggggctgtcctcctggcccacaggctgaaagtaagccaagcagggagtgatcagggaggaggaagagtgaaaactccagagaaggtctcttgggagagggtaggcatttctggctggtgtccggaaggcttcatggaagaagcagcagtagatgtggatgggcagagctgtgggggaggatattccaggcagagggaacagcttaggcaaaggcctgcaggtgggtacttgcggggcatgttcaggggcctggagtgcaggggtgcgagggcagtagtgggaggcattttgcccactcttctcaggccgctagggcggctgccagcagcccagatgggctttcatacatgctaaatataacttcctcacccacactccacctgctcctgcagcacagcataagcctactgcctgggagatgctgcccccaacccccacatcaggctggagcaggcagtggggcctctgaaggtggtcatcacgagagttactgtttatgtacctactgtgtgccaggcattgtgccagatgcttcacatcctctggtttcacagcagttttgagggtgggccctttttgaatgaggaaacaagaagtgtccttagtagcggggaatggagagaagtggacaaatgtcaaaaatgggaccaggccagggtggttggtcaaaggtgggtggtgagggaggaaatgcttccagctggtctggtcggatttcacacacctgagggacacgagacagctgtcctggaggcagagcctgtcctggcacagaaagagtaggccagagatcccggatctaggcctgccccttatcatttcatgccagcagctacgtttctcataatttctgtcctttcccaagaatgtccagcattcttgccacttttctccctggccttggctttcctgggcttggactccagcttggtaccttaacccatttgctcccctacagctcttccaccctccatcccttcctctaggaagcccagtggtggccatgggagggcgtgaagttgttctcagacccacagggatggctgggggttgggggagggactcttagaccctgcctggcatccacagaaggccctggtcctggatcaggactgcaccgtgctggcggatcaggaagtgcggctggaaaacaggatcaccttcgagtgagtgtcctgcccccaagtctgggtcccaggtcctgacgctcccttcaggccctgttctagctacctggctccccaggccccgcccctcgtgctagccccgcccctgggacaaaccccgccccctacaagccagtcccaccttctgcagttcaagctccaccccctcgcgtttgtcctgggaagggtttggcggggggccggccctccggccctctgctgcccgagggttcctcgcaggctggagctgacggcgctggagcgcgtggtacgaatctcagccaagcccaccaagcggctgcaggaggcgctgcagcccattctggagaagcacggcttgagcccgctagaggtggtgctgcaccgggtgagcttccgggccgcggggcggggcggggcggggccgggccggggccggggccggggccggggccggggccggggccggggccggggccgggcggaggcctgtaccgcgggctgctgacctctccccacagccaggcgagaaacagcctctggatctggggaagctagtgagctcggtggcggcccagaagactggttttggacactcttccaggtaggggacgctggcctcggggcttgatctggaacagctgtggcccaggaaggcaaggggatccaggtgggaggcaaacactaactgtggccctctctgctgcaggtgtgaagatctccaaagcccgtgcacaaatctccctgccgcagccaggtgagcgaaaggcgagtggcctcttccaccctctgcttctcccctcccgattttggctctgaccccaaattctcgcagggctgcccacctagaactcaggataaggccacccatccccctccagcgtcccccagttctctggtgaaggtgcccagtagtgccactggaaagcggcagacctgtgacatcgaaggtacatggtggatgagctggggatcagaaagactagggcagtggggttggggaccattcagggtggcatcagagagccttgagctaaggcagggggctgggtgccactgggcgtggaacaggaaggatgggggttggggggtcaaaggggctggaacagggggccgcaggccattggtgctggggccagggaggcagtggccacagtaaggcagtgggactatcgtgggctggcatataggcaggtctgctggggggaccctcatgctgtggcttgcctccaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgcagccaggccacaatgggggaggtgagtccagccccttggaacaggcttgcccaacatggagggatggcgttggcagtgccagcctccccagcctgtgccaagcttcaacaggggcaagaggaggggccggcccctcctcaggaagctggtatgagtaaggccttgagggtgcaggcaggcagccctgtaccccacccacatagactatactgtacatacagattttgcagtaggcttggggcagctgggtttgtccttgatgtatgatactgttattataataattattattattctgccatgagttgtcttccttgtgtgccagactgtcctgtggcttcccccaccctcaaaacacactacttctgtcaccaaggtcagtgccaggaaactcttggggacctcaggatgtgcctcctgacttcctgttttcagaacctctcttcctgactgcacagtatatggggtggtgtgtgaatatcttatagtatttttttttttaagaatatgggagctgggtgaggtggctcacacctgtaatcccagcactttgggagaccaaggggggtgggggtggatcgcttgagctcaggagtttgagaccagtctgggcaacatgtcaaaactctgtctctaccaaaaatacaaaaaattacctgggtgtggtggtgcatgcctgtggtcccagctactcgggagacaggtggaagaggatcacttgagcccggaaggcgaaggttgcagtgagccgagattgtgccaccgcactccagcctggatgacagagtgagacctgtcatggtgtggaggtgagagagagggcggggagaggtgtgggggtgaagaaccctgtggggagctgtgcctctccatcatgttgctgttgtactgtggtctctgtggatctgagtacatcattctggtcctgttctctgcttctactggggactgagtgtctctgcacacataactggagaatcctttgagggcaccaaaggtctataagggggacactgattgttgtagcaggggcaggttctctctcttttttttttttgagacagagtctccctctgtcgcccaggctagagtgcagtggcgcgatcttggccatcttggctcactgcaagcttcgcctccagggttcacgccattctcctgcctcagcctcctgagtagctgggactacaggcccccgccaccgtgcccagctaattttttgtatttttagtagagacggggtttcaccgtgttagccaggatggtctcgatctcctgaccttgtgagccgcctgcctcggtctcctaaagtgttgggattacaggcgtgagccaccgcacctggcccctcaggggcaggttctcactcttacctgctttagctgggtggtctagctggaagtccaaacccctcactgtgggaggcaaggaggacctcccagaaggagggccccagactgcggggagagaagccagactgggttccagcccagagaggtaagtgctgcaacaggaagctagggggtgtaggggccaggagaaggcacctgagagagtgaggggtgtctcctgactgcctcaaacaggtcacgttgccttccccattggaatctttgcactcgctgtctcctctgccaggaactccccttacctgccccgtgcgcagtcaactggctcctcctcctcctggaaatctgtggggtttgccagccaccctgtcccactatgggagcttcacacctctgccccctcagcccattttgtttggctggcataaccggatccctggcaagcctggctgatcagaatactccattccactggccaatcagagtactccattccactagccaatcagagtagtacctttccctggccagaatttggttcagacatagtcctctgacctcaggtgttccaatcagagtcccagtcccggtcattttctaccgtctcctggggtttgtagaaaggacccttagggagcgaacctgcatgtga

SEQ ID NO: 16778 - DNA, 15236 bp, Human
gattaatgtttggggagaagtgtgtgtgaatcagtgaccttcaaataattttgtattcttgaggcaattattatgtgacaaataataaaaaggtaaactgaaatagaaaggagaggatgaggtttatacattagttgagtcaggaggcatttgtggtacattggaaaaaacgggactaacagaagacttgggtttgaatttgggctcagttaaaaacttccattgtgtgatgttaggcaagtcacttcatttttctgatcttctttcctcattccttatatgttgtaacaactactcaagacttgtgaggaaaaggggaaatgatttttaaaaaatcaattctttatttacgtaacaagttggttatgtccactgcattgtgtgaaacattacagtatcatataggaaagtactgtcagtacagtgttggatcacaggattttttgagagtgccttatgagttagtctcatcattgagggccaacacatatactttggatagaaagaataaaatcctcaaagtgaaattttgattaatatcctctacccatttataggtacaccttattttaaccaaagagtatatgtgaaggacctaaccatcaaagcagaaaaataaggagatctttgtgaagtttatgaagagttcatgggccaggcgcagtagttcacgcctgtaatcccagcactttgggaggcctaggcaagcgaatcacctgaggtcaggagttcgagatgagcctggtcaacgtggtgaagccccgtctctaccaaaaatacaaaaattagccaggtgtggtggtgggcacctgtaatcccagctacttgggaggctgaggcaggaaaatagcttgaacctggggggcggaggttgcagtgagctgagatctcgccattgcacttcagcctgggtgacagagcaaggctccgtctcaaaaaaaaaaaaaaaaaaagttcatggaagttttaagtatctagtaatcatttaaaaattatttgagttaaaagtaatcgagtctctgattttttttgtttttttgttttttgagacagagttttgttctcattgtccagactggagtgcagtggcacaatctcagctcactgcaacctccacctcccaggttcaagcaattctcctgcctcagcctcccaagtagctgggattacaggcatgcgccaccatgcctggctaattttgtatttttagtagagacggggtttctccatgttggccaggctggtcttgaactcccgacctcaggtgatctgcccgcctcagcctcccaaagtgctaggattacaggcatcagccaccacacctggctcaagtctctgattttttttttttttttttttttttgaggcagagttttgctcttgttgcccaggctggagtgcaatggtgccatcttggctcatcacaacctctacctcccgggttcaagcgattctcctgcctcagcttcctgagtagctgggattacaggcatgcaccaccacacctggctaattgtgtatttttagtagcgacggggtttctccatgttgatcaggctggtctcaaactcccgacctcaggtgatctgcctgcctcagcctcccaaagtgctaggattacaggcatcagccaccacacccggctcgagtctctgatttttaaaactcttcataatacccctttatccaattcttcatagatggtaataacgtataattggtgacatttcacatcgctttgggcttataaagaatgtattttgacttcaggcatttgtgtttactgtgccatcagcctctagttcattttacttattcttttcttctccaggtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggtaagattgtggcatggtctactttttggattgatttctaggtaaaatcccattaaaaaattctcttagcacaaagccatttattctgtatttggagtcatcctgccaatcctggtttgaattgggttgggttagttacagcagattttttcaagaacattttgtgaaatttggggactgtagagatatctagtactgttttctctgtgttctttctacatttattgacaggtttttttggtcaaacattcagtaatgataattaacatttattgaccacgatatgcacttagcattataacaaacaatgttacacattatgcaacgagcagtgtttgtgcttaaggtcacaaatacaaaaaccctatgaggtgtagctaccattatttccctcttaccaatgaggaaacaggttcagagccatttagtaatttgcctaatggcacatagtatgtggtggaactaatgtacttgcctaggtgtctgacactaaaaaccattctgtatgtacttcagatattctaaccacctttgatgaaaaggcacccccagactacttcgttgtaataatcgtatacaagggtccagaaacttgggtgaaggaaaggtggtagaggtagtatttttatgtcagatccttaatattttttctattggtaggagaaaaaactctttgtacttctttgagcaagcatttgaacataagtttttttttttttttgggagatggagtctcgctcttcgccaggctggagtgcagtggcactatctcggctcactgcaagttccccctcccgggttcacgccattctcctgcctcagcctccctgatagctgggactacaggcacctgccaccactcccggctaattttttgtatttctagtagagacgggatttcaccatgttagccaggatggtcttgatctcctgaccttgtgatctgtcacctcggcctcccaaagtgctgggattacaggcatgagccaccgtgcccagcccttttttttttttttttttttgagacggagtgcagtggcacgatcttggctcactgcaacctgcacctcccaggtttaagcgattctcctgcctcagctcccaagtagctgggactacaggcgcgcgccaccacacccagctaatttttgtatttttagtagagacgaagtttcaccgtgttggccaggatggtcttgatctcttgacctcgtgatccgccttcctcggcctcccaaaatgctgggattacaggcgtgagccactgtgcctgaccagaacataagctttttaatcattcttgggttgttgagtttaaatgatttttcttgctgtatttatggagtagagttagaaaggtgggtgaactcttagtgattttcattttatagatgggaaaactgagaccaaaagaggatttgacttgcttaaggtcacaaataccataaaaaattttatcgcaacttttcaatgaatggctattacagagtttattttaatgggattttatttgtattttgaaacatttttaaaattcctgacaatacttctacctttcttgagtctgtattataagaaggcctttttgtgaaaaatgaagtcctttagcaattaaaataattttacactttagataactaaatgatggacccttcttataggatatcactgtgcctgcttatttatacttataattccctgagcttcttaactttgtatacacagcgtacaagttgattctacgcctgtatgccctcagattgttcagtcacctttaagcctggctgaattatgtggtactattttcaacctgtggattccttggccatagtctccagaagtggcacaggccactgtcctcctgcaactataaaaaagatattggtagccccttgaagataggtagtcactgggttagggattcaccgtagggagagttttaaaggagcaaggcttctggctataactgcattagctgtctttttaatataccactttttttcttaatttcagaattttatttctttaaaaaaagcatgtttatttcataaaaatataaagatacagataagcaaaaagaatttaacaacatttaattgttaataactggcttctagatgtttttctctgcatatatctgtgtgtattcataaatacacatacagataggatcacactatatattttttaaaatctttccccatcttccttggtattgtttttatagctgtcatagtgttcactatatggatgtgccatacttctttaatcattcccttatttttggaccattaatgtggtttctaatttttcaccattccagtttgtggtgaatgtgctgttacctaaatatttgtatatgtctttaattatttcttttgtataaactcccagaagtagaatttttaggttgcagtgtatgtgaacttttgtgtaagttttcacgttatgctaccaaactgccctttagaaaggtgagtctcacactgccactgagatttcatgagtgtccattgaatatataaccacagtgagaacaattctgatctttgtctaaaaatgatatctcattgttttaatttataatagtagatttctttttttttttttttttttttttttttggagacggagtctcgctctgtcgcccaggctggagtgcagtggcacgatctcggctcactgcaatatctgcctcctgggttcaagcgattctcctgcctcagcctcctgagtagctgggattacaggcccgcaccaccacactcagctgatctttgtatttttaatagagacggggtttcactatgttggtcaggctggtctcgaactccttaccttgtgatatgcccgcctcaggcctcccaaagtgctgggattataggcgtgaaccaccccgcccggcctataatagtacatttctacatttttggctgtaggtttcaaaaacaagttccattataattttttttttttttaaaggaacttaagaagtatggagtgacgactttggttcgagtttgtgatgctacatatgataaagctccagttgaaaaagaaggaatccacgttctagtgagtgtgtagtatttaaatttttcaaaacaagttgtatctttcaaacataaatatttataaaactaggccaggtgcactggctcacacctataatcccaatattgtgggaagatcacttgaacccaggagttcaagaccagcctgggcaatgtggcgagatctcatctgtacagataattaaaaaactggtggggcatgttggtgcacacctgtggtcccagctacttgggtttttgaggtgagggaatcacttgagcccaggtggttgagactgcagtgagctgtggccacaccaccacattccagcctgggtgacagagggaaaccccgtctcaaaaaaaaaaaaaaaaaaaaattaaaaacttggtattaggtgggcacggtggcacacatttgtagtcccagctacttgggaggctgaagtgagaggatcgcctgagcctgggaggtcaaggttgcagtgagccttgattatgccactgcactccagcctggatgagagtaagaccttgtctcaaaaacaaaaacaaaaaaaccctggcagtaatacttttggatttttttaaggttgtagtggaaaatacattattgatagcaatctttcaaattcttttggattaacaaattggcagttttgttcatttgtgctcttaaagcctacaaatcatagtattttcaactaataaaaagcaaaatttagtgtgctcttattttaacaacatgtaaatttgcaagttttattttttaggaaattaatacaatatttagcttttgtttctaggctactaatttgaatataatgaaagtaatttccatcagacattcttaagtccatatggaactctgccactttgcaagtacaagattagttacttaatattttgtggataacttgtaggaggcaaaaaggtgggataagaggatgaggagaggtagaaggcatcctcctccagagtaatcagcatagtttctgatactttttgttaggtttctgaggagctttagtatgattagattttttgtctagctcaatttgagcacaaagtgattggaattattttaaattaagttcctttttagcatcaaaataggctgtttccttatagcaaatgggagcatcagattagttaacattttattctttcttccctaagtagttgtctaagttgtaggagcagcttttaggagcacgtaatgaaatgatcttgtaattttagatgtctttgagctgttggtttgattgtgggaaggttatgtagtaggaagagaactggagattttataagtagttaggaagaacgtaacaaggaagatactggtttaaggttatgttcctgcttcttattgagaggtagttctgtagtctttattatattggtcagtggttgggaaggcagttgatgcaaaaagaataatgacctattggtaaggcagtcctcttatatctgatccatagtttcctcatgtccattttggtgaaaataaaaactaaatagccaaatgtgttttaaaaaaatgtgttttagggccctgtgtggtggctcatgcctgttcccaccactctgggaggccaaggtaggtggatcacttgagtccaggagttccaagactagtggggcaacatggtgaaaccctgtctctccgaaaaatacaaaaattagctggacgtgatggcatgcacctatagtcctagctacttgggaggttgaggtgggaggatcacctgaacccgagaggtcaaggctgcagtgagccatgattgtgctgctgtgctccagcttgggtgacagagaccttgtcagtcaatcagtcaataatgtgttttaatagtttggcatggtaataatttgcttgcagtcaaatttctaaatgactttactgtccactgctggaaatcactgggaatgagtgtaaacatgtcaaatgcagccctgtgtttaaaaagtagtaataaaatttaaacttccgaaaataagctgcatacaagtttattttgctgcattatgaatatgttctctagtgagcaaaaatcaacttgttttgacagatggcagagtgagaaaatgactggattgaccatagtctgtttgagtcagtaatgttggtaaacatctttgtgaaatagaaatgaactaaagaacttgaactagtttgaggaagataatggtaggcctaagatttattccaggcctttaaatttaggtttttgttttgttttaaatagctgtgatctgggaaatgcaaatcaaaagcacaatatgataccaccttactcctgtaagaatggccgtaatcaaaaaattaaaaaaaaaaatagatgttgtcagggatgtggtgaaaagggaacacttgtacactgctggtgggaatgtaaactagtacaaccactatagaaaacagcgtggagattccttaaagaactaaaagtagaactatcatttgatccagcaatcccattactgggtatctacccagaggaaaataagtcattaaaaacaaacaaacaaacaaataaataaatagctatgatcagataaaatgaaaggtttaacttacacttgaaaaaacaagggcatttagccttaagcttggaatttccttttcccagacagagattttaagagttaatctaattttgctaggtgaggagggttttggaacatttcatggtaagaggatatccccaaataaggcctgtcagtcctctgaatgctcttgcaaaccagacacacattggaatagactaatggtggttttagctgtatcaatttgaggttcagatgtttctaaatgattaatgatttttttaaaaatagacactacttatatgagtaagtgaagcatgttttatattgtttcttaactaggtgcattttagggagtattagaggaagtaagctcttgactaaggtactggttttattgctatttacagttaaactctctagtgacatttataataacacagtcctttaattatggggcgtagttgtcaactcaatcatgtactgttttggctaatgggctacatgaagtgttctagtggtgccaataatgaatgcagaatcaatttaatgctctgtcacttttctctttttcctcccctaatatcttaaagtgtccttatccaatctcattagaatagccttatgtttttaaaaaaattcctaacagtgtttttgcatttctatctttgaagcttagatggcaggagggaaggcttgtaaaatgtcagcccccagtccccctcctccactccccatttgtgttggtttcttaggacctcttgctaagtagtgaggaagataaacccctgcctatactgtgaatgctcgtgggattagtcttaattgaaagatagcccaaataggtgaatacagaaagagaaagggatacttgacaaaatggtctccatttgcccaggaccctgtcatgcagccctgtccttgttaaatggggacatatataatttagtaagcactttaaaaatactcactgcttgccttttaataagcacaaagatggtagtttgtttctgttatgatttactaactattggagatttcttatcagataacctttctctaaagatgtcataacttagttatcttgaattataatcttcaattatctgtagagaccaatgagacaccagttggtatgctttgccagagtggacttttaaatcatgttgacatgtgctgtgtcctctgttactttgtcttggctttaattacagttttgtctattatgtctaattactactctattcagatatcatttttgggagaacactagctcttatgactctgatagagatttctgtaagtttttgtaaattcagatgtgtgcgacactgcattgagaagggtaatttatttggcaaactttaatttcaatcctggatcattttacagcaatgatcagaattgtgttaacaataggtatatatagtgcagttagttcagttaggcctgccgtgtgtactgtgtgcaggtattctgtattaggatgttaatcatggagaaaatatcaatttaatgtaaaaggtcatttcttttcaggattggccatttgatgatggagctccaccccctaatcagatagtagatgattggttaaacctgttaaaaaccaaatttcgtgaagagccaggttgctgtgttgcagtgcattgtgttgcaggattgggaaggtaaactcttacctttattaccctttttgtctgaattcattaccatgcctaagttagttgaaagtttcactttggtagacatttgcatatattatactaaataacattaaattacctgaaaggaaaggaaatgagaggaaaaactagtgtaatgatttctcaaaagagcctgttcatttcatctggttgtctgattctgatgccagcctggattgtgggtgttttatttttctccctatttcaagtaatcaaaagttcaggtcactgaaattggcaacaaaattaaaataattttagagtttgatgaatctatacatggttaattttggactgagatgaatgggaagttaatagatagcagatatctgaactttaaactcttgaaagaagatgtatggacaagaattgactttgatcttaaaaccttttcccctgagcattgcttagaatggtgttgcaacgctgtcatcagcagcagattaaatgccaatttaggatgcacactttgactcaaaacattagtgtaggctgccattgcctcaaggtggtgattactcaagctgttagttctgctctgcccttttgtttgctatttccttttttgtagtgtggtactgtttgttcataaggttagaagttttagtccttatcctgaaggttgaagataatgttgtaacgtgagttggcagttttataactagtagctatcctagttttaggtagcccaaaattggtgccctgtaatgggctttataaaaacatcatttcctttgttaaatttttttaaaaagatagaacttcttctagtcatcaattcttgggcattttcctagctcatcaaaaggattttcttgaaaacgtctagcacctttttagcatttgataaggaaatattaaaatcaattggtaatgaaaattctgacacattggagataagtaatatgtttggtcatttattttactgtgataatggctaaaggccaatgaaggatttttgatcatatctagtgatgagagaatttaatatataatgtgatgttttaaagagtaaagatttcttaaggtttagaatttagtgctttactaaaagtagataatcaggctgggcgctatggttcacgcctgtaatcccagcactttgggaggcggaggcaggcagattgcttgagcctaggagttcaagagcagactgggtaacacggagaaaccccgtctctactaactattaaaaatcaaaaattagctgggcatggtggcgggcacctatagtccgagctatttgaggaactgaggcaggaggatcacctgagctttgggaggttgaggctgcggtgagccgtgattgtgccactgcactctggcctgggtgatagagcgagaccctgtcccctgccccgccaaaaaaaaaaatcatagaattaatgatgatgagatatatttactgtattaggcagataccagctactttagtatacaggaaaaagaaagctcatgcgttgcattggtaatatgcagttacaggtttttaaaaatcctttcactccaagacttatggatacttacatacaggtttctttctgcagggcacctgtgctggttgcacttgctttgattgaatgtggaatgaagtacgaagatgcagttcagtttataagacagtgagtatgaagtttttgtgttcagaaacacagaaagcaagatcatgcatgaggaaggaattatggaagggatattcatttatagtatgggataatttgctttttttggcttgaagtattatttgaagatgtaaaaaatttagagcaagtgatagagactcagtacagctggtttccagattcaaaagttttctaatttggacattatagactgtgtccagtatattgttttgagtatctaggaatctcaaaaatgccccttttaatagattccaaataccttccaaatataattctctgttaggaggaggcaagaagaatgtgtagaggagcagttaatcacctgagactcttttttttttttttgagatggagtctcgctctgttgctcaagctggagtgcagtggctcaatctcggctcactgcaacctctgcctcctgggttcaagcgattctactgcctcagcctctcaagtagctgggactacaggcacgcaccaccacgcccagctaatttttgtatttttagtagacggggtttcaccatgttggccaggatgatctcaatctcctgatctcgtgatccgcccacctcggcctcccaaagtgctgggattacaggcgtgagccaccacgcctggcctcacctgggactcttaagtgatctattcagggacaaaatcaggatggtagtgcacagacaggatcttgacattgatctggaataacgaatcatgctattttgttatccagaattctttgacaatttttgtcttgccctttccctttcaacccttcctttaaaaaaagaaaacgaaagtagaaactattctgatctttattaaatggttaatagactataatgacagtcagcaagaaaaatttttctattccttctaggagggcttagaaagttcatgttgcaacttagctctttaagaattgttgtagtatgggaaatatgctggttttcagctgtgtggaattagaaaggctttaggatgtaaataatgcatttcagtgaatcagacagctctttttttacatgataaagtttgccattcttgtattttcagaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaaacaaaaaacaacaccaaaaaaacagcagtgatatatatatatatatatatatatatatatatatatatatatatatatatatatatatatatatataatataatatatatatatatatatatattttccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctctttgtgcatttttttcctccatcctcaagagtttatgtctgtgcttataaagcggagtttaagctgggtgcagtggctcatgcctataatcccagcacttcggaaggccaaggcaggcggatcacttgagccccaggagttcaagaccagcctgggtaatgtgttgagtc

SEQ ID NO: 16779 - DNA, 13451 bp, Human
  misc_feature (1)...(13451): n = A,T,C or G
ccttggcctcccaaagtgctgggattacaggcgtgagtcaccatgcccagtcgagcataaacttttaatatatggcttcaaatccttctgcactgacatcctgtgggacttgagaggtgaaattgcacaaagttttgcaacttcattttctaagataatcatatctgctttacagagtcatgattggaattaaataatgtgtaagactagtgcagtatctgacgtagtagagggcagtcacaaatgtcaagagaaaggaaatttatgtatatggagctctgactgtgtgccaggcactctcctagatgtttcccattcattaaatttaatcctcacaatgctatgaagccaactatataaaaccaaggctcaaatgggtgacttgctcatggtcaggtaggtagcacacagtggaagcaagaatgtgaaagccagcacttggcacagcaaaatgaaccttccttcttcctccgctggtcacacatgactgccaggcttcaaaccaactccagtgcctagcaacatactcataaccagcacactgtgcccctcttgttcagagaagaggatagtaagagggaactagagctagtcagccctctctcactgatgggaatgaggtgtttcaagctccaccccgccccccccaatcactcttccaggtggcctcaaacactaagcagaacagttccaagccaggacccacctgtcgatgccaaggtgaggtaatagagaagggatccacactggttgaggagaaagggcatcaggtactggaaagaggagaaacctgcagtcagtgtgatggcctgactgagcagcactgccttctttgagctcctagcgaatgtctttccttggagggaggcagggttataaggacccagagaacactaatccctctaaggaggatccttccagggcaaagagggaaacagactgaagtctgtgcctttgctcaaactaccctctccctcacctctgctagttcccatcctgcaaggccttgaagccaatgtcagcccctccaggaagccttccccaagtcctccagctccagccttcctcctctgaactcctcccctgcagggccaatttgagccccaagccctccctctggaaaggctcacaaatgttgccttatgtaactgaaggaatcacaataaaatgtgaataatggcagccatagattgagcacttactatgttctaggcctaatgctaagtgctctacgtatctcacctaattcctgcaactgacctatcagatggttattattataatcgccatttacagatgatgaaactgaggctcaaggacaactgacttttccgagaatttctagtgagtaagtggtggggctgacccagacctgtttgactccaaagaccaaattcttggcggcaactccaccgagagaggggcctttcacagagacgcacctcagtattcaagaagagggtcttcatctcctgtagcaactgctgggcccaggtcggctcatgaacccgctgcaggccggcggaggcccgcttcagcagcggctgcgtgccaccccacagagcggccaccagcaccagagccaacacctgccctgaatgcagacgagtgagtcaccctgacccccaccccaaacggccgcccaccccgccctctcctggccttctagccccagctagccgcccccacttccctccttcgctctcttcgcctcggctgcgactggcggctaaggcaggcccagggaagctagggagatgaatccaggagtccggcctctggggttgtagcaggggtcggggttagagggtggatgtggagcaggaaatgaattcgaggcgagggtcgggaaatccatggaagggcggggccggctacctacccagagacgccgccatggcaacgccgctgtcttctacttccgggaacgaaggggcggagacccataatccggaagtgacctcgaaaccttttccggtcttactcacgttgcggccttcctcgcgtcacagccgggatggtgagtttcagagttaggggtattgcagtgggggtcctgggctgaggctggggcccaattccgagcactgacgttactgtcttgtccccacagaagccgatcctactgcagggccatgagcggtccattacgcagattaagtataaccgcgaaggagacctcctctttactgtggccaaggaccctgtgagtgttggctggagggggtccgggaggggcgggatccttctgccaggacgatgggtggacacgccagttttgccgttagcggggaaccaaagagcagcccattgtgagaagtagggagaggccatgccgggggtaggttggcgaaagtattctaccgggaaaggtggggaagaactctattggccgagtgcggtggctcacgcctgtaatcccagcactttgagaggccgaggtgggagggtcgcttgagcccaggagttggagaccagcctgagcaacgtagtaagacccatctctacacacaaaaaaattagcctgacatggtggcctcgcgcctgtggtctcagctacttcggagtctgaaacgagaggatcgcttgagcgcggtgagctgagatcgtgccactgcactccaagaaaagcaagagaccactgtggaaaggggataaagatgagggtcagcttgcccagagaacgggatgcgacctttagggataatctaatctttctaccaggataggtgcaggctgtgttattcagacacagggaacttaatgagggtgtctctagtctcattttaagtcaatcccatcctgctactcaatgccaaacaatccctcatgatactgccttttgaggcacctggccattttattttattttttcttgagacggagtctcgctctgtcgcctaggctggagtgcagtggcgcgatctcgactcactgcaacctctgcctcccaggttcaagcgattctcctgcctcaacctccctagtagctgggactacaggctcgtgccaccatgcccagctaattttttgtatctttagtagagatggggtttcaccatgttggacaggcttgtcttgaactcctgacctcaggtgatccgcctgcctcggcctcccaaagtgctaggattacaggcatgagtcaccacacccggcctggccattttcaagatgagaaaactgaagttcagaggagagaagcactgtatttgagatcatatagtgagacagtggcagagcaggcaccagaacccagacttccttactaccagctgctcccacttggataagacatcagagatactgtttttctggactggagctcaacttggccttttattctttggagccgttgggagtcccaggagagctggagctaacaaatgaggatgcctttacaagccgcctgactcctctgttgcttcccttcaggaagggaggagaatccaggagttggtctttttaccagctccctgctgtttcccaagaaataaacagaagagggcagaatcagccttgctacaggctgctgagggttcctggggcaaaataggaagccattgctcttactgggatgtgtactatcctgtggtttgacttttccagatcgtcaatgtatggtactctgtgaatggtgagaggctgggcacctacatgggccataccggagctgtgtggtgtgtggacgctgactgtatccttattttgggtctgagtccgtgttgctagggtctgtcagcgatggagaggctgagttgggagttgggagttgggggtgctgttgagggcctagagaacgatacctcctactccctggtctcttcactgactgaggaaacattcaggacaaattccagttctggataaggaggtaagaggggtagaaaggctctttggggctgaacagggagatgattcacttggcatcccaagaggacaagggctcgggtgaacttcgtcatatttcttaacaactcttcaggggacaccaagcatgtcctcactggctcagctgacaacagctgtcgtctctgggactgtgaaacaggtaagctgggttcattcacctttttagcaaatattgaggacctacagtgtacctgtttgagtaaacaggtcctaggaaaatagagatgaaatccatagatagtttccagtctagggaataagagacaagaaagatagatgagaaaatacacgccatggtagaggaagcatagattaagttttctttttttttttttttttctttttcttatttttgagacagagtctcactgtcacccaggctggagagcaatggcactatctcggctcactgcaacctctgtctcccgggttcaagggattctcctgtctcagccagccccagtagctgggattataggcgcacgccaccatgcttggctgatttttttttttgagacagattctctcgctgtgtcacccaggctggagtgcagtggcacaatcttggcttactgcaacctccgcctcccaggttcaagtgattctcctgcctcagcctcccaaatagctgggattacagacatgcgccatcacacctggctaatttttgtatttttagtagagacagggtttcaccatgttggccagactggtctcaaactccagacctcaggtaatccacccacctcggccttccaaagtgctgggattacaggcatgagccactgcacctggccaccagctaatttttgtatttttagtagagacagggtttcaccatgttggccaggctggtctcgaactcctcagctcaagtgatccacccgccttggcctcccaaagtgctgagattacaggcacaagccactgtgcccagcctaagctgttctgtttagtgccaggtctatgctgggtactggggacatggagggaaatcagatcaggtctttgctgtggagaagcacagtctgagggagagacagatatattgcagtctacgtatgagtagtgccacattagcaggatgtctgaggaaagagtctaggtaagaagttaaaatacttggccaggtgtggtggctcacgcctgtaatcccagcactttgggaggttgaggcaggtggatcacctgaggtcaggagtgcaagaccagcctggccaacatggtgaaaccccgtctattaaaaatacaaaaatgagccaggcatggtggtgggcacctgtaatcccatcgactcaggaggctgaggcagaagaatcgcttgaaaggttgcagtgagccgagatcacaccatcgcacagcagcctgcaggacaagagcgaaactccatctcaaaaaaaaaaaggccgggcgcggtggctcacacctgtaatcccagcactttgggaggctgaggcgggcggatcacgggtcaggagatcaagaccatcctggctaacacggtgaaatcccgtctctactaaaaatacaaaaaattagcggggcatggtggcaggcgcctgtagtcccagctacttgggaggctgaggcaggagaatggcgtgaacccgggaggcggagcttgcagtgagagccgagattgcaccactgcactccagcctgggcaacagagtgaaactgtctcaaaaaagaaaaaaaaaaagaaaagttaaaatactttttaagtttgggtcactggagcaagacaaacagtgagatgtgatggtagcattctctagaatgtcctccctgcaattgcaatggatggtgtagcccagactttgcctgactccaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattggtgagggctgggaatagggctggggttgaggtaaagggtacagttctagagcccagggcctaacatctactgccccacacagacaacaatgagccctacatgaagatcccttgcaatgactctaaaatcaccagtgctgtttggggacccctgggggagtgcatcatcgctggccatgagagtggagagctcaaccagtatagtgccaaggtaagaggccacatggggcctgagcctaccagaataatttttttttttttttttaagatagagtctctctctgttgcccaggctggagtgcagtggcgccatctcggctcactgcgacctccacctccctggttcaagcaattcccctgccttagcctcccgagtagctgggattacaggtgcatgccaccgcacctggctaattttttttgtatttttagtagagacagggtttcaccatgttggtcagtctggtcacgaactcctgacctcaggcagtccaccgctcgtggcctttttttttttttttttttttttttgagacagagtatcaccctgtcacccaggctggagtgcagtggtacgatctcgggctcactgcaacctccacctcctgggttcaagccattctcctgcctcagcctcttgagtagctgggactataggcacctgccaccatgcctgggtaatttttgtatttttagtagagatggggtttctccatgttggccaggctggtcttgaatcctgacctcctgacctcagatgatccacctgcctcgggtcctggtgatagcacactagttcagaacaagggcagggctgtatgctgtggctcacatctgtaatcccagtgcctttgggggccaaggcaggaggatctcttgagcccaggggttggggctgcagtgagctatgattgcaccactgcactccagcctgggtgacagtgagaccctgtctctaaaaaaaaaaaaaaaaaaaaaaaagttaataaaaaattttaaaaagagcagaggtgagattcaaatgtagatttcaccactttctagctgtgtgatcttgggcaatttacatgacttctctgaccctgtttatctgtaaaatgtttcaaggatcaaatgatatcacatgtttgaaaaacttgtcacaaagtactcaggacatgttaataaggatcacaggccgggtgtggtgactcacacttgtaatcccaacactttgggaggctgtggcaggattgcttgagacccggagattgagatcagcctgggcaatataggaagaccctgtctctacaaaaaaaaattaaaaattagctgggtgtggtggagtgtgcctttggtcccaggtactcaggatgttgaggctgaaagattgcttgagtctgggagattgaggctgcagtgagccatgattgtgccactgtactccagcctgggtgatagaacaagaccctgtctcaaaaaaataattaaggatcacaaatgagcatttccttgccaccactgagtataatgccctgtataatgctgagtataatgctgaactcctagaacaaagaagtaaatcagatgcagtcccttcccccatggggagacagacttgcaaacagctagcacctgagtcagattgtgaattgtgccaccatagaggtctcagccaagtgtggaaggtgcactctcccagggaggtggcgtgtacattaaaccctggagaataaatggagcttcaagcaggaaggaaagaacatcccacaggcaaaaggaacagcaaaggcaaaggcacagagttaagaaagtatggagtcttcagaaacccttggggtgtggtcttggggacagaggacggggaatagattttaaacgtccttcagtgtgaggaggtaaagagttttgactttcctccaggcagtagggaatctttaaagggttatcaatggccagattttccttccaacagcttttgcagtttatgtttggagagtgaacctgaactagccaataggcataggatgtacattactggacagagtcaagggatatttaggggtgactgataggatagagggggtgaggaaaacacaaagtccatgctgtctcagctttcatttgggtgcttgggtttctggggagctgagattagtagggattgggcccattcagtgtcactcttcttccttccctagtctggagaggtgttggtgaatgttaaggagcactcccggcagatcaacgacatccagttatccagggacatgaccatgtttgtgaccgcgtccaaggacaacacagccaaggtgagcctgggcagcggtctggcagggctgctccctccctccggctgcacagctcaccctgcccgacttcccccaggaaagctctttacagatttcccccctgccttctctctccagctttttgactccacaactcttgaacatcagaagactttccggacagaacgtcctgtcaactcagctgccctctcccccaactatgaccatgtaagagaaccccacctgccttcctgctgaagcctcaggaagcttccaagttctagatgcttgtccagaagttgggctacaacattgtgggggaaatgatgtcaggcagagaggagatgcccagaggagtgacaaagctggaaggattgaatagccccagggcagccagcaggaggtggcagaagtgtctgatcatcccctacctttggtatcctcccattgagccgtgtgagatgttaaaaatgtatatggcagcagaaaaacacaaaatggacttggtgtccattggtcccatctagagtttcttcttccattcaggtggtcctgggcggtggtcaggaagccatggatgtaaccacaacctccaccaggattggcaagtttgaggccaggtaaagaagaagagagctcttccaaattaaaatctcatgtggtgtaccttttttgtttgtttttgtttttgagatggagtctcgctctgtcgcctaggctggagcgcagtggcgtgatctctgctcactgcaagctctgcctcccgggttgacgccattctcctgcctcagcggcccaggcgcccaccaccatgcctggctaattttctttttgtatttttagtagagacggggtttcaccgtgttagcaaggatggtctcgatctcctgacctcgtgatacgcccgcctcagcctcccaaagtgctgggattacaggcatgagccaccgtgcccagcctttttttttttttttttttttgacacggagtcttgctctgtcacccaggctggagtgcaatggcgcgatctctgctcactgcaacctctgcttcccgggttcaagcaattatcctgcctctgcctcctgggtggctgggattacaggcacccatgaccacgcctggctaatttttgtatttttagtagagacaggatttcaccatgtttgccaggctggtcttgaactcctggccttaagtaatccgcccaccttggccttccagagtgctgggattacaggcatgagccactgtgcccagccttcattatatttctctatgtctaaatttcctctactgtataatgagacaatgacaatatacttaacataaaattatgcagattaaattattcagttaatatttattaagctctttaagcactgcccagcacatagtaggcactctataagtattagttatgtattcaggcagacatctgggtccagtcttccccatataataaaaaagttaaaaaagtaagagacagggtctcactatgttgcccaggctggcctcgaactcctgggctcaagcaatcctctgtcctcagcctcccaaagtgctgggattacaggcgtgaaccatggcacgcagccaccaatttccatcttattttgttcacattcacttcttatctcaatttttctgctttattattattattttttgagacagggtctcactctgttgcccaggctggagtgcagtggcaccatctctgctcaccgcaacctcctgggctcaagcgatccttctacctcagcttctgagtagctgggattacaggtacatggccaccgtccctggctgctttttgtatttttagtaagaagatgttggccaggctggtctcaaactcctggcctcaagtgatccacccgcctcggcctcccaaagtgttgggattacaggcgtgagccannnnnnnnnnnnnnnnnnnnctggacatggatgggagttgctaggatgcagtgagtgaccaatggcccttcccaagagattaaaaccctgtaaaaggatgacagcaacctgagtgtccccactttgagtgctgaactagttaccaaagagcaagacctcacctacacacagcaaatacatagacatagatatactgccattcttccattgtatccatggcagatgtactaatcattcctggcactcacttccaatgaacctcagaatccttctccagcactacaagcaactaccaatcaaagtcgatacacatgataggctgggcatggtggctcatgcctgtaatcccagcacattgggaggctaaggaaggcggcttgaggccaggagttcgtaaccagcctggccaacatggtgaaaccccatctctactaaaaatacaaaaattagccaggcatctgtaatcccaaccactcaggaggctgaggcaggagaattgcttgaacccaggagggggaggttccagtgaaccgagattgcgccactgtactccaccctgggtgacagagtaagactccatctcaaaataaataaataataataacaatttgcatttggggagtgccacctccaaagtgttttggaagaagatagaaagtgaattaattgtgtcccttttcctccaggttcttccatttggcctttgaagaagagtttggaagagtcaagggtcactttggacctatcaacagtgttgccttccatcctgatggcaagaggtagggtaccagtgaagcagctgacctaagcctgggttgggtctctgcctttcccagagtaagcacctgactggtgcctggctatctttttccagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagatattttgtggtgtctgtttcatcatttttccttttcactgacaccccagcaagctgatgctgatcatggagacttttattattgagacctccctatactttggacacttcaaacttaagaccctcagtacttttggctaacctgggttgcaggcaccctcatccaaggtgtaaaggtcctaaggggcctgcagaggtttcaggaacatctcagctgctatccaaggagccagtgcttagaataggggctcggctgaagcagttggctgagaggcttctgtcttctcccttcctgtcactatttgccacactcttcccccatgcagcttctgcaggctcaggtgagcaggtccagcgcagaaacaggcctgaggaggaggaagacaggtcaggacgctgagcagaggggtaatacccaggggagaaggtgtggagctcaccttgccacagccgcaggctctggggctccacagatggccaagggattgaggaggtagagtgggttctggagtctttgttgctcttttggctggttgagcccagaccacagggagtgcatctgagtcctcccttcacacggcatctgcagaaaggcagggagtgagtttccagccccaggtatgccctctgggagtctgggtgggcagccctggttagtagggtgacagccactttggagcagtgataacctttacttttctcctttttcttgcaaacattattgctagtcagatcttgtactaggcactagaataaaaggggaacaagacaaagtcctacttcttaaggagttctatttaaagggagaaaccaatttagttttgcctcaatgtcagagaaggctaattaagaatgtgatgtttgagctgagtctcaacagacctagcatacccactgtgcaaagcaacagccaacatggggagaacggcatgagccaaagaaagaaggcgggaaagggcccactgtgaatattgataggtctggacccaggagcttttgaaagaaaattgataacaatgaagatgcagagaacagtgaggcggctgccggagagtccagatggaagagaccagtgtggatgaagacggggggagggccttctggcaagggaggaccaaactcagacaattttaggagaaagactaaagatgaaggatgggggagagggaggtaaatagagatgatccaggactagtggggttagtgaagcaggatggggtatagaggaagactgagcaacagaagataactaaatctgatcttcaccctggaaaggtgaaccctccctccccgcatctctcaatctcataagacagctggcatctgggactgataggcagcatatgcaacaagccaaccaaataataaaaataccacttcttttatttacttatttatttatttatttatttaatggagtcccaccctgttgcctaggctggaatgcaatggcatgatctcggctcactgcaacctctgcttcccaggtgcaagcaattctcatgccttagcttcccaagtggctgggattacaggcatgtgccaacacgcccggctaattatatttttttgagatggagtcttgctctgacacctaggctggagtgcagtggtgggatcttggcttactgcaacctctgactcccaggttcaagtgattctcctgcctcagccacctgagtagctgggactacaggcgggtgccaacatgcccggctaattttttgtatttttagtaggcagggggtttcaccatgttagccagggtggtctcgatctcctgaccttgtgatctgcccacctcagcctcccaaagtgctgggattacaggtgtgagccaccgtgccaggcctaattttttgtatttttagtagagatggggttttaccatgttggccaggctggtctcaaactcctgatctcaggtgacctgcctgcctcagctcccaaagtgctgggattacaggcgtgagccaccgcgcccggccagattatggctgct

SEQ ID NO: 16780 - DNA, 35493 bp, Human
  misc_feature (1)...(35493): n = A,T,C or G
aaaagaccatttattttgatcaagaaagggtttggagcttgaggtgggctttgtagtatgagcatcatcaaagaaaggaggacatttcaggtcaaaggaatagtctgcacagaggatactgtggtgtgaaggtgaatgtcatgttcaggatactgatcataatctggtgtgtctggagcacaggttggcaaactttttctatatagggccagatagtaaatattttaggctttattttgccatatgcttgggtgtctgtggcaactaaactgctcagctctgccactgtagtgtgaaaacagccatagaggaactgtaaacggatgggcatggctgtgttccaataaaattttatttaccaaaacaggcaactagttgtatttgtcccaagggccatagtttgcctactccagtctagagcaaagagagagagagagtgagtgtgtgtgtgttgtgggaaagggtggtagcaggagatgaagctggaaaggcaggttaagaaagtccttggatgaagctggaaaggcagattaagaaagtccttggccgggcgcggtggctcatgcctgtaatcccagcactttgggaggccgaggcgggcagatcacaaggtcaggagatcaagaccatcctggctaacacaatgaaaccccgtctgtactaaaaatacaaaaaattagctgggcatggtggcaggcgcctgtagtcccagctactcgggaggctgaggcaggagaatggcgtgaaccctggaggcggagcttgcagtgagctgagatcgcgccactgcactccagcctgggcaacacagcgagactctgtctcaaaaaaataaataaataaagtaaaagaaagtccttgaatgctggccaggcgcggtggctcacacctgtaatcccggcactttgggaggccgaggtgagtggatcaactgaggttaggagtttgagaccagcctgaccaacaaggtgaaaccccttctctactaaaaatacaaaaattagccaggcatggtagcacatgcctgtgatgccagctacttgagaggctgaggcaggagaattgtttgaacccaggaggcgaaggttgcagtgagctgagattgcaccactgcactccagcttgggcaacagatcgagacttgtctcaaaaaaaagaaagtccttgaatgccagtcttctgaagttattattattaaatgttgagacccagcctggtcttgaactcctgggctcaagtgattttcctgcctcagcctccagagtaactgggattacaggctcatgccaccatgcctatctctattaaagttattctttactctttatcctgtaggggatggggagccataaggattttttgagcgaaggagtgatgttatcagaattgtggattaggaaaataactctggtgacagtgtggcaggtagtgtgaattgaaggtagagggaccaattagaaggctagtgttatagattaagcatgtgataagttttagttttcttatctgtaaggtgagaataataataccccctgtcctacccatgttactgtgaggatccagtaagaaaacgaagtgaatgtgctttgacaccataagtgttacaatatgtaggaggtgaattgtggcttctaataattctgagtagcgatggttatttttctgttgtgggagggaattccttggaggtatagtgaggtgaatcatttcactggctgttgttccccagtagctttggaatgaacccctcttgctatgtagtgcctgtgggttccagaagaaagtgagctagactgaaccttaaatgttcacctcaccagggtccctgcttttttttttttttttcttttggagttacccttcaaaaggtgggagagaatcttggaaactagaaatgagccagaaagaatttgactgggagttcgctgtaaaaattcctgggttctcctggtagtgtatgcctaactgtgttagtgaagctgtcactctctcttcttcaggggatgttggaaattactattatggacaaggccacccaatgaagcctcaccgaatccgcatgactcataatttgctgctcaactatggtctctaccgaaaaatggaaatctatgtgagttaccagaggtgctaccgctccctaacctcatctgctctggttccccatatgccattcattatctcattttctccaccactcattcactcattcatcaaatgcatgttgactgctgttacaaggcaggtactgtaaatgataaagatttttggctgggcatggtggctcacgcctgtaatcacagcacttcaggaggtgaaggcaagaggatcacttgagcctaggagttctaggccagcctgggcaacatagggagaccctgtctctacaacaaaatttaaaaattagctggccatggtggcatgtgcctgtggtcccagatacttgggaggctaaggtgggaagactgctagagcctgggaggtcgaggctgtagtgagctatgattgtgccactgcattccagcttggggggcagagcaagactctgtcttaaaaaaacaaagccaggtgcggtggctcatgcctgtcatcctagcactttgggaggctgagatgggcagattgcttgagcccaggagttcgagaccatccgggtcaacatggcaagacctcatctctacaaaaaattagccaggcatggtggcacatgcctgtagtcccggctacttaggagcctaagctaggaggatcattttgagtctgggaagcagaggttacagtgagccgtgattgcaccactgtgctccagcctgagcgacagagtgagaccctgtctcaaaaaaacaaaacaaaacaaaaaaaccaaaaatttaatgcctaaataagagtgattgggaccatgttgaagcagatgccaaatctctagttattagagagtatagacggtctaacctgtagattcagctacaggtgatttgtcactgatctttgagtttttaaagagaagctggaaatccagattattatgtaaaatctcctaggtttaaaatgttatcccaagaaaccttgtctgtacaaaaaatatgaaaaaaattagctggtatcctggcctgcacctgtagtcccagctatctgggaggctgaggtgggaggaccacttgagcctgggaggtcaaggctgcggtgagctgtgattgcaccactgcactccagcctagatgacagaatgagattttgtctcaaaaaaaaagttaacccagagtttttgctttttggtttttattttaagcatgtatacaaaccaaacacattagtacatctgtagaccaaataggtccaatggttcccagttttaacctctctggagacagtgaggaggaacaagtgaagggttttaaatgaaagagagataggaacgggcatgcattttagaagcagggaggctaggtaagtggctgttacaagagtccaaatgagaaaataaagaggggctggaggtgatgttgccttactacataagaatctgtggttaaagtctgtttctacagcttgagtaaactaccaacagtggtatttttgtcaccattccagagactgaaaggagatgagtgttctttcctagatggccttgtcatgtctctggagccagtggaggcaactggggaagcaaggaaggaaagtagaggagaagacagaccttgggactacggagcttttttaggtgtgaaggcagctgggaatgaaaaacagaaaaggcagaagatatttttaggtactctagggagcagactatctctgctcccgagagctctgctccctgcaggctggagtgcagtggtgtgatcatagctcactacagccttgaactcctgggctcaagttatcttcccacatcaacctcccaagtagctaggactacaggcaggcaccaccatgcctggctttattttatttttttcttttttttgagacagggtctcactctgtcacccagactagagtgcagtggtgcaatcttggctcactgcaacctctgctttctgggctcaagtgattctccagcctcagcctgccaagtagctgggattaaaggtgtaagccaccacgcctggctaattttttggtagaaatggggtttcaccattttgcccaggctggtcttaaattcctgagctcaaagcaatccgcctgcctcggcctcccaaagtgctgggattacaggcatgagccaccatacccagcctctcttggctaattcagaaaaatttttttgtagaaacagggtcttgctgttttgtccaggctggtgtcaaacccctggcctcaagagatcttcttactttggtctcccaaagtgctgagattataagcatcagccaccatgcctgtattcttttttaaaaattataaaaatgatttttattttttacctgcagttccaagcacagtatgttttagttttacatgtttgattgttatatagatggagccatacagtatttattatgtgactgactttttttgctaaacatgttcttgagactcacccatgttgatacctgtagctgtatttatttttactgtatttcattgaaataaatgtattctagtctgttatctctttgatgagcatttgatttgcttctggggtttgactattgcaaatactgctgctatgaactttcttgaacatgtctcttgatgcatatatgctaaagtttcactaaaggatatactaggattagaattgggtcaggacatatgcacatattcacctgtgttagataaagccaaaatggtttccaattgccagctatgtaggagaattgcagttgctctgagtccttgccaacacttgattttgtcagatttcaattttgttgctaatttaggtagacatgaaatgttatcttactattattttaatttatattcccctactgaaattcctattcaacctttttgcccattttcccattggttgtcttttttttttttttttttccctgagacaatgtctcactctggcactcaggctgcagtgcactggtgcgatctcggctcactgcaacctctgcctcccaggctcaagccatctttctacctcagcctcctgagtagctgggaccacaggtgcatgtcaccacactcggctaatttttatatttttgtagagatggggttttgctgtgttaaccaggctggtctgaaactcctaggctcaagtgatctgtccaccttggcctccctaagtgctgagattacaggcgtgagccacagtgcctgacccatttcttttatatattaaatgtccatttttattcattcattgcatatatactcatcaagcacctactttgtgccaggcaatatgtgtgtgtctggttttgggctctctgttcggttgacttggtctgtttattgacccatatgccaataccacagtggcttaattacagtagctttatattatagtaagtcttgttatctggtagcacagtcctcccactttgttcttctgaaaaagtgatttggctatttgccctttcacttttttttctttttctttttctttttttttttttttgagacagagttttgctcttgttgcccaggctggagtgcaatggcgcgatcttggctcactgcaatctccgcctccctagtagctgggattacaggcatgcgccaccacggccagctaattttgtatttttggtagagatggggtttctccacgttggtcaggctggtctcgaactcccaacctcaggtgatccgcccgccttggcctcgcaaagtcctgggattacatgtgtgagccatggcgcccggcctctttttctctcttttagagacagggttttactctgttgcctgggctagagtgcagtggcacagtcatagctcattgcagcctcaagctcctggactcaagtaatcctccctcctcagcctcctgagtagcacttctttttaatttaattacgattttgatatacatttcactaattcaccaaggtctatgtagatctgattctgttgtttgttgttgtttctgtaggatcctggactgtgtttcctgtgtattttgtgatttttgactgtgggataatgcagtaggccactcttatctgaggggggatactttctagtatgcccagtagattcctgaaaccatggatagtactgtatcctatatatgttatattttttctaatacatacatacctctgataaagcttaatttataaattaggtacagtaagaaattaacaataataaactaggacaattatagcaataagccgtttacagtttcatgcatagaagattcattcctggccgggcgtggtggctcatgtctgtaatcccagcactttgggaggccaaagccggtggatcatctgaggtcaggagttcgagaccaccttgattaacatggtgaaaccccatctctactaaaaatacaaaattagccagacgtggtggtgcatacctgtagtcccagctactcaggaggctgagacaggagaatcatttgaacctgggaggcagaggttgcagtgagctgagatctcaccattgcactctagcgtgggcaacaagagtgaaactccttcccaaaaataaaaaaaaagaagattcattcctactgtagatcttagctcttagcgacttcagcacaggatttttttctttccttatattgagaacttcaaccttttcatgtaaaggaagcacagcacagcttctctttggcatatcaaaattgccagcatcactactcgtggactttggggccattattaagtaaaacaagggcttcttgaatacaaacagtgtgataccttgataatcgatctgattactgagagggctactaagtgactcacaggtgggtagtatacagtgtggatatgccagataaagggatgattcacacccaggggacagagctggatgttacaaaatttcataacaaatggttcacaatttgaaacttatgaattgcttgtttctggcatttttcatgtaatatttttggacagtgattgtgtgtaactggaactgtagaaaccaaaactgaggataagagggcactgctgtattctttggaactttgagtcctgggatgaagatggattgttagaaggtgatttgcttttactttgtaaaagaggtggcatttgagatgagccctttccttcagagatttgggataagggatgaatttcaaataataggaagaacatgagcacggacactgttgaaaagctctatacctctctagatcttaaggaagagttgtttggagtataatatttgtgaaagagagcaggggcaattaaattgggaaaggaaccttgtaaagtttcttgattgctatatcaaagagcttagagtctttacttcgggccgggcgcagtggctcacgcctgtaatcccagcactttgggaggccaaggtgggcggatcacctgaggtcgggagtttgagaccagcctgaccaacatggagaaaccccatctctactaaaaatacaaaattagctgggcatggtggcacatgcctgtaatcccagctactagggaggctgaggcagaagaatagcttgaacctgggaggcagaggttgcagtgagccgagatcgtgccattgcactccagcctgggcaacaagagtgaaactccgtctcaaaaaaaagaatatttacttcgtcaacagggtgtcattgaatgagagcagtactttaacgttttaagatttttgtgataccaatatggaagatggaagatgataaggctggatagaaataggaccaattaggaggccaaaaatactccaagtgagatttaatttgtgtatgggttttgttttgttttgtttttttaatttttatttatttattttctgggacggagtcttgatctgtcacccaggctggagtgcagtggcgcaatctcggcccactgcaagctccacctcttgggttcatgccattctcctgcctcagcctcccgagtagctgggactacaggcacctgccaccacgcctggctaattttttgtatttttagtagagacggggtttccccgtgttagtcaggatggtctcgatctcctgacctcgtgatctgcctgcctcagcctcccaaagtgctgggattacaggcgtgagccacggcgcctggcccgttttatttttttagatagggtgttgctctgtcatccaggctggagtgcagtgatgtgatcacatctcactgcagcctcaccctcctgggctcaagtgatcctcccacctcagcttcctgagtagctggaactacactgtgtgctactatacctggctaatttttgtattttttatagagatggggtttcaccttgttgcccaagctggtctcaaagtgctgggcccaagcagtctgccccccttagcctcccaaagcgttaggattataggcatgagccaccacgcccagccaagagttcatttgttaggtcaacagttattcattgagcaggtgctatatgtcaggcaccatgcttgttgcttcaaataaaggtagaacctgctcctggcctcccagagtagaccaagcaaacatgcaatttatatgcagtttggtgagtgtaatgataagggaagtacaggcttctcagggtagcatttcagagagttacttaactgagattctgagaggtcaaggacagctttttgggggaattggcttttcttctctttctctctctctctcttttttaagagacagccttggctgggtgccgtggctcacgcctgcaatcccagcactttgggaggccgaggcaggcggatcacctgagatcaggagttcaagacaaacctggccaacatggtgaaaccctctctctactaaaaatacaaaaattagctgggcatggtggtggatgcctgtaatcccgactactcaggaggctgaggcaggaaaatcgcttgaacctgggtggcggagattgcagtgagctgaggtcgtgccactgtactccagcctgggcaacagagcgagtctcaaaaaaaaaaaaaaaaaaaaaacaagccttgctctgttgcccaggatggaatgcagtggctattcctaggtgagattataatgcactatagcctcaaactcctgtctgtgctcaagtgattctcctgcctcagcctcccaagtagttgagactacaagtgtgtgcctgggttgacttttcatttgcaacctaaaggttgagtagagggtgtgaagagaacagtgttgtaggtcatagcatgtataaaggcctaaatgtgagagagatggcccttggggaagtgcaagcaaaatggtgcttggcagattggcacagtgaatgagatcaattcagtctctcaaacatgttttatttaactcaaagtattttaagggcattaggttagtggccaacctttaaaaaatgaaattgtccagaaaggatctggcagttgggcccaaattccctcatggcagccatcagctagagctatgtaaataaagattgtcctctgctcaccagtgttttgtttatgtttgttttaagctagctaaactgactggcgcttatgagtgatttgagtttggtgttccctggcatacagcacaaaatatttaggtgagtgtaagggggtgagcagggatcagattattctggttttccaagccaggttaaagagtttgaacttgatattttgagtaatgatgcctttgaagtgtttttagaggggagtgacatgattcagtttgcattttaagactgataactctataacaggcacagtgacacacgcttgtaatcccagctactagcaaggctaaggcaagaagatcacttgagcccaggagttcgagaccagcctgggcaacacagggagattctgtctctaaataaaaaagaaaaagacaggccgggcgcagtggctcacgcttgtagtcccagcactttgggaggctgaggcggatggatcacctgaggtcagcagtttgagaccagcctggccaacatggtgaaaccccatctctactaaaaatacaaaaattagccgggagtggtggtgggagcctgtaatcccagctactcgggaggctggggcaagagaattgcttgaatctgggaggcggaggttgcagtgagccaagattgtgccattgcactgcagctgggtgacaagagtgaaagtcggtgaaaaaaagaaaaaaaaaatagagagacagaaagaaacagggagagggagggagagagagaaagacaaagaaggaaggaagaaaggaaggaaagaagagagaaaagaaaaaaaaagaaagagagacagaaaactctgcctgtagtattcagcataaattaacaatggttaagaaggaggctagtataccagttaggagattgttgccagaatccaagtcaaaaaaagtggtagcccaggatggaagtggacagatttgacagataatacattggtggtagtttcaagagaagttgaatgtagcggatgaaaaaagaagaatcaaagatgattcttgcctggtgtggtgtggtggctcatgcctgtaaccctggcgctttgggaagccaaggccagcagatcacctgaggtcaggagtttgagactagcctggccaacatggtgaaaccctatctctactaaaaatacaaaaattagccgggcgtggtcgcgggtgcctgtaatcccagctactcaggagtctgagacgggagaatcgctgaacttgggcagcagaagttgcaatgagccgagatcgtgccattacactccagcctgggtgacagagtgagactctgtctcgaaaaaaaaacaaagatgataccctggcttcgatcttgaacaactaggtggttggtgctgagaataggaaacccgggaaagaaggacataggaaaaatagggtagtagatgcaatcaatattatggaggcataatgagagagattggcaatggattgaaacaggaaggcaaaaaaggacagagtttaaaatgacacttaggttttcagcctgagtggatgttggtatcattaacaaaaataatgaaagagaacttttggaagttaagtggaatttgagtgcttctaggctctcaacaacaaattgttgagtccagttgaatttgaagtgcctttagggtttgtgggtggagcagactgagaagctatttgaactgtgaatctggagctcagaactaagatcaaaatggagtttgtgcagtcatctgtgtagaagggatagccagaccaaagttttgatgacattaggaagagagtaaagggcttagtatagtaaaaaaacaacttggtatttggagctaagtcttttttctttcactgtgggtgttttggtttgcctttttagaaacagggtctcactgtgtttgcccaggctggccttgaactcctgggctcaagtgatccttacatcttagattcctgagcagctgggactacggtgcatgccactgcatctggcttcactatggctgtttttgataaaacagtatctgtcgttcagtcttattatgcctcattaaattaagtgaggattaaatgagagagtcaaagtacccagagccagatctctggattccttccagtttaccagctgtgtaaccccaggcaaattacttaacctctctcttctatagtttcctccctgtgaaataaggataataatagtatgaattttttatttttattttttctttgtgatgtagtttcactctgttgcccaggctggagtgcagtggcatgacctaagctcactgcaacctctgcctcctggatttaagcgatgctttgcctcagcctcccgagtagctgggtttacaggcgcccgccaccacactcagctaattttttatatttttagtagagatggggttttaccatgttagccagactggtctcgaactcctgacttcaagtgatctgccccgctcagcctctcaaagtgctgggattacaggcgtgagccactgtgcctggctatgaacttttttttgtttgtttgcttgttttttgagacagagtctcgctctgtcgcccaggctggagtgcagtggcacaatctgggctcactgcaacctctgcctcctaagttcaagtgattctcatgctgcagcctcctgagtagctgggattacaggagcctgccaccacgcccagctaatttttgtattttttgcagagatgggatttcgccatgttggccagactggtttgaaactcctggcctcaagcaatcctcccacctcggcctcccaaaatgctgggattataggcgtgagccaccgcacctggccatgaactttaaaaggtgtttttttgttttgttttgtttttcagagatggggtcttaggaatctgaacacattctggcctggagagattgcccaataacttattttattttatttatttatttatttatttatttatttgagatggagtctcgctttgttgcccaggctggaacgcagtggcatgatctcagctcaatgcagcctctgcctccgagttcaagcaattctcctgcctcagcctcctgagtagctgggattccaggcacctgccatgacgcccggctaatttttgtatttttattggagatggggtttcgctgtgttggccagggtggtcttgaactcctggcctcaggtgagccacccacctcggcctcccaaagtgctgggattacaggtgtgagccactgcgcctggccccgataattattttaaaaaagagaaaaagacagggtctcactatgttgtccaggctagccttgaagtcctaggctcaagcgatcctccagggcttagatctttaaaaggttgttgtaagaatcatatgagatagcgtttaaagtgcctgaaagagtgactgtcacagaggaaacaataaatgttggctgtgtattgaaaatgctttataaactgcagaaaatatggcaggttctcaaataacatcacttcgctcagcatcatttagttataacgttgaggagaaaaataactgattcctggcatggccactatctgtatggtgtttgcatattctccccatgtctgtgtaggttttctccgggtactccatttttctcccacatcccaaagatgtgcatgtgaggtgagttggcatgtttccatggtcctagtctgagcaagtgtggatatgggtgtgagtgcaccctgtgatggaatggcgtcctgtccaaggttggttccttgtgttgagctgcgggacaggctctggccacccttggaaatgaatgattgaattcaaattattgtcaagtaaaaattcataaagtagacaataatcatacagatgcacaacaataaaagatgtgatacagaaacactcagcgagcctgccatatttgttattgttcgtttttgaactgcatgatggtagaaggttctccttgcaattttaactttgcatacatttattatttgatttaacccaccaccacaacaaccgccatcactcactgattcaccaaaaattgggtaaataataatgtatatattttttgagacggggtcttgctctgttgcccagactgtagtgcagtggcaagatcacagctcactgcagcctggacttccctgggctcaggtgatcctcccaccttagcctcttgagtagttaggactataggcaagtgccaccacagccagctaattttttatatttttgtagagacagggtttcaccacgttgcccaggctggtctcaaactcctgggttcaagtgatccacctgcctcagcctcccgaagtactgggattttaggcatgagccactgcacccagcccaataatgatcttccttatttttataaatatttcttaaatatagagatatttcgccgggcaaggtggctcatgcctgtaatcccagcactttgggaggccgaggcgggtggatcacgaggtcaggagatcgagaccatcctggctaacatggtgaaaccccatctctactaaatgtacaaaaaattagccaggtgtgatggcgggcgcctgtagtcccagctacttgggaggctgaggcaggagaatggtgtgaacctgggagacagagcttgcagtgagccgagatcgcgccactgcactccagcctgggcgacagagcgagactccgtctcaaaaaaaaaaaaaaaaaagggatatttcacatttatttcagtatttgatgtttgaagtgttttgggtctttatttagaattttagtgatgtttttgtgacagaaatatgctgtaggagcttaagttcttgtttatatcaattagcctatggtaaaattggtttctttatacattgttttgcctatagtcacaatttccaagaacctgtggatgacattaagtgaggacttttgttgtattggtaattagagaggcagagggtcatgtttgaagaagacctacctttaagggatgggaggaaaaggaaataattttaaaaagggaaggaggagtcagaatgttgggataaccaggaaattagcttgtcaaggaagtgttagtggggaggatgtgatcaaaattgttgatgtgatgacttataaaggatttcccatctgtttcagttttcattagatacccttttttcgtgaactcttggagccattttgtccataattttataatacgtatatatacatatatattttttttaatttatttttttgagaggaagtttcactcttgttgcccaggatggagtgcagtggcacaatctcagctcactgcaacctccacctcccaggttcaagcgattctcctgtctcagcctcctgagtagttgggattacaggtgcatgccaccacgtccagctaatttttgtatttttagtagagaccagatttcatcatattggtcaggatggtctcgaacttctaacctcaggtgatccacccgcctcagcctcccaaagtgctgggattacaggcgtgagccactgcactcggcctcttatctataagagacttattcactatcacgagaccagcatgggaaagacctacccccatgatctagttacctcccacgtcggaattcaagatgagatttgggtggggacacagccaaaccatatcactatgttgcccaggctggtctcgaactactgggctcaagctatcctcccacctgggccttccaaagtgctgggattacaggtgtgagcccccacgcctagcctgtcattttctttttaattttctttttttttttttttttnnnnnnnnnnnnnnnnnnnncaccttagcctcttgagtagttaggactataggcaagtgccaccacagccagctaattttttatatttttgtagagacagggtttcaccacgttgcccaggctggtctcaaactcctgggttcaagtgatccacctgcctcagcctcccgaagtactgggattttaggcatgagccactgcacccagcccaataatgatcttccttatttttataaatatttcttaaatatagagatatttcgccgggcaaggtggctcatgcctgtaatccagcactttgggaggccgaggagggcggatcacctgaggtcaggagttcgagaccatcctgaccaacatggtaaaaccccatctctactaaaaatacaaaaattagccagcgtcgtggcgggcgcctgtaatcccaactactcgggaggctgaggcaggagaatcgcttgaacccaggaggcgaaggttgcagtgagtcgagatcatgccattgcactccagcctgggtgacagagtgagactccgcctcaaaacaaacaaacaaacaaaaaaaaacgaaaaaaaaggtcgggcttggtggctcatgcctgtaatctcagcactttggaaggccgaggcgggcggatcacgaggtcaggagatcaagaccatcctagctaacacggtgaaaccctgtctctactaaaaatacaaaaaaaattagccgggcgtggtggtgggcgtctgtagtcccagctacttggaaggctgaggcaggagaatggcgtgaagccgggaggcggagcttgcagtgagccgagattgcgccactgcactctagcctgggagacagagcgagactccgtctcaaaaaaaaaaagtaataattttgtaaagcaccttacagtttacaaagagatttaacaacctcttccaattctctcaacttccctgtgtggtctatgttgtccctgtttagtaaatgaggaaatggaggttcaagagacagtaacttgcctaagcaacagagcttgagctgctgtaggtcttctgatactctgtctcctttgataatcttgtttgcctagttagattgtaaatttcttgaagcctgaatctaaccagttatttctttttattctttatagcacctagctccatgctgcgcaggaaatataaatattcaaactagattgactggactggccgtggtcaaaaataacttgccctttctcccttctgccctctagcgccctcacaaagccaatgctgaggagatgaccaagtaccacagcgatgactacattaaattcttgcgctccatccgtccagataacatgtcggagtacagcaagcagatgcagagatgtaagtccattctgttccctcacactctgaagccgccagttgcatctccctttccactgtagaggcccattctgccgtcctcgcacctcccattcagtggacacctgatttcccctacctcctaaaggtgccagagtgctttttcccctcaagtcggatttttcatgtttcctgatttgtaaacgatagaggtagtactttttctggttatgttcacaacactgtcccaagagtactgtaattattgtagtggaaaaagcactgacctgggacggggagacaatagatacagtaaaatttaactctaactctcagctgagtgggcaagtcacttcccctcagattcttcttttgtaaagtgggctgggccacatgatctctgatttctgtccaactgtaactgttttgacttagtgggtattaattgagaatttagaggccactcaggacagattctagatggtgtaatctttgagatgaggtgatgctgcccctgatcccttggacttgaacttcagagcaggtcccatcttggaagccacgcttagtttgtaggaatcgtgggaattattttagctgtgagggggaaaaaaaaagtattcaaatttgggacaaaactatcatacctgacttcccccttgtgttattttagaaattatctcttagcacctaagacttcatatagtataacagcactgtccagaagaagttttgattaacttatgacagcttatatggaagtgtcagaaaatatgcggcacttgtttgttgctgctgaccacaaggtagtcttactcccaaggaagaaagttatttataactattattacaactaataataactgtacagtggtattgatggcagaaccacagagaccttccttgaagcattaagcttctttgctaccgacaactccaggagctgccagctgctgtgagtgaggtgtttgctctctgaattgcagggtcttatttccctccaagatgaggcaaattcatgcctttcctgtagatggctttagaggtttccataacccatttaggccaaggatcaggctctactctcagcacagtgggctctcactagaggagcaacttgctattaaagtaagaaaataagctttcatgtcttagtttgaatccttggtttcctagcccctctggtgttatttcccgcccctgccacttttttttgagacagagtttcgctcttgttgcccaggctggagtgcaatggggcgatctctactcaccacaacctccgtctcccggcttcaagcgattatcctgcctcagcctcctgagtagctgggattacagggatgtgccaccacgcccggctaattttgtatttttaggtttctccatgttagtcaggctggtctcaaactcccgacctcaggtgatatgccagcctcggcttccccaagtgctgggattataggcctgagccactgtgcccgacctgttttccctctttaagaggaagacaggacaggcacagcggttcatgcctgtaatcctagcactttgggagcccaaggtgggaggattgcttgagcccagccaggagtttgagaccagcctgggcaacatagtgagaccctcatctctacaaaaaaataaaaaaattagctgggcatggcggtgcacacctgtggtcccagctactcaggaggttgaggagggaggatcttttgagcctggaaggtcgaggctgcagtgagccatgattgtactactgcactccagcctgggcaacagagcgagaccaaaaaaaaaaagacattagtgcctatttcatagtcaaggatgggggaataagtgaagataatatatttaaatatatataatatgtctaccctcaatgaattgcttttgctatttttgctattgcataatcacttttgctattatgacttactatttttattatttacaaacttatcaaggcagacaaaatgctatgccctgaggagtgtgcaggttctgctctggtgcgccaatttttccgaatccagcattctaaagttgtacattaaaaaattcagtctggctgggtgtggtggcttacgcctgtaatcccagcagtttgggaggctgaggcaagcagatcacctggggtcgggagtttgagaccagcctggccaacatagtgaaaccccatctctactaaaaatacaaaaattagcttggtttggtggtacatgcctgtaattccagctactcaggaggctgaggcaggagaattgcttgaacccaggaggcagaggttgcagtgagccaagatcgcgccactgcactccagcctgggcgacagagcgagactccgtctcaaaaaaaaaaaattcagtctgggtgcctatagtctcagctacttaggaggctgaagcaggaagatttcttgagcccaggagttcaaggccagtctgggtaatatagtgagacctggtctctaaaaaaaatttttctaattaaaataattaggtcttggatttttctgtcatcagaaatgggggcaggaagaataagcctctctaagaacttcagagtacctcactgagttgatttgtagggttatggagggtcagagtagacagagactttagatgtcacttaacacagtgctttataacctggggtatctaccaagacagtaatgagccctttttaaaaaaagaattatttttatttttattcttgtttttagagatggggtcttgctttgtcatccagggtacagtacagtggcaagatcatagctcactgcagcctcaaattccttaatccttaacttgcccttttagaatatgtaccaatatctaacctaggcgctggacatggtagcatgcacctgtaatgccagtgctttgaagggcaaggcaggagggatagcttgaggccaggagttcaagaccagcctgggcagcatagtgagacccccatctcttattttatcttaaaaaaataaaaataaaaaattagttgtgtatggtggcacatgcctgtgattctggctactcaggagcctgaggcaggaggatcccttgagcccagttcagggctgcattgaggtatggtctcatttcgccaccacactccagcctgggcaacatagcaagaactcgtctcaataaaaaaaaaacacacatggccaggcgtggtggctcatgcctgtaatcccagcactttgggaggccgaggtgggcggatcacgaggtcagtacatcgagacaccatcctggctaacacggtgaaaccccgtctccactaaaaatttacaaaaaattagccggacgtggtggcaggcgcttgtggtcccagctactcgggaggctgaggcaccagaatggtgtgaacccgacaggcggagcttgcagtgagccgagatcacgccactgtactccagcttgggcgacagagcgagactccttctcaaaaagaaaaaaaaaaaaacccacacacacacaaaaacatcccacacacctaatctaggaagttatgcttatgataagatcgagtaaatcaggtttccttgcttgtggctgaaatgtaataaaccctttctggtcactttgagagccttgaccagaagttctgacctaatatttagcaagtgaaaatgggaacacaaataaatgcatttagggggcttttggtgaaaacatgataaaagggattggtaaaaaattgggagacattctcatccattttacagacatgtaaactttcccagtcacacagcaaggtgatggtagaatgcagaatggaactctagtcccccaattctgtagttttaaaaaatatagtgtatataaaatattttagatacacaggccaggcagggtagctcatgcctgtaatcccagcactttgggaggctgaggcaggtggatcacttgaggccaggagtttgagaccagcctggccagcgtggtgaaaccctgtctccaccaaaagtacaaaaattagccatgtgtggtggtatatgcctgtaatcccagctactcgggaggctgaggcatgagaattgtttgaacctggagggcagaggttgcagtgagccaagatcgcgccactgcactccagcctgggcgacagagcaagactccatctcaaaaaaaaaaaaaaaaaaaaaaaacagaaaaagaaaaaaacatattttagacacacacaaaaagcatcaaaaaataatataatgcactttgggaggccgaggcgggcagatcacgaggtcaggagatcaagaccatcctggctaacacagtgaaaccccatctctactaaaaatacaaaaaattagccgggtgtggtggtgggtgcctgtagtcccagctacttgggaggctgaggcaggagaatggtgtgaacccaggaggcggagcttgcagtgagctgacattgcgccactgcactccaggctgggcaacagagcaagactctgtctcaaaaaaaaaaaaataataataataatataatgaacatccatgtgtgcccaatacccagcctgagaaagaaaacattatcaatacagttgatgcccccttgggcatctttccttgatcacataccctttctctcccactcccccagccccccaccccattaccagcactgccaaggtataagcactatcctgaggttagtgtttaatcttcccatctctttgcaatgagcatttgactgccttctctgcctacgtctgcttccacctctcacccagtattgcttccctttagtctaaagctagtgtgagaatgagaaaagcgtttatagcagaaagagagaaaacccatggaaaagtcttccctaccctcacagattagctcacatgagtatctgctcttccatttgccccctttccatctctaatcacatagcttattgactaggaataaaagggctggtcatttgagctacatgttggtttggtgcctgaagaaaaatatttttttttttctcacgtccaaaacacccattccttcccatggaggctccatatcccaaataagagtataaacaaagctttggaaacgcaggcaggccaaactctgtgcaggaggaagtggccagagagggaaatcagttgccaatggataaacagccggggcccagggaccaaagttcttatttacacagcctcccagtgtttacccaggaagtgaggaagagacccacccgctgcacactccctcatgcagccatgcttcttcctcagagcaccggatcttggcaccctccaagtttagtgcagaaccagagctggtaactcttgtggttattgtagatcttgagcttcaactgtgtcttgagattttaccagcacaatccaaactgagctcttctgctctcaccccagggctgctccttcctctacttttggaaatcttgataacagtgggtacagtagaaggctgggcaagagaataagtatgcagccccacacctcctgcctctgacttcctgtagctcattgatgtctcagcagttactttttttttttttttctcctgagatggagtctcgccctgtcacccaggctggaatgcaggggtgcaatcttggctcactgcaacctccacgttttgggttcaagtgattctcctgcctcagcctcctgagtagctgggattacaggcacatgcctggctaatttttgtatttttagtagagacggggtttctccatgttggccaggctagtcttgaactcgtgacctcaagtgatccacctgccttggcctcccaaagtgctgggattacaggtgtgagccaccgcgcccggccagtagttaccttttctgtaagaggagatttggagctataaagttcctctaggtctgtgagtctacagcctccaggtgtgctttccttcctgttttcatttcatttgccttattgtttgcatatgtttccacattatgtactacttggtacttttaccccattaggcccgaaataactttactccacttgtcactgtgaatgtagcagtaagacactgggctacgggagtcaagacaccgggaccctgattctggttctgctactgcctggttttataaccttgggcaaatcacttaacttctcggtatctgtttgttcctccgcacagtggggttgatatctggcttgtccagctcatagagttgttgtgaggatcaaatgaggttgtatatgtgaaaggacttggaaaagggccgggatatattttcacaggcttttaagacagacaggctggctgggcacggtggcttatgcctgtaatcccagcactttgggaggccgaggcgggcggatcacagggtcaggagtttgagaccagcctggccaacatggtgaaaccccgtctctactaagaatgcggaaatcagccaggtgtggtggcaggtacctgtaatcccagctactcgggaggctgaggcaggagaatggcttgaaactggagggcagagattacagtgagccaagatcacttcactatactccagcctgggcaacaagagcaaaactccgtctcaaaaaaaaaacagacaaaccaaagcttgaggcttgcatactgcttctgccatttactaacagctcacctctctgaacctgtttccctacttatttatttatttatttttttgagacagggtctcactcttgtctcgcccaggctggagtgcagttgcgcgatctcagctcactgcaacctctgcctcccgggttcaagtggttcttgtgcctcagcctcccaagtagccgggattacaggcagctgccaccacacctgggctaatttttatgtttttggtagagatggggtttctccatgttgcccaggctggtcttgaactcctggcctcaagtggtcctcctgccttagcctcccgaagtgctgggattacaggtgtgagccactgtgccaggccttgtttccctacttataagatgggaccaaatcttacctcagaagcttgtgtgaagatgaatgatctcgggtatttaacgcatgtagcgcagtgtctggcgtgttgtacgtgcgcagtgaacgatagttctctgggtctctgttcttgccccttgtttgtcagctggcgtgagggccagaggataagtttttctccctcaagaaacgaaccaacattttccaagttgctaactgcttctccatattagatttttgttaattttctgaccagtgggtgaggtgggatatcagttttgcttgttatagataatgggctaagaccaggtgtgatggcacatgcctattgggaggccaaggcaagaagactgcatgaggcctagggaacatagtgaggctctgtctctaaaaaaaaaaaaaagaaaaaaaaattagctgggtatagtggcatgcacctgtagtccaaagtacttgggagactgaggtggaaggattgcttgagcccaggaggtgagggtcaaagctgctgcacatgagccatgtttgtgccactgcactccagcatgggcaacagagcaagcccctggctctaaaaaataaaaaaataataatgggctaaagctcaaagatgttaaacaacttgatgcagtcatacagccaggaagtagagcctggactagaacccacacctcctgaatttaaattctgtgtttttttccatcagctcataaatatgtaaactaaaggaaattgtggaaactaaccttttgcttatttctttcaagtcaacgttggtgaggactgtccagtattcgatggcctgtttgagttctgtcagttgtctactggtggttctgtgggtaaggaatattcatcttctccccaggggtagactgggttgttctagtgaggtctgccttttaggctgctatcctagttggctgatctgaaaccatgtagaatggtcctgtggtttttactgaagtctctaaaatggctggtgtagtgtctcacacctgtaatcccagcactttgagaggctgaggaggaggattgcttgaggtcaggagttcaagaccagcccaggcaacatagaccctcctgtctataaaaaaataaaataagtaaaaacaattagccgggcatggtgactcgtgcctgtagtcccagctactcaggaggctgaggcttaaacccagtaggttgaggctgcagtgagtcgtggtcacaccactacactctagcctgggcaacaaagcaagaccctgcctccaaaaaaaaaatttaaaaagcctctaaaatgtccctctggttcagtcccagcccaggttcaatctctgacatggtactgacaggtgtccttgactgtcctttcctactaagagatcttatgtacaggcgttccccgcagacctcctggggttgttaagatgctgtacgtaaaagcaatttgtgaactgcaaagtgctataaaaatggaagtgtcatcatctgtgaatctgtcctatgaaaaagtatggtaattacctttagaggtcagaaatactcctcatgtatctcccacttccatttgcaacttttgggttatctccaggattactctaaacgctttcttaacaaatatttattttcctgtgatcccccaccaatataatcattgtgtccatccccgctgccccaccaatataatcacagaaaacaaagaagtgcacagaaaaaaacacaatcacccacagtcacagggttggtggataacctctgttaccatgttggtgtttgtatggccattcttttgtgtgtgtgtttatatctgtgtcacacatatacaacatctatattttacaaaagtgggttatatacatatcacatatatatggttttatgcctgcatttcctacttaacgaaattgtctgtagttttctacagcttgctttcttgtggctctatgattattccatgttgtggatttacttgagttgatataatctgtccctcttcttgataatttggatcaatctatgcttttattgctgttaaaatcaacactgcagctggacacggtggcacatgcctgtaatctcagcactttgggaggctgaagagggtggatcacctgaggtcaggagtttgagaccagcctgaccaacatggtgaaaccccatctatactaaaaaatacaaaaattagccgggcgtggtggtgtgtgcctgtaatcccagctacttgggaggctgaggcaggagaattgcttgaacctgggaggcggaggttgcagtgagccgagatcgcgccactgcacttcagcctgggtgacagagtgagactccatctcaaaaaacaacaacaaattaacactgccacaaatgcacttgcacacatgggtgtgtatttatcttttacttcttctgggacctattcgtgctagtgctttttgacctagtgtatcagcactatctttggtaatttttctttttctttttttttgaaatagagtctccctccatcacccaggctggagtgcagtggcgtgatcttggctcactgcaacctccgcctcctgggttcaagcgattctcctgcctcagcctccccaggtagctgggactacaagtgtatgtcaccacgcccagctaaattttttcgtatttttaatagagatgaggtttaaccatgttggccaggctggtatcgaactcttgacctcaggtgatgtgcccgccttggcctcccaaacttctgggattacaggtgtgagccaccgcgcatggcctatctttggtattttttcaaagttccttgaccatgagccatagtaagaaataaatttacacatgcaatccaggatacatataacatatgcatgcatgcacacactcactcactctgaagccagagttttacaaaagagcagttacccttactgttactctgatatttttttctatgctatttcattaaaaaaatatatatatatatacacacacacactaatcatgatgtactaaatcaattttaaggcctgctaatgggttactaccctcagtttggaaaatcgttttttacgagtagacagtatcatgtattccctgctgaagtagggtgggagggaggggactggtctatgaattgcacaatacagctgttgaataggcaggtcttaacctttcactaggttccctgggcttcttggaggaaggggagagtggcttagtaacaggcttatgttctcttttctcatgcccagcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatgcctgcctggccttgtctcttggaagagcaccttaggccaggttcccatttccctcttcccctgggcttgcctccctagtttgcttttcctaccgatgtgctggctaggatgtgctcggtgagtgtctctggccatcatctccttgatggggtcttggtttgatctgagccacggcatgatcaggggcagatgctgctcagatcctgcctccagagtgtccctgtgtggctggagttgaccctggctgtagagtaggaagatcggacttggtcggcttggtcaggcctctggagacacccggccgctcttccaccttccttcagccagtttccacgtctctggtgcttagagatacctgagggaggcagccagcccggtaagctgggagctagcgcccttggcacgtcccatccccaaagagcccccagacccctgacccccttctgatcctaggtatcaccagagggtgctgtacattgacattgatattcaccatggtgacggcgtggaagaggccttctacaccacggaccgggtcatgactgtgtcctttcataagtatggagagtacttcccaggaactggggacctacgggtgagaacgccctttaggagccaaccggcttaccctcagctggcagctctacttctctctcctatctcatgccactaaaaattgcttcttgcctcttctgccaatcagaataccacatcccaatctgaagcacttgccctgatctctttcccttccttattctggaggaagggaatgatgggacataaagggccagagaaagaagaggggtctcctgactcactgtactttcctcctggccacagctgggttgcatcacactattcttatgtctcataagccttgagtttgggggtaggaattgggactctgaaggacatctcaagtgttcttcatgtttttgggtcactttcccctttagccttttgactgaaaactatggactgtctctccagaaaagtacatgagattttacatctgatatagaatagttaatagacaagtccccttactgaagcccatccatgaaccttaggataagaatccttggaagctacttcgttgaactgttccatctgcttctattagcatgaatgtggtgaaatcagctgctttgccatgcctggtagcccttgggtaaaaaagtggcactaattcagttgtttgccatggcaagcgttagaataaatgagcattcactttttttttttttttgagacagtctctctctgtcacccagcctggagtgcagtggcgtgatctcggttcactgcagcctccgcctcccgcctccaggcgatcttgtgcctcagcctccgaatagccgggatttagctgggattataagtgcgtgcaactatgcccggctaatttttgtatttttaaaagagatggggttttgccatgttggccaggctggtctcgaactcctgacctcaagattcacccgcctcagcctcccaaagtgctggacttaaataggcgcactcactattttgaggttactgggaaggactttcttacctctctccttccctccacaacaccctagagagggagcatgggggaagaggagtgagcattagagctctctggagtggaaagggttgtcaagggtggctgtcacttctgtgactcacctgccagccagctctaacccaatcccaaggtagaaatcttgtgctatagggtaggctattcaatctctggtcccatcaagagctctcagtctgggggtaggcttaatgctatgtccagagatgatttgccagtgaagctagatttgccagtgaagagaatggtactaacaaggtacctctgttctgtcctggcccacatcatgggcctagcttgtctctcttgaacctcttcctttatccctccagcccctatccttgaccttccttcaagcttcatccttcagttttactttaatggcctttttaattaggatatcggggctggcaaaggcaagtattatgctgttaactacccgctccgagacgggattgatgacgagtcctatgaggccattttcaagccggtaagtggctttatccaccccttgggctacaaacaggggattggttggcggtggaggggagcaaagcacccccaccatacctcaggaatctctccttactaaagctggtggggagatagaagtgtttgaaccctggattgctgtgtggtcagttaggggaacaaacacccatatttattggttccttctatgggtcaggtcttctgctggatacaaaaatatctaagacatgatctttgccctcacggactatggtggggaaggcaggcacatacccagtagtctatgattagtactgtttttgtatctccatttctttgggctgctgggagattattgtgttcttttggtagtggtatgtctccttggttttttgtgttcctcattgccttacattgatgtctgcacattagaagaagtagggacttactccagtctttgcagactggctttgtctgggaaagccctttgccagtcagcccatccagagattctggaaaggctgtgtggcatgttccatgggtaggctggcctagtgcctgtgtttttgagggatgatcagaggaatgagagacaaactactgcctgggctggcaggagggtagccagggatgatttcacagaggtgctgatgtttaagctggactttggaaaatgaggaggtgcccatgtgaagaaggaggtgatggcagtaagggtggcatttagtagaaggaatggcactagcagaagtgcagaggtgccagtgtggcagcatgtaggccagtgtggtgtatgggaggagtgctgaaggaggcggtgggaagtgtatgctgggctcagtatttcaaagggagccttgaatgccatgccaaggagttaaatcttcacttataaacagtaagaaactgcttaacctaataaggtcaggtagtcattcagcaaacactgactgcccactatgtgcctagtatttaataagggctacagaagtgggagttgtggtctcggtctcagtaacgttagactctgcttgtgagaataagataaactaaaagtgcttgctcataatgtaaggcttcaagtctgtaagaccgaatgagtagagtagatgcagctaaaggtcaggaaggcttcctggaggaagtggcactagagcttgggcaacagaagagacttagggagttgagagggaggccattctaggttcagtgttactagagtgttagaagggtcttagagaactttttaaattggaaaattgaaatcccaagtgggcaagcaagggctccagcctagcactcccttttctctcccacatagcatgagggagagtggaaaggtaggagtgggtgggaaagtgttgcacccagcctttccactccaaacctcgtattgctttcttgaggttggtggtgaccaggatgtatcattttaggtcatgtccaaagtaatggagatgttccagcctagtgcggtggtcttacagtgtggctcagactccctatctggggatcggttaggttgcttcaatctaactatcaaaggtgagaccaggtagcacaaggatgggtgggcggggtcctgcttggtgctcctgtaactcagcaccccttctcccaccaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatggtaatagctgcagggccaggttcggctgggctgggtgggagctggagctcatctgtccttaagtttataaccccttccccgttggtcatatgaccgctcctcttctgatactagtcactgagtctcctgcctgtcctcttgtgatcagcagaccataaccatcactttttccctagtcctttttagctctctcccctctccctcctgcttttggtctggacaaagttctcattggtaatttacagctttggaatttctactctgtagagtaactggagtagcgagtgaagggagcgctcataatgagcatggcctcaagtgtcctaaaccagggacatgggccttctcctagcgacatatacaccactggtacagacataggagagtgatgttaaaaagatggaaatcccataggtacccgtgtctcacagtgtcttggaggcattctcctctgtttggataaataggcccagagaaacctacaaatgctttagggtgcttacgtgcaaatggttagggtgcggtggccaggtctcttgacggtcttctctcctgccccaatcagagcttccatacaatgactactttgaatactttggaccagatttcaagctccacatcagtccttccaatatgactaaccagaacacgaatgagtacctggagaagatcaagtgagtatatcctccagccaccccttggttgaacattcctgactttggtttgtccctgaccagagccctgctactctctcccattggccacagacagcgactgtttgagaaccttagaatgctgccgcacgcacctggggtccaaatgcaggcgattcctgaggacgccatccctgaggagagtggcgatgaggacgaagacgaccctgacaagcgcatctcgagtgagacccagacctagagccctatgccttccattcaataggcagctcacacttccaccaccattcctggctgcacactccctccaagctccccacctgtagagaaatctgttttcgagttccagtgcctgtaggaacaggttagggagcccgagttcctccctcttctggttccctttcccttggtgtctcttggaggacacgcagggaagcactgggcatagatgctgagctaaatcagcacccgcctgccctctcacccatgcttcccactccctcccagtctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaaggtgggtttgggttcagctgggacttgggtctcgagcctgagaggatgaatctatgtagggcagtgggaggagggagtgactcaggccctgccagctcctgtggggctcttcctcagttccttgagcctttcagtggctcccagaagtggcagagcccacaaaacaatgaacctctactgcctgagcacggctctcacataccaccccagcccttttcccagcactgcaccccagtttcccagggggctgcctccgcccaccaggttctggctgtagcaggctgggaaaccagtccaacctgttctcaacagggctcactgggaggaccagggatgggcttttctctctttatgtccagtgagctgtagtgttggggaaggggtctcagggtaaatgaagacctcatgggtcttcccagaggtgctgcccttggccatccctgtactcttgtgttctagaagtcaccgaagaggagaaaaccaaggaggagaagccagaagccaaagggtgaggaaggagctgcctgtggccatctccctggcattggagcaccagcccctttgtcccaccactctgaggaaaggcacagggacagctggtccagcttacaaaggcctctttcagggaccagtctgtccagctctgcagttctaggcagagctaggagccccagcccccagtagtcacctaggatcctgtggaagtcactgtctgcacttttgccctgaggctctgggctgggtcatctcatgccagtctctgctctctccacagggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctatatcctcctgagcttgtttcctatgtgtccctgggttggtttcaactctacttccctgccgttctggtgtccatgagtattggggcaaccccctgaacaagaaaaccccataaacttacctgcctgccttaactcctcccttgaggtttgaggtaaactactttccaccaatcttctcaccctacccccagaagaccactcattaaagcaccactaaagggacgacatttattccttttccaaatgttacagtaaaaccaggtggaagagaatggttttagcagttagaaaaaaaaaaaaagtacaaatctggggtttggccattaaaagttatttacaacagtgggagaaaaaaagacaagaagttgtttcacattacagacctccccccaccccaaagcctaatacttgcttaccaagtcaaaaaagagacacagttgattcacaggctggaggtttgaacttgagtaagacatttataaaaacctagacggggcagtgtcctccccagcccaggtgccactaggcacagcacaagagactaaaaacaacaggggaaggctggacactcaaggtttgggagtataagcaccccacttctggctcagggatttggggagtagggtaaacaaaacctacttggaaaagaattggggaagaaaaccaacaactgccttatgcaggggtggggacagggaaggaggtagggccagggacaggagcatttcacatcactaacctaacttgggaagctgtaagggaccatcttcaactggccttaagaggagaaccagatggctgatgggagaatccacaggagggagaggaggaaagggaacgtggctgggaggaggcaatagccccttcctttctgggcacaggaaggcagccagggcaccaggtccaggcagtgacctcacaaggacagcacagtttttgcagcttagagatcacccacctgcccctacctagctactcattctgctcagcgctggctggtgtagggccactctccggccccgagggagtggatggctctgtagcctggggccctgcctcttcttctgaggctgcactagcctctgcccccttggcctggggttcctggctctcaggggtggctgcggccttcccttcctgagcagtgccctcgtcgctgcaggcaccgatctccccctgctcctgctcttcctctgtgggtgaggaggcagaagaatcacccccaccctccttccgatttctcttgaaggacaggccgctcaatttgaaaggcttcttgaaagagaatttcttcttcttcttgggggtctccttgggggggacctcccccttggcctcagcaccctggctagggggtgctggctcgatggcatcgccagtggccccggctgcctcatctgttccgttcacagggggcgactccccttcacccttgggggataagtctccattgcttttcacgtggccattctcctgcagggcagagggaatagcaatgagggcaggggctccccctcccccagcccgcttctgatcccttctagaggaaggggtcctcgattcgattctactgcaacccgaaagtctggcttcagcctcacccacacccaggatcccgtcaaacacctccctctcgcccctcacgggcgcgcggggagcgagcgcgcagagggcgcgaccggcaggaggcgctggggtcccgtggcccccacccccgtcccccggggcgcgctctctattccgcgcggaaccgctccggatctgctgtgcggatcccgggcaggcgggcgagccgctctaggcgacattgggcgggaagccgccccggggcgctgtctctctgcacctggacggcctattttcccagcctcccgctttgtgtaagtggcccccacccaccccaggctctcccgcatctcggctcccccttaaaaaaaaaaagaccgtgggccaccgaggtcgggtcggcgggtggagtgcgctccccgcc

SEQ ID NO: 16781 - DNA, 55703 bp, Human; identical to SEQ ID NO: 12007

SEQ ID NO: 16782 - DNA, 8044 bp, Human
  misc_feature (1)...(8044): n = A,T,C or G
aaaaaaaaaacaaaaaaaaaatggccgggtgcggtggctcatgcctgtaatcctggcactttgggagaccaaggcgggtggatcacctgaggtcaggagttcgagactagcctggctaacatggtgaaaccccacttctactaaaaatacaaaaaattagccaggtgtggtgcgggcctgtaatcccagctatttgggaggctgaggcaggagaatcgcttgaaactgggaggtggaggttgcagtgagccgagatcacgccattacactccagcttgggcaacaagagtgaaactccaaaaaaaaaaagttgtatgaggccgggcatggtagctcacgcctgtaatcccagcactttgggaggccgagctaggtgggtcacgaggtcaggagatcgagaccatcctggctaacatggtgaaaccctgtctctactaaaaatacaaaaaaaattagccaggtgtggtgacgggctcctgtagtcccagctactcaggaggctgaggcaggagaatcgcttgaacccaggaggcagaggttgcagtgagctgagattgcgccactgcactccagcctgggtgacctagagtgagactcaatctaaaaaaaataaacagttgtatgaatgtgatctctttcttaaaatatcttattgtactatactcacccttcttgtgatgatgtgagatgcttaaatgcccatgtgatgagatgtggtgaatgacataggccttgtaatgcagccttaggctcctactgaccttgaacacaagcccactgcagtactgccacagtcactctgataaccaagacagctactaagtgactaatgggcagacagtgtgtgcagcatggatatgctggacaaagggatgactcctatccagcgagacagagcagggtgactcaagatttcgtcacaacattcagaagggcttacaatttaaaacttatgaattgtttatttctggaattttccatttaatattttcaggccacagttgaccatgggtaactgaaacctcagaaagtgaaaccatggatggggtcaactaatgtcctttggtatggtgggagtgtcgagtatgaaatgggaggacagatgaggctacagataagcttagactttatcctcaaggcagtgggcagccactgaaggcttttaaacagagctgagaagtcgctgttagattttctggcaggaggtcaccagtaaccttgaacagagcagtttctgggaggtaggagcagatgcagaattccaagagaactgtgtttttcttgtcagaccggggctccccagggaatgctatgttgctcccatcagactggtgtacatcaagggtgttgtgatacttccatcaaattggtggtttcccaggacattgtgtgtttccccagagggctatgtgacccttccccaggtactttctcaaagggtcttgagtctctcccatcagactgaggaatcctcaaagctaagaaaccattttaggctgggcgcggtggctcatgcctgtaatcccagcactttgggaggccgaggtgggcggatcacaaggtcaggagtccgagaccattctggccaacatggtgaaacctaacaatgcaaaaactagctgggtgtggtggcggtcgcctgtagtcccagctactctggaggctgaggcagaagaatcacttaaacccgggaggcggaggttgcagtgagctgagatcgcaccactgcactccagcctggagacagagcaagattccgtctcaaaaaaaaaaaaaaaccatttcatggacagaacgagacgctgtctcaaagattaggaactcctctgtgggtcgtgtgtgccgtgagactggactccctaaagggctctgtgtcccttttatcagatgggctctttacaggattctgtgtctccctcattggtcttgagcacttgctccctggctgtacttggcaagggcttgagctggaaaagatgaccagactcccaccgcccagagggcgtcccctgcaggagagcttcatgcgcctggtggaggcctgtggggactcggagcaaagcatggacaactggctgagtcggctggacggctgccgctgactgtaacatgtaaagcaggcactgagcaccacctgcctggcagtccagggcatggagaggtaaggccccattgacatagagaatagggtgagatgggcagggctctcaacccctggatgcaaaactgtgattcagtaagcaaatatagcctagaactgggtccattctattcctggcctggtacatggggctgaaggcacagacagcaccctgcttgtgacttcactggcccaactcatcctggaccccttgagcaagaccatggctggattccaggaactggtggagtggaagtggatccaggaaagtaagtgaccacccaaccccagccttaccctccatccagaaacttgcttcctcgtgcccattgctctgccccctccccaggccagccaccccttccagctgcgctgtgcccattcagccttctcccatgcccaccccaagcatgaggcacccacctttctcctcttcctggactgcgtgtggcagctgggctgccggttcccactgtcattggagtttggggaagggctactgttggcgctgtttgggcacgcctatgcctcctcttttggcaccttcctctgcaacagcgaaaaggagaggtgagctgagggggtgttgaggtagcttaggggcaggcacaggaaagggttggatacctgtgccatcagtgccttacttccttttttttttttttttttgagatgaagtctcgctctgtcacctgtcgcctggtctggagcgcagtggcacgatctgggctcactgcaacctttgcctccctggttcaagctattctccagcctcagcctcccgagtagctgggattacaggaatgtgccaccacgtccggctaatttttatacttttagtatagatggagtttcaccatattggccagtctgatctcaaactcctgacctcaggtgatctgcccacctcggcctcctaaagtgctgggattacaagcgtgagtcactccgcccagccagcaccttacttccttaggagccatctttcccgaattcaagtgggtttgtcttttaggaaaactgagtgttctccttgccccacctccaaatctcatacttcctcctaacttctgcaaacccagagataaataggtccaaggccaatcctttagacagacctactctgtccatagccaattgcaagtgaacccctaccttgaaaacaaggattaaaggggaaatttgctgcaaaaataatttataaggctctctaccactttgcaaggtcgattgtttcaaagcaatagaacagaggttgaaagcagagtggaatcatttgggctcaaattccagtttcaccactcacctgctgggtgttcatagcaaacccgtctgagtctcaatctcgtcggtagcatgaaggggataagagcagccataatctggccgggcgcggtggctcacgcctgtaatcccagcactttgggagctgaggcaggcaggtcacctgagatcaggagtttgagaccagcctggccaacatggtaaaaccccatctctactaaaaatacaaaaaattaggcctggcacggtggctcacacctgtaatcccagcactttgggaggctgaggtgggcagatcacaaggtcaggagatcgagaccaccctggctaacatggtgaaaccccctgcctactaaaaatacaaaaaattagccgggcatgttggcacccgcctgtagtcccagctactcaggtggctgaggcaggagaatcacttgaacctgggagtcagaggttgcagtaagccaagatcccaccactgcactccagcctaggtgtcagagcaagactccatctcaaaaaaatataattagccgggcgtgttggcacatgcctgtaatcccagccacttgggaagctaaggcatgagaattgcttgcacctgggaagcagaggttgcagtgagccgagatcatgccattgcattccagcctaggcaacagggtgggactccattaaataaataaataaataaataagtaaataaaagaagtggtatttttattatttggttggcttgttgcatatgctgcctatcagtcccagatgccagctgtcttatgagattgagagatgcggggagggagggttcacctttccagggtgaagatcagatttagttatcttctgttgctcagtcttcctctataccccatcctgcttcactaaccccactagtcctggatcatctctatttacctccctctcccccatccttcatctttagtctttctcctaaaattgtctgagtttggtcctcccttgccagaaggccctccccccgtcttcatccacactggtctcttccatctggactctccggcagccgcctcactgttctctgcatcttcattgttatcaattttctttcaaaagctcctgggtccagacctatcaatattcacagtgggccctttcccgccttctttctttggctcatgccgttctccccatgttggctgttgctttgcacagtgggtatgctaggtctgttgagactcagctcaaacatcacattcttaattagccttctctgacattgaggcaaaactaaattggtttctccctttaaatagaactccttaagaagtaggactttgtcttgttccccttttattctagtgcctagtacaagatctgactagcaataatgtttgcaagaaaaaggagaaaagtaaaggttatcactgctccaaagtggctgtcaccctactaaccagggctgcccacccagactcccagagggcatacctggggctggaaactcactccctgcctttctgcagatgccgtgtgaagggaggactcagatgcactccctgtggtctgggctcaaccagccaaaagagcaacaaagactccagaacccactctacctcctcaatcccttggccatctgtggagccccagagcctgcggctgtggcaaggtgagctccacaccttctcccctgggtattacccctctgctcagcgtcctgacctgtcttcctcctcctcaggcctgtttctgcgctggacctgctcacctgagcctgcagaagctgcatgggggaagagtgtggcaaatagtgacaggaagggagaagacagaagcctctcagccaactgcttcagccgagcccctattctaagcactggctccttggatagcagctgagatgttcctgaaacctctgcaggccccttaggacctttacaccttggatgagggtgcctgcaacccaggttagccaaaagtactgagggtcttaagtttgaagtgtccaaagtatagggaggtctcaataataaaagtctccatgatcagcatcagcttgctggggtgtcagtgaaaaggaaaaatgatgaaacagacaccacaaaatatctgaccagaagccatttattaccaaaccaatttatttcttagagttcaaaaccttctgtgagaatcttctctggcctggttggagatccaccttcttcttttttttttttgagacggagttttgctcttgtggctcaggatggagtgcaatgacgtgatctcagctcactgcaacctctgcctcctgggttcaagtgattctcctgcctcagcctcctgagtagctgggactataggcgtgtgccaccatgcctggctaatttttgtatttttagtagagacgaggtttctccatgttggtcaggctggtcttaaactcctgacctcaggtgatccgcctgccttaaaaaaaaagtggtgggattacaggcatgagccaccacgcccggcaggagatccagcttcttaagcctcaaactcaaattcgaagtactgtgggtcgaagtaatggatacggacgtaaccatcttcgccgccgctgctgtagctggaaaaagatagccaggcaccagtcaggtgcttactctgggaaaggcagagacccaacccaggcttaggtcagctgcttcactggtaccctacctcttgccatcaggatggaaggcaacactgttgataggtccaaagtgacccttgactcttccaaactcttcttcaaaggccaaatggaagaacctggaggaaaagggacacaattaattcactttctatcttcttccaaaacactttggaggtggcactccccaaatgcaaattgttattattatttatttattttgagatggagtcttactctgtcacccagggtggagtacagtggcgcaatctcggttcactggaacctccccctcctgggttcaagcaattctcctgcctcagcctcctgagtggttgggattacagatgcctggctaatttttgtatttttagtagagatggggtttcaccatgttggccaggctggttacgaactcctggcctcaagccgccttccttagcctcccaatgtgctgggattacaggcatgagccaccatgcccagcctatcatgtgtatcgactttgattggtagttgcttgtagtgctggagaaggattctgaggttcattggaagtgagtgccaggaatgattagtacatctgccatggatacaatggaagaatggcagtatatctatgtctatgtatttgctgtgtgtaggtgaggtcttgctctttggtaactagttcagcactcaaagtggggacactcaggttgctgtcatccttttacagggttttaatctcttgggaagggccattggtcactcactgcatcctagcaactcccatccatgtccagnnnnnnnnnnnnnnnnnnnntggctcacgcctgtaatcccaacactttgggaggccgaggcgggtggatcacttgaggccaggagtttgagaccagcctggccaacatcttcttactaaaaatacaaaaagcagccagggacggtggccatgtacctgtaatcccagctactcagaagctgaggtagaaggatcgcttgagcccaggaggttgcggtgagcagagatggtgccactgcactccagcctgggcaacagagtgagaccctgtctcaaaaaataataataataaagcagaaaaattgagataagaagtgaatgtgaacaaaataagatggaaattggtggctgcgtgccatggttcacgcctgtaatcccagcactttgggaggctgaggacagaggattgcttgagcccaggagttcgaggccagcctgggcaacatagtgagaccctgtctcttacttttttaacttttttattatatggggaagactggacccagatgtctgcctgaatacataactaatacttatagagtgcctactatgtgctgggcagtgcttaaagagcttaataaatattaactgaataatttaatctgcataattttatgttaagtatattgtcattgtctcattatacagtagaggaaatttagacatagagaaatataatgaaggctgggcacagtggctcatgcctgtaatcccagcactctggaaggccaaggtgggcggattacttaaggccaggagttcaagaccagcctggcaaacatggtgaaatcctgtctctactaaaaatacaaaaattagccaggcgtggtcatgggtgcctgtaatcccagccacccaggaggcagaggcaggataattgcttgaacccgggaagcagaggttgcagtgagcagagatcgcgccattgcactccagcctgggtgacagagcaagactccgtgtcaaaaaaaaaaaaaaaaaaaaaggctgggcacggtggctcatgcctgtaatcccagcactttgggaggctgaggcgggcgtatcacgaggtcaggagatcgagaccatccttgctaacacggtgaaaccccgtctctactaaaaatacaaaaagaaaattagccaggcatggtggtgggcgcctgggccgctgaggcaggagaatggcgtcaacccgggaggcagagct

SEQ ID NO: 16783 - DNA, 9033 bp, Human
gcgcccggccgggaatgttaagacctaagccaaccacccctgctctaaatcactgcatggctcccatgtccctcaaaagagacacggcccccaaggccctgcttaaccggccctggggtctctctaatctctctacctcctccctcacccacctccctgcactccagcctcagccacctccccagtcttcttgagcacgccggacacatgcccaccatggggcctttgcactggccgttccctctccctctccagatatccccgaccttcctccctcacttcctttcctgatgagggattttaaattgcagccccctcacacccacaccctcacccggctccatccctgtcttctctgcacctcatccctgtctctgccctggggctgcctccctgccagacttggacaacaggccctgagagctggctctgcttggttccctgctgttttgctgttgatttccagtgcccaaagagacccagcacacagtaggtgccacgcaggtgtcagccttgaggattgctagttactgccttcctcactggaggaagtgccatggggggcgctgaggtgagaaaacgcctttgaaaaggtcacacaggccaggcaagtggctcacacctgtaatcccagccctttgggaggtggaggcgggcagatcaccttaggtcaggagttcgagaccaacctggccaacatggtgaacttgtctctactaaaaatacaaaaagccgggcgtggtggcaggtatcagtaatcccagctactcgggaggctgaggcaggagaatcgcttgaaccccggaggtagaggttgcaatgagcccagatccagccactgtactccagcctgagcgacagagcgagacaaaaaaaaaaaaaaaaaaaaaaaggaagaaaataaaaaagaaaaggtcacaaggactctctgggatgcctgtgaatgcctggcaccaagaggcctggctcacaggtgctcaaccaatgctgctgatccgtggatgagggcgtccccataatcgtcatgttcaaatcctggctccaccagctgctctcctgactgtgccccagttgggcatgagtgtccttcacagaggtgacacaccagtccattcaggtcaagggcgcagagcagtcctggcagcacacagtaggagatttattggagctctgagcctggctgtggttggcggcttccctgcaggcctgccccacccgtgtagcatggctgccgcccagacccgcccgacgtcccgcccagcccagccggcagcagcagggggcaggatttcccgctgatcccggcggtccgtcctctgcagtttaaaaagagcccagcggggcttaaccctcccgcgtccggccggcctccgatgccccccgtcccctgttctgtgcggaactccggctttggccatctgcctacttctctgagcttcagtatcctcatctgtaaaaccggttcccctcatttcagggtcaaaaatgagcattcagtgagcacaaggagccctcagtcgccaggggcatcctccccctccccgcggcggtgccgtttatctggccaggggaggtccacccgggaggaggtgactttgcagcctccagccgctatcgcttcctgccttcatcttgggaacaggccgtgctgtgcgccagcccggggagcccaccgtctggggaggggggcgattaaaaggtcccaacctcctccccaggagaccaaagaggttggacggggccccgggtactaggctgggtgggggttgggcgcctgggccggtcgcagttgtctgggggccctggggctctctgcgtcgagagcgctcgaagacccgggattcctggcccgatcgcgggcggggggagaccccagctccaccccagctcccgccggctcggggaaggggcggcccctttaagagcgcgcggccccgcccgccccctccgggcaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccaggtgagcgcggagacccccagcactccctgcctggtgcgcatggacgggggtggggaggcggggcgggaagcggcgtcctcggcctctgttccccggggctgtgtgaccttgggcggccccgcaccctctctgggcccagagccccagcaccggcagggcctgcggaggccgctctgagtcctggccccgcaggcaccggcctggagcgctggggaggcttcttggaggaggcggggcctggccctggccccggatcgccgagaccggccacgctgcgccgcctggacgccgggctcctccacccacagctctgcgaccttcacgagctcgaccctttctgcgcctcagtttcctcatctataaaatggagataatgcctccgcgcgctgagcccgagcgcggtcgtgctgttacactattgctgctgctatgtcgttaatgacggcacagcccttatggaaggggggccaaggaaggcacggggaccttcccgcaggacatggggtgggcaccagccctaagccatgcacataacccactctgaggtcaggacctgggttcctttcgtgtccactgggggccttagccgttgtcttcacttctctaggtcccagcccttcacaatgggcgcgcctccctgcctgagagggaggccccagccaagccccagtttccaccgcaaaaagccacacagcaaacacttaatggaccctaaatttataaaaattatcccatagagtcctatgaggcagggaatgttactgtacccatttcgcagatgaggaaacttggggcaccgacatttcccagagccaacatgtaaaccaggcatttggcctgagtgacagactggtgcaggtggccagcagcttaatttgtactgagcgcttactgggtccccacagcgatcctgaactgtgttcctgcccacagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagtcccccagcaccaggtgccagggacccgacagcacagccagtgcctgcaatctgtccctgaacctcccagggtccaccctgctatctgcagaacagtctgccccacaaaaagagtgcacatgttgagcaccaaaccgaggaatgtatacctgaccccaaggaaatgggtagcccacagagagggaggtgccggggagatgacgcagcccagccgggcctgggacaggatgcgggctcctggcacgatcttccctcactttgtgtgctaactgtgcctcaactgagcttgtgcattccttcttctggggggccgcatgatcggggcgcctcctctgtgccctccctgcagtcagtcttaggcagatgtacccacaacctcatggaggctcgaggttgagcgggtgctgtgatgctcggttgagacgaggcatggaaaaacctgggcaaggtgcctggcacacagtaggtgccccagggggctctgcaggtctccccactccccaggcacccctgggaagcctagctgggttgctgctgttgctgggagcagggatcctgtttggaattacaggattcgttctactctaagcataggcgttgctgggccctgcccccaagtctctcctctcccaggatctgggtggcccctgccacccctgagggctggaccaagagtttccttcttatcagaaggtcaggactacaatgtgcctgcctgggaggcagatagcggatggcagtgggcagagcctggggccccaccccctgtcctggaccagggtcactcaaggccccacctgcttatttcctctggcggcaccactgccgctgtgggcggggaggcgggcagggctgcccacatagccagcttggcagcgctctggctctggtggggggctgtatgtggtgcgtgctcacccggccagtggtctgtgtgtgcatgtgtccgatgtgtctgtggtacgcctccacatcagtgcccacccaggggcatggggccccctgcacctgtgtcctgtagcctgcctggccttcctgtgggccccagccttcttgtctgagaagtgggtgaagcgggagtgaggacgggctctgggccttccccaggtctaggggctgtgggatgttcgtcaccgggtctcagaccatggcctgaccacagtcccatcatctcatcctgggcagctccctggacccagagagccaagaaaggggagccggtgaaaggtcatgtgtgggccgggcgtggtggctcgcacctgtaatccagcaatttgggaggccgaggcgggtggaactcctgagcctgaccaacatggagaaaccccatctctactaaaaatacaaaattagccgggagtggtggtgcatgcctgtaatcccagccactcaggaggctgaggcaggagaattgcttgaacctggaaggcggaggttgcggtgagacgagatcgtgctattgcactccagcctgggcaacaagagcaaaactccaactcaaaaaaaaaaaaaaataaaaaaaaataaaaaaaataaaagaaaggtcacgtgtggaagctgtaccccatccggggcaacactgcctccatccacttacccggaaagcctgacttcctcctgaccctggaatggctgacattaagccccaggaggaggacttgacctctgacccctaccctctctctctggcctcaggtgagggagattctgggccgctgcacctgccctgaccagtttcccatgatcaaggtctcagaggggaagtaccgtgtgggggactcgagcctgctcatctttgtgcgggtaagggcctggggccgccccagcgggcagcagccaaggtggtgggctgcggggcgcccggggcacagccgtgacctgcccacacctgcaggtgctgaggagccacgtgatggtgcgagtgggtggtggctgggacacgctggagcattacctggacaagcacgacccgtgccgctgctcctccactggtcagtgccagggtggggctggggctggacgggcaggggacttgcttctgtggctctgtccctcacatgctgcctgtcctctctccccgcagctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggtgagatgcaggaggacgaggagtgaggggtccagagggtgggggggcgtcagccctggcctgcatgatgggttgcctgtgcgccagagtgactcacaccctgggaaaagttcccgtgggtgggggcgggcctggcttcccatctccatggcaacccaaccaaaccaacaacacagctggggcgggccctgtggctgggcggcagccagtccagctcttgcttcctctggcccgtcctgggaaggggggtgtctagagcccaggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagccacctgtctgtttcttggggactccaccttggggccattcagaccctttcgaggaccctggagttaactgcctggaggccaagcctggcaactctgacctctaggcttaaggcgttatcccgcccagcccagaaatcccaggcgcactcaaattattttcccttttattatcccgtggtaggtgtggcataaagaatatgtccagtgaagctccaggagcaggctgcgtgtttccagtcaagttcatagccaagtcctttccatccaatgggattgtgacccattgaggtcccagaaaggactggtcatctccaatggagcttgggacctggttgggtccaatgaggttcaaaagggggccagtcgcttaggagactgggttggagctttcctcatccaatcagggcggagacttccctgtccagtcccagtgaagttgggcgatcccgtccaatccaggtccctgattgtcccagtcacaaggtggggcccatggatggcactgtccgatcgggtcacatgaggctgcagcgcgcgggatgcagcgccccctgcaggcgcagggccgggtgtgcagggcgcgcgcgcaccagagcgcagcgcagcagctcgcggaagagacgcagcacgtgccagttgtacttggcggagcactcgaggtagccgcagcgccagcccctgcgcactagggcggccagcgcgcgccgcggtccgaagcgcagccgctgcctgtcccgcttgttgcctaccacgaggatgggcgcttcgggcgcgcccgccggcctgggggccgaatggagatgagagacgcggggaccccacggccggagaattcccccagtgggtatacacacgcaggcgcattcccttcctacggccagagacaccgccccccccgccgccccaacgaaaccccaggcccatgtgggccaaagagcacatacagcttaagaccttcccacgggcgaaggcctaagacccggcccacgacgttgggagaccctacacactctcctcaggcaaaggccctgccagacctgtcctagctccccaccgccagaactgccgggcccctacctggtctccgcgatgcgctgccgcagggccttcacgtagtcgaaactgtccgggctgcagatgtcgtagacgagcacgaaggcgtccgtgtcctgcaagctccagtccttagcgtctggccactcctggggacaggaggccagggtttgcggaagcctcctttccactcttccgctctcgaaccctctgcaggggcctggacgctaatcc

SEQ ID NO: 16784 - DNA, 6631 bp, Human
agcctgaaaagtcaaaaacccagaagtttggccagatgtggtggctcacgcctgtaatcctcgcacttttggaggctgaggagggaggattgcttaagccaggagttcaagaccagcctgggcaacatagtgagattccacctctacaaaaaataaaaataaatcagctggatgtcgtagtacacacctgcagtcccagctatttgagagactgaggcaaggaggatcacttgaacccaggaggttgaggatgcagtgagctaagatcacaccactgcactccagcttgggtgacagagcaagaccttgtctcaaacaacaaaacccagaagtctgaaaagttacaacgtgaaagaggacatcaagtgaagggaaaaatcatggtaggaaagaaagatgaagccagcagtccccactcactgagctagaagacctggaacactagacagaggtggttctgagcttcctagtggctgaggagaggagtgaaagcggaccccagcccctgatccagcatgggaggatgaaagcacagccattgttctggagacactttctggttgtcattatacaggctccctggaggatgtgcctcctcccccttcaggatttagctcctctacttcccctgggctggtgtgggcacattgtctgtgctttgacagtccctagatcccatgtgttctagaaccttctctcccaaagcagaactttttttttttttcctgttttctgttttttaaatctatctcagcctcctgacaagcaataagatttggaatatttgttgaggggataaataaatgaactccttagtcagtgcagagatctgtgcattgcggccatttcttgagcattgccgccatttcttgagcattgccatgtgcaggtcagagacgtgggagcccccacacagcggggaggagagcagaggcggaggatgggggggctgggctaacccaggctttccaagctgtgatggggcaggagcttctccactagctcgagggagggggaacttgggctctgggcgcctgttttggaggttgcatccctttgaggggcgctacgggttgcaactcacgcaggaaaggtgaccttagtagtgatggaggtggagtgggccaatttctggatctttatttagtcacctccagccttgctgggacagggatctggggctaagctgctgtggtctcggcaccctctgtccccacttcccctcgaggacggctgtttgaatattgtctagtgtgggccatttacccccgtgggcaggaggaaggtaggagggacttcaaaggagacttcaagggcccccccactgcccttctaaccttgcagattcccctctcgggcctgtttcctcttctctcaaccagcgatgccaggctgaggctgtaggttcgagaatcacgtaggtaatgggcctggcacatagtaggctctcaagaaaaggttggagcctcttgaggagtctgcctgtgatggatgcggagcgcagacccagcgcagtgcggcgattcgcccaaggtcacacagccgccccccccaattcggaccccgggcggcctgactccgggggccggggcttgtcgggagccagcgtgggggcgagcagtgtttggaagagcggccgcggcagtgggtgggaaggggcttctattttggagcgggtgagaggagcgggacacgcggaggaggtaaggaaggggtaggccctctccgggatctctgtcccccagtcaccttcctgcgacccttcctgggaggggcgtcctgggcggtgggggaaggtgggaggggcgggcggttacctcatcgccgcctccgggaggccccgctcgctcgcgccggcggctggggcggcgactccaggcgcggaagcgagagaaggatagaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcggcagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggtagcggctcgaggagcgggcaggggcgtgtgacagtgtgaggggtgtgcgtgctcggtgcacacgtgcgtgtccgcgtggaggcctcgggcgcctggctgtgctccgggatggagggatgtgtgtgcgtcctgggatacttgcgtttcagcccttcccgccgacctggagacgcccaagcccaggctggaggccgggcgattttgcccaggggcgttcccttgctcctgtgagcgcctccacctttgcctgcctcggctgggggtgtggagcagctcttggtggtgcataacggtgccttcccgagagtgtggcgttttgtgtttggggccttgagcagagctacaatgggagagactggggtcaggagcaggggtgtactttctacgggggctggtggaggggttcattctctgccctatcatttttgtcccctggagcgaagactcgtttagtaatttgtgcaaagtaaaggacagacctccgaccctagagcagtgaagaggaaagagcaggcaggattaagcagggcttcctggagggagtggcatttgagctgaacctggaagaccgagtgaagttctgagtaaaggaagtggcaaaaacataccaggtggaaagaccagcaggtgcttacgctacggtcataaacggttacagctgacaatctgggggcgtggtggaccacggggctcgggccaagggctttggaattagtcttagaggccgtggtaagcaccgagagcatctagggaggagagcggcctgagccgagttggggaaagctgaaaagaggaagattcggggtaaacagaggggagaccaaggatgaaggaggctggctgacaggctccaggcacgatttggaaaattttaccctggtggtcatgaggagacggcccggaaagcttgggggaggggcacagaggtctgtatgggggtgatgttggcctgaggattagcgtccaggcccctgcagagggttcgagagcggaagagtggaaaggaggcttccgcaaaccctggcctcctgtccccaggagtggccagacgctaaggactggagcttgcaggacacggacgccttcgtgctcgtctacgacatctgcagcccggacagtttcgactacgtgaaggccctgcggcagcgcatcgcggagaccaggtaggggcccggcagttctggcggtggggagctaggacaggtctggcagggcctttgcctgaggagagtgtgtagggtctcccaacgtcgtgggccgggtcttaggccttcgcccgtgggaaggtcttaagctgtatgtgctctttggcccacatgggcctggggtttcgttggggcggcggggggggcggtgtctctggccgtaggaagggaatgcgcctgcgtgtgtatacccactgggggaattctccggccgtggggtccccgcgtctctcatctccattcggcccccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacttcactgggactggacagggaagtctccgccctgattggatgaggaaagctccaacccagtctcctaagcgactggcccccttttgaacctcattggacccaaccaggtcccaagctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttgagtgcgcctgggatttctgggctgggcgggataacgccttaagcctagaggtcagagttgccaggcttggcctccaggcagttaactccagggtcctcgaaagggtctgaatggccccaaggtggagtccccaagaaacagacaggtggctggagcaaaactttactgtcagaggctctgctgggccacaggtcttcagaacaccgggctcgcccggcctcctctaaggcattcaataatattagtaattaaatagcaacgctcatcccccaaccggaatgtacaacagaggtcccattgtgccatgtggtcccaaggggtctggtcccatgaggtctggtactcaagaggcagagggggctccctgatgcagaagggttaaggccacaaaggaaaaggagaagggatggggtctggggacagctgagctggtccatcacatccaggaatctggctcagccctcggggtgactgagtgcagggcatgccatgtccccagctctgcgggtccggaggggcggcgggggccccgaggcgtggggatacgtgagggtttacggtctggctgtgtgtccatccgaccccgtgcccaggtcctcgagggttcagtgcaagccagggggctcccaggtgcatctagtggcccccccatgccagggcaggggctgccttcatcggaggagctggaaagggcttggcttcggggcccaggcagcccattggccgtccggccagagtccccaggttggccacatttgccacccaggacgctgagggacgaagaggaggaactggaggaacaataggcagagtcaggagctggagggtcgggggcccgagctgggtcaggggctggtccagtgggggtcacgctagcaacagcctcaagggcccgggcattggccaggaactcctcttccaggcgccggaacagctgctgctcctgctgcgggtcgagctgcaggggtgtgcggaagatgctggccggtgtggtgcccaactctggactggggctggagacccgggaaagccggggtgctgcagggctgcgggcacggggagtctggggggtgctcctgcccgagcccccactgcccctgccccttggcacccatgagtgctgcccgtctcgatccctgcgcacaagcagcacagcctgctcctcgcggctctggctccgggcccgccgggcagggctggggaccgacagctgggctcccctgcctcctggggccccccggggccggccgcgatccagccggtctcgggactggctgcgcagggcaggaggccgtctcggagaggccggggtgcctgtggtcagccgccggctgggtcgctccctccgggggccagtgcctgtgtcatcactgcgggtaccaagggggccgctctgggcggaggaggctgaggagtcactgtccccggagtagcggcgggagcggggatgggggggcagctgatcccggggcctggggcagggggacaatagagacagatggggtaccacggaaggactggcatgcagaacaggcagggagaggaacagcagggtatgtggctggtggacggggctgtcaggggcatcggtctgtcctggggacttccagggagaagtgagcagcttcctccagcggcccagggccccaaaagccacggaagaagaagtttcctgggctctagacaccccccttcccaggacgggccagaggaagcaagagctggactggctgccgcccagccacagggcccgccccagctgtgttgttggtttggttgggttgccatggagatgggaagccaggcccgcccccacccacgggaacttttcccagggtgtgagtcactctggcgcacaggcaacccatcatgcaggccagggctgacgcccccccaccctctggacccctcactcctcgtcctcctgcatctcacctgggtggggtctcgggcccctcctttgtgcttcgtaagctaacgggagtcatctcaggccg

SEQ ID NO: 16785 - DNA, 35784 bp, Human
ttctgctctgtgtcctgaggcaagtttccaacctcatctttttacagatgagcctcattttacagatgagcctctcctttctcatctgtaaaatggaaattcataaattcttttcctcagagtatgatgaaataaaaaggaataggctaaggcaggccctggcccacaactcttcctccataaaccatagcaatccgcactaatcatggcaggcgtctgtagccaccaactggcccatcgagaaggcctcaatatggaggtggctgctccagcctagctggtcccagctttggccctcaaacatggcctttccctgcccaccaaagcaaggccttctcccccgtgctgttctcttgcatccagcctgtcctccagggcctgtaggtcttcacccctggtcaggcctctcggtcccaggactcccactgagctgattcagggcaggaagcaggatcccagagagacaagaaggctgcctaatttgctcccctgccaagcgccttctccacatctaccagtttcctgcaggaaaaatgtggaaagctcctctgcctgcattgtccttccctccattttgccagcaggcaaactcctatttcacccttggaagcccagctcaaatatcccttcccctcctctggccccctaacatcatggatcttatccttaggagcacagcttggccagtctgtctccctaggcaggtggtctgagctcatggctcctctgatccaaccccacattccccagggtattcacagcacacagccagtgctttatatatgttcactgaaaaaaggacactagcttggctcctggtcctgccgagggatttgaaggtgaaccctgcccttcgcggacccgggcatccacctagggggctggggctagaggtccaggaaggtgggcagggtcagccttgcctggaggcagggtttggggccaaggcacccaccgtaaacctcctcctgcatcgacacctcacaaccattccccagctctgggcaccttagcaagggtgaagggcttacccgtggacactcggaactgggacttgagccccctggacctcactttcttcaatctatgaaacggggcagtgcaccaccaggccctgcctaccttactgggaagccgggagggcagaatggaaagacaaggacggagattcttccggtggcggatagagtagggggtcccaggatctgtctggttcgaactcagctggtgactttgcagagatactcaatttccttgggcctcagtttccccttctgtagaaacaaggatatcggatgagggatgattaaagggcctgctccacctcgaccgttaccggggatagggtctcggggccaggcacggcgttcgaggcctcccacccagccgaccggccttggggacccttccccgctggcccgggccacgcgtcccgggtactcactgcagagcgcgcccggcaaccccgaaaggccggtcggggaccccggctgggagtcaggactctagctcccgggcgcgacccgagaaccctgaatccattccgcgcacacccggccgcgtgacccctgccgaccggctggcgcgccacccattccccgcggcccgcggattagtcagcagttgttctagtccgggtcccttcccccagccctcccgccgatctccgtctccctgcagggccgactcttcagcgaccgtccctagagccagcggacggaaccattccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacgggtgagtatggtggaactgcggtcgcgccggcggtagccggaacgcccaaactgggggtcgttcgtctctgggcttggctgggaagactgagtggagttgccgagagggggttgaggcacccgccgcggcccgacgagctcggggatccgcattcctctcccctcccccaaccgggcgggccggttctggaatcttccggcgcccgtggcgcgcggggggcttgctgcggcgggggcgcgcggggcccgccttggcctccattgtgtggcggtcctcgcgccctgagctccgggcctcccgccacgtgggcggggcctgcggccttcgaggccctgcgtgaaggggaggatttggccaggcctcaagccggtcactatgaaaccgccggggggcccgcaggctgctgtccctgtgaggcctccctccccgttttcagggtttcctgagaaaccaggggaaaaagcaaataaagataccgtggatttgtgggccgaggggtgccggcctatgagcgggagccccgtcatccttaagacccagtcggctggggcgtctggcgctgccgagctgccccctctgtggcttccagccccaagccgaacttctgctcgcctgggctttagacagaatgtgcttccctcctccagggcccccagtttgccgctttcttgggcttctccatttttatcgttattaatccacgtcctcccctcccccaaaaccaattaagtggcttcccagggccctttttctgcaaacgccgagggacatccgttgtataataaggccagcctgggtcgagagacgagaaacgctaccagaaagatatttctggtctctctgacctaggaggaacaaaaggccgagccttcatttgaattatgtttcagcagtggcctcgcacgtttattcgcctgcgttaggccggcaggcctgttgatttcgtaggtcgacagaggagaggggaaaaaaggccagtagaagcaatcttaaaggcacttgcaagcaagccccggttgggaactccaaaatgggagtagagtggtccttgatggaaggagcgtttaagagtgtcgcctagccatcacctgcagttcgcaatctgtgggtacactaacccgcgaaaattggcagggtggagcatttttgccccgggggtattctcaggccacctggttccaggccttagagacagtgggagaagatgagaaggaagacaggaaaagttctgggcactccagagtttttggagtccagaatccagcaacttaaggacagtttaagaattctccccatctgtggtcaataaacaggtaagtgttggctgttcgtgccgggataccaaagagtggataccaaagagtgccggtagaagagaggactgaaataccacagctaacctcccggtgggaagtggtttcctaggtgccctatccaccctcttctgctctgcaaaagcctgaaaaggcaaaacgtgtgcgttgacatttttgcgtggctggacgtgccttttttcagtcaactttgttcaaaccttgttcaccagtaactaccatgtgctgtactgtattagaattacagttgtggtttctgttgacacaaagtaaacacattaggcctggctgggggggccttcagagagtcacataagtaatctggtccttagtttcctttcctgtaaaatacagaagttaggctagacctcttaagcttttgagcccttctgaccttccagcataagcattccacaaatttgtcctatgctgacttcagctcaggtactgtgaagctcaactcaggtagtgtgaagcagcttccatagtgactgctctaaagtgttaaaccgttgccttgggttaataatagaagttttctctcctcgtatgttatctcatgtagaaaagtacgtaaagcatatatatccagtgcaacaaagaattggaatgcagactcgcagcaatctagaacccccagcgctcaatcacagtgaagtgatttttagtgaagtcagtggctcacttttgggggttaaaaacgaacacggttgctgaataatctgaccagtttgtaattgtattaggttggtgcaaaagtaattacgtttgcatcaacctaatagcttgcttgagggcctgtgatgtttgtgtgctctaggaagataaatgtaagttcatgaaacaaatttgctaccttctatagcccaccagttagtatagggccgaatcctgtggtttctcactgataagaggtcattggttgttccatatcagctttgccagtttgatgttttacataactgctcttgcgtaaaagtcgtcttgcaaacgttgaacttacatgacagtgatttacaatcacttctcaagcaaagacctcaacaaaacgtgggttaaaatatttgatgttaaatgattcattgctgtgtttattttgtagatgccacatggaaaaaatgatctgcatttagttttaatgtcagagagagtatgacttgtagtgctattgaaaatgcctttaagattgtcatgaacagattatttttttcattataggttagcctttgggcagttgatttgttcctcttggtgattcagggttttgagttaagagtgtgtacaaaggaaagaaagtagtccagtaaagtacagagaggtaggcagataagccaacgtgaagagatggattcagcaaagctctctcaggccgccgagggattgtgaggctggctttggattccatgaagtggatgccatgaagagctgtcaattgttggttttggatgagggactactttctgattggaaaataaaggaccccttttttccgtcctaatggcagtactgtcttcagacagaacaagatatgtgttcttgtggagaagaaagaattgggcagaattttcaaaaataattactttaactgcctttaaaaaaaaactaaatttatctaactttaatgcagtagcgctctgaaaactattttccgtttgtttttactacttgtagacacctcagtggaccagtttttggtccctttggatgcatgttataaatttcataggaaaaggaaaattatagggaggtttacttagataagggatgaaaattcatgtcttttttttaagttgaaatcattttgagttgtatgaaagacaatggtgttaccaaatttttcccagaaagactaaatgctttttcttctttgccagtcttcagggttctgccttagctctgcttcaccagggtttataatatatctagcttttaagttgctgcacaaatatagttctgacacagcaaaccctttaaaacactggagtgtggtgactgccttcttgtctgccattccgtttcactgtcgttgagctagggaatgatggtttgtctaacttgctaaagtgaggggagtgaaaactaatttttgaggagaggtaggttctaacgtaaccaatctagtgttaaactttgtattattgttgcatgcctccgttttatatgagggtagaaacttctgatcctgttagtagatcttgttgtcagtctgtgatattgatgatcatcctgtattttaaatgacagttgggattgggatgggttttgtggtcatgggaacataaaaagtatacctgccaaatcagctgatcttgacctcattagctagtcccatagtcaaatgttgagtttaactggtttagacttttttttctgttagatgttgagaggtaagggggactcatttggacctgtgttggcaggtctccctacagtttaaagaattcttcctgccacgtgaattctttcccccttttttctcttctccttgtttctgctaactttacactatttttcctccttgttttcctctagattacagtacctatagccaagctgcagcgcagcaggggtaagtcagtcttttataaccgtattttgtgtgtgattaatattttttgaatatggagccttctataattgtagaggtggtatttgaatgttctctattcaagttattgcatttaattcttttgcagctacagtgcttacaccgcccagcccactcaaggatatgcacagaccacccaggtaatctttaaaataattacatgtagctgcacctccaagtaaaatcagtatattatccagttatctttcagttatccagtaaaacaaatgagtaatgtgtttggaatagtaaaatacccaggcattttaaactttcacagtgggagtgcgaaggactccattgtgccatcataaatgaaaccattcagaagctgataattgactctttataactttttaatatgatttctcaagttaggtgccctgttccatgcttggtccttcttcattatgtttaaatttagtgaatttattcatcatagcaattctgcaaaggaagaggatgatatgaccattctgcagaggagaacattgcagtgcatagatattaagtaacttgccagtggttgcacagtaagtggcggggttagctctaaaaactggcgacctagccaaggagctgctgagctctttccagtgaagagtctgttgaaaagcctaggccaacagattctagaaattagccttctagtgttttcaagataatgttgaattctgaaatgatccatgccataaaatggatactaataactgccatggaaacatgttctaggacaagcagaatgtgatgtctctggcagatcttacataactggtcatttaaacaaacctagagaataatcatgctaatatctgaaagaacaactcttccttgcctgattttaagtattatggatgtctaagttcaaaagacagtactcttgatgtgcccaccataagaggacatacagcgttctggttcattttctttgaagtggtatagtagttttaaagtctttttgtcaggctgaaaatctggttttcaattttttctgacagattttagccctcttcattgctttctctgttcatttgtcttcgtaccttttgtttccaatcactaaaactgtgctacgctaagtgctagcagttaatacacctgtgcccttattgctcttcccttgagagtgtcttgttaatctcatgtatagttaactgaggttttgcctgattatcttttttttcccccttttgagaagctgtgaatgacattgcctacttacctaatgagctttttccgtagctaactttaccataatatgagtgaaccagataagggataacattcatgatactgtgattatttgtcttgttttgttgtttttgttttgtttttttaatcttctagaaaggaatgtttttgattttggttctccaatttagtccattttattgctaaaatacaaaagttcatgtatgaagttcttgcattcgtttttttttggagcaggcatatgggcaacaaagctatggaacctatggacagcccactgatgtcagctatacccaggctcagaccactgcaacctatgggcagaccgcctatgcaacttcttatggacagcctcccactggtaaggcctgccttggagagatttttgggtcgttctggctagggcattggctaagaagcttattagtcatgctttcggatgtatattctggtccataccttggcatctggggaatcctttattcttaggaagaggtattttttctctttcttccctactcttatagtcttgagagatctccaatagaatgtgggtgggataaattccaagagagaaaagaacttttaactgtttgaataatctcacgatgaaatggagactatgtaaaagattttgctaatgctaatactgagtaagaatgagtcttcttaaattgagctgcttaaaaatcaaactggttttcacatgtttgcttcatctgatagtgtaccctctactttttgttttgtgctttccacagtagaagggaccagtacaggtttgactatcctgctcattcttgcatgggaaatgctttccatcttgtctaaccctgtaatgttaatcctttaggtgttttcatttgttgaacccccaaactttctaacatcacacacagcaaggtgctaatgaaaaactgcttcaggtgccatttgcagatccatgtcctattctttatatgattttgggaaaggtttttttatttaatattactttgtttcaagccttaataatagttatttaccttcccaaaggtatttcaggtgatttctccccagctgattttcccctgttccctgaaggatagattgcatgatgagatttatttagaggagcagactgccaccctgcatgtatcatgtttgtctattggttggtttctagtccagacacattttattttctgttttaagtgttatgaattattttaatccatggtatgtcttgaatatatataacattattccaagatactaaaaaataaactattctaagaattagaagaaattgtattccgatactgaggttgggtgggatacatgaaaaacctatgataatttttttgtgttcagtgctgtgtaatgtttcaggctgtctccccctgcccttttattattgctgttataaaagactctaataaagtcttaaagatatcagagctcttattttcaaactgtctttagttctccaaattatatatagtccagttaaggggaaaaacctgtctgtaatttatctcattgagtaccagtgtcctgattttgatgggaagtaattcctaacccttctagggtgtttctcaaataggatgggaaatgtttatctaaactttctagtggtgttaattgcagctgtgggaagagctggaactaaggttatgcagtttggattttttagcatagaattttgaaattgtgagataaacttcatgtattaaagccattacattttttaaaacaagcatgatgtgaaagttaatgtggcctagatctagccttccgaatccttagatcattttacaggaatgagacggagtgatttataggcaaattaatggttctctagagccatgtatcacattgtcgttggttgagaaatccccatcatgactgtgggcctaaaaagtacaggtcattctagtttagagactagtagctttgatgagctggagattgcacttagtaataataatgtttgtataaaattcacagtttatagagtggccttcttgtctcccttaatcctcccaagaacttttggggtataaaaacaccaaaattaagcctgatgagcaaactgtgtgaacaaaacttagcaggagcctaattggtagtgcgtgggttcaagcacacatgctgcatttttccttacctcatactgcctttacacatgaaagttatcggatagtcattggagggaatacatagaaatacactgttctcttctaggatttttaaaaattaaacttcagaagaaaggggttatataaacctcaattcaatggaattcttaaaaacttcttaatttttacgttgaacaaaagttttggtttgtgtaatatttcttaccacctttttccttcaagttgtcagcacatagtaggtgtgttttctttttttgccactggtcttttgtttttttgtttttttgttttttttttggtcattaaatcattttgctctgttgatttttgttcattttgcttggctgcttttgtgggtactacagattaattaaaaggttatttattaacccagtgtctattgctgtaatctttagcatgacaaggccctaactgttgctgcatagttttatgacatgagttattgccctgatcacttttagttttttgtttttttaattgccctccttgtaaatcttatagacgtgtcatgtagtggggtgtaatcggtatatgaacggtagggtagatggtattagattctaatttaaataaatgaatgccttatgtggttgaccttaggactctgcaaaaacttaagcagttcagatgaacaacatgccaactcaaaaacttttattgcttggggcttcctgttttctggaactatgtatactttcatacacattttaactcagcagttttgacaaggacattactatctctgtgtataatttcagaatttccttttaatatttgaggtagagaagaaagagtattattatattctgtgctacaaatggtgattgtacaaaaggaagctgatacttgtttctggccagtacatgaggacactttaaggccctaaatcttaactaaaatgggcagtcttgattcaggatttattttaaatatggaagctttttctttagtgagatgtagactttttttttggatataaatgccagcacctagaccaaagttttgttttgttttgtttttttaagatagggtctctgttgcctaggctggatcttactgcagccttgacctcccagcctcaagcagtccacccacctcagcctcccaagtagctgggactgaaggctcacgccaccatgcccagctaagtttgtttattttttgtagaggcgaggtctcactatattgcccagggtggtctctaactcctaaactcaagcagtcctcccacctcagcctcccaaagtgtaaaccaaactttttattgcatggcttaattgtacccattgaccatgaggaagaagagtccagcaccaggaatggttgtaacacctcctacaggaaaggtactctagttaggagctgcagactttcgtggttttggtcatgctccacgccgaagtcccgaagggaaaggcatggatcctgcctggtctggcagaggcaggagctagggatagaatgcatcttgctttgcagcatacctgtgaaaccaggttttttctgacacctggttagtgaaatactgaaggggaggagagactctagggtttacctccaatattgctgagcaggaaaaaggccttttgcttgtggtaggtaagtaagaggaatggagctgagtaacttgataacgaggcaggaatctgctttatgatgtgaaaacattaccttttaaatgtttgtttggagcaatatcgaagtttaattttaaataatttacaaaaaaaggataaactgtgttaagcaactataatttatagcttatttttattaatcatgtgctcaagtaattaagcttgtgcttcacatgatgttagtgcttgggaccaaaagaaagtgattaaattaattactacccaaattacaggttttagtgctagaactagtacctggatcattttctaattattttaaaatgctatgtcatttgccttttaccttttcttctgggatgttttattcctgcttgagggtattttggggtaagtttgtttacaaacttgttaagacgacctgctagcaaaatcagtacagacttggcaaaaacagacttgtctcctattcacagcattcaagagggggcagaaggaaccctgttttctgtagcatgacatgccatttctgttaggtgtggttttagagcaaatgagacagttactttaccaaaaactaggtacattcagagaacttaggctttaaataccagtttgttgctactcttgcggaagggggaatatttaaagggattcaatatcctgatggtttaaagtaagtggtttacaaattgttctgataatgagtgtctaggcagatctctgaggggacctgaaatctgatgcagctctcctttgttctaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaaggtaaggccatggtgtccttaatgcgtcagtcttatgttggagggaaagaaagcaactgtgtacacttaaaataatctgtggtttagttccttattagtggttgctttcatatactctcagatgttcactgttagtaactgatgtgctagaacataccacagaaatattctgcatttaacagtgaaattggctgggcgcggtttctcatgcctgtaattctagctctttgggaggccgaggcgggcggatcatataaggtcaggagtttgaaaccagcctggccaacatggtgaaaccccgtctctactaaaaatgcaaaaaaaccggcagggcgcagtggctcacgcctgtaatcccagcactttgggaggccgaggcagggggatcacaaggtcaggagatcgagaccatcctggctaacacggtgaaaccccggctctgctgaaaaatacaaaaaattagccgggcatggtggtgggtgcctgtcgtcccagctactcgggaggctgaggcaggagaatgtcatgaacccgagaggcggagcttgcagtgagctgagatcgctccactgcactccagcctgggagacatagcaagactcggtctcaaaaaaaaaaaaatagaaaaattagctgggcgtggtggcgcacacctgtaatcccagctactggggaggctgaggcaggagaattacttgaacctgggagatggaggttacagtgagctaagatggcaccattgtactctagcctgggcgacagaggaagacttcacctcaaaaaaaaaaaaaagtgaaatggtgctatcgaagggtcaaaatgaggaatggcactgaataggttctctggtttcagaatgaccttttagggtaggagaaggctattgtttttaaacccagaagaagagagagagagagtgtgtgtgtgtgtgttttcactcaaaacagcataactgatagaattgtacttttgaattgtacttttgatgcttttatctttgatttcattgaccctgtaaatgggtaaccgctttctctttggcaaaaacatggtagttcacacaggcaggaggggaagggagcatcatgtgagtcaagaaatggtcgtatgacctaattgtctggaaaggacataaccatattcaagaaatcaaacattactgtctcggcttaagcaattgacatgacttccctacattgtatagaggcttaatctaaatattataggcaaataaaaattcttaactgggtaccctgctataggatgagcagagctcataccccatgactggttagcaggtaaacagtataattattacttaacaaaagattttagatctttgctttaggcagtcacttaactggcttgtgtatacagtcttgaaaggacattgaattctggtttgaaagaagacattttaggaaatcaacttctaacctagatatatctgctctagaggtaagaaattagctctgacaaacactcgtgaaattacttttaaaatgcacagtgagtaatcggagccgcttggcaatttacccttggtagaccacctttgcagtagctaagttaaacttagtggcttattcctgaaaggcctcatttccgagtgtcatcagatgtatgaagtcccatttgatactctgatgcaacagtatatccaagccatatctggagggttttatatatgaattgggttttgataagtcatcctttttttttcttttcacttgttaccactttaaaacagctgtctgtctcataatcagtggcaactgctttttcgactggaaaagggtatgggacctatttcagctcaggaaaagttagtacttcacaccctctctggtttttctgggttggttggttggttggttggtttttgagatggagtgttgctctgttgtccaggctggagtgcagtggcgagtgcacccaccacccaggttcaagcaattctcctggcttagcttcccgagtagctgggactacgggcatgtaccaccatgcccggctaatttttgtatttttagtagaggcaaggtttcactatgttggccaggctggtctcgaactcgtgacctcaagtgatccgcctgccttggcctcccaaagtgctgggattacaggtgtgagccaccgcacccggcctgcctgttgattctttggactttgcttaaaatattaatagctctaactcagtctgctgcagccttgatgtaaagtgttagggccaagaggtaatagaaacccctggagttttccttggaactgagattaattttcgtcatttaacagggatacttacttccaggttcatctgagcagggacttgggaggggtctctttgccttactctggtgtttccattacggagactttgagccaagttagattagtttatggcagcccagtttaggaaatgatttttttctggttggttggatggtttggttggttttttttttttttttaagatggagttttgctcttgttgtccaggctagagtgcgatggcacaatctcggctcgctggagcctccgcctccggggttcaagtgattctcctgcctcagcctcctgagtagctgggattacaggtgcccgccactctgcccagctaattttgtgtgtgtgtgtgtgttgtttttttttttttttttttttttttttttttttttttgacagagtcttgctccgtcgcccaggctggagtgcagtggcgccatctcagctcactgcaagctccgcctcccaggttcatgccattctcctacctcagcctcccaagtagctgggactacaggcacccaccatgatgcctggctaattttttgtatttttagtagagacagggtttcactgtgtttgccaggatagtctcgatctcctgacctcgtgatcctcctgtctcagcctcccaaagttctgggattataggtgtgaaccaccgctaccggccaattttttgtatttctagtagagacggggtttctccatgttggccaggctggtgtccaactcctgacatcatgcaatccacctgccttggcctcccaaagtgctgggattataggcatgagccaccgcacctggcagtttgttttttttgagatggagtctctctgttgcccaggatggagtacacgatcaacagctcactgcagccttcacctcccatgccccagcagtcctcccacctcagtcttccaagtagctgagaccacaggcatgtaccaccatacctggctaatatttttctatttctgtagaggtggggtctccctatattaccaggctggtctgaaactcctgggctcaaaccatcctcctgcctcagcctcccaaagtgctgggattttttttgtttgtttgtttttgagacggagtcttgctctgtcgcccaggctggagtgcagtggcgcgatctcggctcactgccagctccgcctcctgggttcacgccattctcctgcctcagcttcctgagtagctgggactacaggcgcccaccaccatgcctggctaatttttttttttgtatttttagtagagacagggtttcactgtcttagccaggatggtctcaatctgctgacctcgtgatccgccctcctcggcctcccaaagtgctgggattataggcatgagccattctcgcctggccttgacctggtctgtttttaataaatgagaaacataaacccacaaattctctaaatttatgatgccatggacttacgtaaatgttacttcaacctaaaacttaacattattgttagtttctggtcttcagcagtcccctttgagaaaaagcatttattccctaacagatcacttctcccggatcacctaaactggtagcacacaatatcgcaacgcacttttatagcgtttactgtgatgaatggagcatattaatgtctcttctgtggatatgattgattctcccccttccttagtgttgtcttcaagcaaatatagttggaccgacactgagtttgatgtagtttactttaggattgtatttattattgtatttatttccaggcttaatcataacattgcttattgctcgtagctttgtagcattcttacccaggagttttgtggttgaccaaccacacaaaaaaagtcactttttaattttatttattatttctcctcttagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccaggtcagtctactttttgtggcaaaacaaaaacagtgacaaaacagtttttttcaggttgttgaccagcttgctttgacttcttcagctaaggtatgttatctgactgtcgcagtgataagtcatctgaccatacttggttacattaaagcctgagatctagggtcccatagtgttgcctggcagctaataactattcttttttctttttttttttttttcccccgagacggagtctctctctgtcgcccaggctggagtgcagtggcgcgatctcggctcactgcaagctccacctcctgggttcacgccattctcctgcctcaacctcccgagtagctgggactacgggtgcccgccaccacgcccagctaattttttgtatttttagtagagacagggtttcactgtgttggccaggatggtctcaatctcctgacctcgtgatccacccatctcggcctcccacagtgctgggattacaggcgtgagccaccgcacccggcccagctaataactattctttctaaatacaaaaacatttttaccactctaagttctttctttaagtttcttccttttgctgttttagttaactcagatgggaagcagaagtatatgaaagcatgtaaatagatgtaagagccatcttccccaatgcagttaggataagtaaagcgcagggcattataattcaccttaatcattttacattttacctaacacataaaggtttattcatgcactaaccttttaatgtatgggccaactctttttattttatttttattattatcgcctggccaagttttcttttttgagacagagtctcactctgttgcacaggctggagtgcagtggcacgatctccgctcactgcaacctctgcctcctagggattctcatgcctcagcctcccgagtagctgggactgcaagtgcatgccaccacacctgactaacttttctttttgttttattgttgttttgagatggagtttcgctcttgttgcccaggctggagtgcaatggcacaatctcggcttactgcagtttccacctcctgggttcaagtgattctcctgcttcagcctcctgagtagctgggattacaagtgctcactaccacacctggcaaaaatttttttttttgtatttttagtagagacagggtttcaccatgtgggccaggcttgtctggaattcctgacctcaggtgatccacccgcctccacctcccaaagtgctggggtgacaggcgcgagcccctgcgcccagccagtttgtttgtttgttttgagatggagttttgctcttgttgcccaggctggagtgcaatggcgtgatcttggctcaccgcaacctctgcctcctgggttcaagcgattctcctgcctcagcctccctagtagctgggattagatacagacgccaccacaaccggctaattttgtatttttagtagagacggggtttctccatgttggtcaggctggtcttgaactcccatcctcaggtgatccgcctgcctcggcctcccaaagtgctgggaatacaggcatgagccactgcgcctggcccagtttttgtatttttagtagatacagggtttcacaatgttggccaggctggtcttgaactcctggcctcaagtgatccgcccaccttggcctcccaaagtgctgggattatgggattacaggtgtgagccaccatgcccagcctgcaagttttcttaacccatgtttaattagatgtgggttttcaaattgtttgaattgtgccctgaaagttttgctagaagtagcggttcccttttttgcactcatttcattgttttgcagcagatgtgaacaggtttaggaacaagtagaattgattgggtgtctctccatacagccagcttggagcaaaagtgggtagggcttacaacccttcttccacagagcaggttcgtacctattgcattgagagcagttaatagcagttaatctggcaagttggataggtacacagtgagagattattgaattcatacagcaatggtgagggatgtggtgtgttagaagctttgtttgtttgtttatttttggagaccgggtctcactctgttgtccaggctggggtacagtgacacagtcgtagccccctgtagcctcgaacttcctggcctagtttaatcggactttaaaatatgtgtccttactgtttctcatcatgatttgtaaagcttaataccagatgggtttttttgtttttgtgtgtgttttgttttgtttttttgagacggagtttcactcctgttacctaggctggagtgcaatggtgcgatcttggctcaccgcaaccctcgcctcccaggttaaagtgattctcctacgtcagcctcccaagtagctggcattataggcatgtgccaccacacacagctaattttgtatttttagtagagacggtgtttttccatgttggtcaggctagtctcgaacccctgacctcaggtgatccacccgtctctgcctcccaaagtgctgggattacaggtgtgagccactgcttctggcccttgttttttttttttttttttttgagatggagttttgctctgttgcccaggttggagtgcagtggcgctgtcttggctcactgcagcctctgccttccaggtttaaacagttctcttgccgcagcctctcgagtagctgggactataggcgtgtgccaccatacccagctaatttttgtatttttagtaggtggggtttcactatgttggtcaggctggtctcaaactcctgacctcaggtgatccacctgccttggcctcccaaagtgctgggattacaggcatgagccttcaaacctggccaataccagttcttttcaagcttcatttctgtgcaagaatgtatctattaatttctcccatgtaattgacataatcttaatatttgtctttcatacaattccttcattctgaagtttcctctattaatactcagatttcatagttaatcaggcatgtctgaaagattgaaagtagcaaagacaaatctttgagggaaaactactatttttgtgttgagtacccttatcccttcagaaaatcgttaactcgagattattggcgggcaggcttggaactgaatgcctcacttcactctctctatattttctcagtccccatttcactgggtcagccttccccaagtgcatattcttgccacaatacaggaagcatctaaactcccatatttgcctgccttgaatatagttgaaaatgacgttttgttttgttcttttgagacggagtctcgctctgtcgcccaggctggagtgcagtggcactatctcggctcactgcaagctccgcctcctgggttcatgccattctcctgcctcagcctccccagtagctgggactacaggcgcccaccaccaggcctggctaattttttgtattttttagtagagatgggggtttcaccatgttagccaggatggtctcgatctcttgacctcatgatgtgcctgcctcggcctcccaaagtgctgagattacaagcgtgagccaccgcacccggcctgattttttgggtttttttttggagacggaatcttcactctgttcccgagtcgccaaggctggagtacagtagcggatctcagctcactgcaaactccacctcccgggttcatgccattcccccagcctcagccttccaaagtgctgggattacaggcatgagcctccgctcccagctgaaaatgaccattgttttaaatgggagtggcgattaagagaaaactctttaaggattatacagatggtggttataatatttccccctcccagctgggcaccgtggctcatgcctgtaatcccagcactttgggaggccgaggtgggcggatcatgaggtcaggagatggagaccatcctggctaacaagatgaaaccctgtctctactaaaaacaaaaaaactagccaggcgtggtggtgggcacctgtagtcccagctactcgggaggctgcggcaggagaatggcatgaacccgggaggcagagcttgcagtgaccggagatcacgccactgcattccagcctaggcaacagagcaacactctgtctcaaaaaaaaaaaaaaaaaaaaaaaaaatttttttgttttaccctcccatttaatgttttattctgaacacaaaagtatttgctgagttgaaattcaaattgttgatgtgtagaaagtaactactgttttatggatgtctgtgtcacatggtgtgaatgtctcttttattcaggggatttgaaataacaagcctctttctaaaaaagcttttttttttttctcttctctctctttcagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagtgagttgctaagagagaaaaccaaataagaatgaatgtgtttagagtttttttgtggggttgattttttttgttggtttgtttttcttttgagatggagtttcactcttggggctgaggctggagtacagtggtgccatctcagctcactgcagcctccgcctcctggttcaagcaattctcctgccccagcctcccgagtagctgagatgataggcgcctgccactatgcccagctattttttgtatttttcgtagagacggggtttcaccatgttggtcaggctggtctcgaactcctgacctcaggtgatcctcccgcctcagccacccagagtgttgggattacagtcatgagccactgcgcccagccacgtttggagtttttgaacagggggaatactctttgccattgtttgcttttggaatccaggacacatctttagggcatggcattccagctaacatcttggatgccccagtgaagatttcagtgcttttttccaatttgtttttagtatgccttggcaaaaaagaaaagagatactaattgatcagaaaaaatgttttagactgctagccctgctgtctttggggaagttgtatgcagtgagtaaattcaacatcgtttttggcctccctatcagtcattaatgtaaagtggggaggcagctattgcaggccactatgattttgatagtcaagtaaaagctatgtttttttgttgctgtttgtttatatccattaaggggaaaaatggccaggcatggtggctcacacctgtaatcccagcactttgggggaggccaaggcaggaggatcacttgagaccaggagtttgagaccaccctgggcaacatagtgagaccctgtctttttaaagataaataaagattctttaagaaaatagaaaaggaaagggggaaaaataatcctcctcacagaatatttgcagttcttctgtatggagagaggtaaccaaaacacataattatcttcagaatttaggatcattgctctttttaaattacattctatccacggggatttctcaacaactcaaaggagtagtgttgatttatggagctcagcccctagcagtgtgctaaagccctaagaaacctggctctgttttcatttcttgagtttagctcaaaagaagctgcttttggagacatcttaggatatagaaccctataaactatatgttagccagagggctttttttgttgttgttatttagaagaggtttattataggctaactatataaggttatttcagctgtgatgatccagcagttttgttgaacttaaaagagcctacctattaaggatgctttatcgtgatgtaaagaagatggtgccttggttagtgccttggaattgaggattttgtgattccaggagaaagtacatcaggcagtggtgtaaatgctggtccatggcttacagatgtgactctttcctcaggttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggtaagagcaaaccttttctccttttacctaattttgtttcatccataggattttcagtggaaagaagggactgaaagacataagaaattaatttctgcatttccatggacaatctgttgagctcaagccatcttctaaaacatggaaatgtcatctttgtggcatatattaagtggcagtttattttctttccctgccagtatacttcgttgggtcggggagaacaaagaatggttttgaaaccagagctttcagttcccttcatggtttccagaggtgagaagcctctgtgggtagtagatttgggatggaacacacacaacccttctaatgaccctaagttgttaactaactgcctttgaatggttgtcttgaaatacctggtgtatatactgcagaaaaggaatgcagctgttttccacagtgtttgtccccaacttctgtttgtactcagaatcgttgaacatatgaagattttggtcccataatccttaaactatagcctgaggtgcacctgattacatagagtttggatggagcaaagaaaaatccaatagcattttgcagagtaatgtatataattatgggctcacttcctactggagatgttgaaagtctaaatcggtttgaccattttgattgatggcacaatctggtttagaaaactttgtttagatcaatgacataaccctgctgcctctgcctgcccttcccctcccttctcccatccccttttccctatctggtgtctgtactttgatgaaggtgagctataatattggtggttaacataatccagaaggcttagttctgtgtgtgttctgtccctatataaactggtaaagaaaaaaaaaagttatgcagaatgttagatatttacatttgatacggtgtgccactattcaaggaaaaattaaatagcattttttaaaaaatagaatgaacttcaaaattaaagttgatttttaacttccatattagcaaatactcttcactactgaaagacagtactattttgcatattctgcataactttaagaaagtctttagtgaaatctttattggaagaaagtcatttgacaacaggcaaaaatttaatgattcggtatgaagtaaaatcaatcttctgatttggaaaatactctattataaaggtttcacttctttttggatgttttaaaatagacatagacacttgaaagtactatcatcacgtctcaaatcacctagaattcctagtatttttaaattgcaaatacaatttcaagtttatttaaatactccagaagttataatcctactaattgtgctagactttgctagtagagggggcccctctttctggatgagaagtctctcttgcagccatagaagagaccatggctttccccataggtttttcaacagactgtgaagcagtctgtcggatcctgtggggatagacgggcatttccctcgttgcccccctttttattgtggtgtggtgatggttttcagtgtcttgtacaggtaaggcactcaatgttgttaacatgccctttttcattgcctcagtattttgatattttcattggctgttaaacgtggaaactttttaacatgctttgtcgcatttatatgctacaggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatttggctctcccttgggagaggttgagggtgcacctttatgaacatggaaaggtttatcacagcagttaacccccacttgctcctcccctctataccaagctcttctggtttttcacctgacggggtgggtgtttgggatctattttttcttgctaatttgccaagtattgcactattaataccagcccccgaaatgaaaggaaccaaccacactggtgtgtacaatcagacaagcaaggttgtatattgaggaaatttgagcaagctgccctgaagaaaggcatagtgacaagatgagagagatgcattgtttggagatgtgtttagccagtgcccttcttccccacgagcccccccaaggctcagagcggtactggcttttaaagggaaaggccttcatttcttcgtttatccccccagcagcgctggagagcgaggtggcttcaataagcctggtggtaagtttttgagtattaccatagatagtgtttaaaaaaaaatgcagtcagtttttagaaaactataatttttttattagtttcataagtggtttaaaaatgatctatacaaaagagactaatgggtactgccggcattgtcttaggggttaataaggttaacctatggttacaaaacaaagggtaacttgaagtattgagtaactgcttctgtaatatgggggagaataaatttttaaatttggtttatttagaggaaaaattttgacttaaatttaacactgatttggcacataagcattgagagtgtatttggttaatggtttagaagcaaaccagcaaaggaaaaaagcaaaccctagcaaacctttcacaaatgttaaagagacactgctccattttagcagtgcgggtcattttgagtttaatgaatccccatcaaatggtggtatagtagatagctatgtgtgtttgtaaggtttgtagcttgcaagacgtgcactaataatattttatatgatctttcctggttggcaggacccatggatgaaggaccagatcttgatctaggtaattttgaattctagttgtgcttcatatcgtgctttgtaaattaatggtacagaggtaaatgcatgcgtagagttcagcagccttatagaccagtgtgatattcttgctgtcaaggacagtttgggaaatcctatgtgagcatctactcataattgccttaagtgaagtaaaccaaaagtttgatagcattcttcttagtatgcttggtagttttcttagatttatgatgaatatccttgggcagtagtgatcaggtagttaagaaacccctatagatacatgataataattctcctgtcttgttgtctctgaaaggcccacctgtagatccagatgaagactctgacaacagtgcaatttatgtacaaggattaaatgacagtgtgactctagatgatctggcagacttctttaagcagtgtggggttgttaaggtcagtaaaagcataaccaggtcatctggcagaactttaaaccacagagcattttaaagagattgaattgatgttgagagttgttttctaaggttgcctttgcctgacttctttctaggtatcttatggtttgttcctttttaaaaaagattagccttttttttttttttttttgagacggagtttccttcttggtgcccaggctggagtgcaatggcgcaagtcttggctcactgcaacctctgttcaagcgaatctcctgcctcagcctcccaagtagctgggattacaggtgtgcgccaccagctaattgtgtctttttagtaaagatggggtttcaccgtgttgggcaggcgggtctcaaactcctgacctcaggtgatctgcccaccttggcgcctcccaaagtgctgggattacaggtgtgatcccctacgcccggccttccctcctccacccctagggacagagtgttgctcaatctcagcctcccaggttcaagtgattctcccaccacagcctcttgaggtagctggacttataggcacatgccaccacacccaactaatttttatatttttagtggagatggatttttgcctgttggccgggctggtctctaactcctggccacctcaagtggccacctacctcagcctcccaaattgctgggattacaagcatgagccactacacccaacctcaaattattgtgtctttatgctaattcttcatagctagtaacgcagattttttcttcagggattttgactgtttttcagttcttgctcttctgtattagagttagtttatgaaccccataaacctcaaaaccttaaaaccccaattgaatatttactaaatctatgaagtaatttcaggagaatttacatttttatgatactgagtgatctttttttccccatgaagattttatttctccatttatttgtatatttatttgcttatttatttactgagacagtcttgctgtgtcaccaggctggagtgcagtggcacgatctcggctcactgcagcctctggctcctgggttcaagcgattgtcctgcctcagcctcctgagtagctaggattacaggtgcccgccaccacacccagctaatttttgtatttttagtagagatggggtttggtgaaaccatgttggtcaggctggtcttgaactcctgacctcaggtgatctgccgcctcaactcccaaagttttgtgattgcagacgtgagccactgtgcctggcctgtctctatttattattttattttactttgagacagagtctcactccttcacccggctggattgcagtggcgcagtcttggtttactgtaacctctgcctcccgggtctccttgcctcagcctcccgagtagctggaattacaggcgcctgccagcacccctggctaatttttgtaagtagagatgggatttcaccaggttggtcaggctggtcttgaacttctgacctcacgtgatccacccacctaggcctcccaaagtgctgtgattacaggtgtgagccaccacacccagcctatttagatcttcagtaaagactatcgatttccttaaaggtcttgcaaattttactagttttacttctaggtttcgtttattttcaagttgctgtggttaagggtcttcgttaaatgacacttttctggttattactggtgtatagaaatacagttgatttggccgggcgcggtagctcacgcctgtaatcctagcactttgggaggccgaggcgggtggatcacgaggtcaggagatcgagaccatcctggctaacacgatgaaaccccgtctctactataaatacaaaaaattagccaggcttggtggcgggcacctgtagtcccagctactcggaggctgaggcgggagaatggcatgaacctgggaggcggagcttgcagtgagctgagatggcgccactgcattccagcctgggtgactgagtgagactccgcctcaaaaaaaaaaaaaaaatacagttgattttgggcgggcgtggtggctcatgcctgtaatcccggcactatgggaggccgaggtgggtggatcacgaagtcaagagatcgagaccatcctggccaacgtggtgaaaccccgtatctactaaaaatacagaaattagccgggtgtggtgacacgcgcctgtagttgagctacttgggagtctgaggcaggagaatcagttgatcccaggatgcagaggttgcagtgagctgagatggcgccactgcactccagcctggcgacagagcaagactccatctcaaaaaaaaaaaggaaatacagttgattttggtaaatcttatataaggtgatttctccctgcttgtaggtgtgtgtgtgcacagatatcacacacacctcaaaagtaaaatgcttttagtgtctactgtcacattctaccctgtgcaagactccttgtttgcttttttgttttgagatggagtcttgctctgttgcccagactggagtgcagtggcacaatttcagctcactgcaacctccgcctcctgggttcaagcctcaagcctcttgagtagctgggagtacaggcttgagcatattaaaaagactgctttttaatatgtatataacatgtagtttattgaggaatgtggagtttatcctggttaagaaagtagtatttaccatcaaaattttggaaataaagatgttaaaatagatttccaagctggatacagtggctcacatgtgtaatcccagcactttgggaggccaaggcaggtggatcccaaggattgcttgagcccaggagtttgagaccagcctggacaacagagtgagactctgtctcacaaaaaagaaaaaaatgcatttccacattattcataccacagttttgccatattttcttttcagtttttaggtatcacgttcctttttttaagtcagaggtatcaatatatatatcctgttgtaatcttttttaagtcctataaatagattgctcttgtgttactggatatatgtaaacaattacagactaaactgatcgtgtgcatatataatgcaaaaaagtacacgtgaagatattcttatacaaggtagctcctgaattcaagtcaaccacatctgatattcagctgaaagactagtcatctgttctaactggaggaagtagtggctgtgttagactaaccaagaatccctgtagttcactcacagcctgtacactgtccttcacggtttaaggataattttctttatgccagtcatgtcttatgtggtggtatcaaagtctgactacccctacgaggtggctgtgctcagtggatacctgtctgggcatagaaaatgccagggcaggcaaaccagcatcagaagatggctaaggcaggagtggggcctatcctgttcacttccacactttggtctactttggtttttatgataaagcagggatagaggagaaaataacttagaattctgaaaaacttaaaagcggagaaacggtgacatttagtgacttactacatgtgagaaattggtacttttcctggattttgcctggacttttttctcccaaattagtatattctagtcatgcctaactatgctattctttgtctagatgaacaagagaactgggcaacccatgatccacatctacctggacaaggaaacaggaaagcccaaaggcgatgccacagtgtcctatgaagacccacccactgccaaggctgccgtggaatggtttgatggtgagatgtactcactggcattcttaatctccctggctatagaatatggcatgagggagaaacttgtgaaccataggagcaagaagaccttccatctcttcctgggggaggtagatggccggtctccctgcagtagtagtagcacccagccattgaccctggatttggagatccctttattttgaggcattagtattacaaatcaaccttgcttaaagtggcaaacacttcctaagcacagattatcagaaggtacagaaaacccttcaaaagaacatcttagccagtgtacatttgcatatagataaatatatatatttaaatgaggccttgacattaatggtgggatttcacttcagacaaaaccaacttgaaagcattgaatgacttggccatgtccagtggcttgcacctgtaatcccagcactttgggaggccaacatcggtgcattgcttgaatccaggggcttgagaccagcctggggaacatggcaaaaccctgtctctacaaaaaaaatacaaaaattagccaggtgttgtggcacactcctatacctatagtaccagccactcaggaggctgaggtgggaggatcacttgagcccggagagtttgaagctccagtgagctgagattgcaccactgcactccaacctgggcaacggagcaagactctgtctcaaagaaagtgtcaaataacaagtcctggttctgttttcttggtcatgcagtcagcttcccaccagcttattttcctccttatggtagacagtgttttttgcttgtgttgttttttttgagatggtctcactttgtcacccaggctggagtgcagtgacacaagccatctcagcttactgcaacctccacctcccaggttcaagccaatcttgtgcgtcagccactcgagtagctgctggactacaggcgcatgtcaccacgctgagcctaacttttgtattttttagtagagatggggtttcaccatgttggtcaggctgtaggaaggtttttaagtgtatttaagtatggcctttttctggccaggcacagtggctcttgcctataatcctaccacttcaggaggccaaggcaggaggattgtttgaaccaaggagttcactagcagcctgggcaacctagtgagacactgcctctacaaacaattttgtaaaattagtcgggcatggtgatgcgtgcctgtagtcccagctacttgggaggattgcttgagcaagtgagattgaaactgcagtgagctgtgccactgcactccagcccgggcaacagagtgagactcccatctcaaaaaaagcctttttctggccttgtcattaaagatcttagagaagattacaggcagacctaatgcatctgggagtggtcatttgatgatgatgtggagttggtgaacagggagtacaggggagtaattgatgttctgttgtcttgttccagggaaagattttcaagggagcaaacttaaagtctcccttgctcggaagaagcctccaatgaacagtatgcggggtggtctgccaccccgtgagggcagaggcatgccaccaccactccgtggaggtactttttctgagctcctatgttgcattaaaaggttttcagtacacttcatacccttgagaaacttgattattagagtgaagaaatataaaattgtgtgtagagtcaatactagactatcgagagctaacaatgaatgtttgttgggaataaaaggaagagaagaacatgggaggctggaagccactctgcctgtcaactccagactgccatttattcagctttggttgtgtctgtatagacatgcctattccttacagaattgtgggagttcagccaggtgcagtggctcacgcctgtaatcccagcactttgggaggctgaggtgggcggatcacctgaggtcaggagtttaagaccagcctggccaacgtggtgaaactccctctctactaaaaatacaaaaattagccgggtatggtggtgcatgcctgtaatcccagctactcgggaggctgaggcaggagaattgtttgaatctgggggggtggaggttgcagtgagcaaagatcgtgccactgcactccagcctgggcaacagtgtgagactccgtctccaaaaaaaaaaaaaaaaaattgtgggagctctgtttctgtagagcacgtggaacacgctcctcacagggaagggggctgatggcctgagccacacggaaacacgggacaggtgatggggaaatgacagcagtagtatctgtgggtttacttagtgatttttatttcctatagcaaatttggtgctacagagaaatgatttgctgtttcttgttgttcttgttgtaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgtatgtacttgtcttggcaaattgataccctacgagtgaagccacccttccctcaccccatccccactctagagtggattgctctgtctagaggaacagaatgatgaccctgatggctggttagggacactagtcagccattcactggacgcttcagagccttctgaagattgatttgacctgtcctgtgggtgcaatgctgcctgaggctgtgccctaaagcatgggtgtacatagatcctcttgatagtgagtgtgtacctgttcacacaccacctttccttgtttatcttccttagttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtaggtgcaggtttcatgagtgtcccctcagcttcctggtgctaaacctcttttcttatttgtgggcttggtaaactgcagttgccctctgcttaacaactttgagttgtcgtgtcctcatttctaaattgtcagcccgatgccgagattgagtgaagtgtctggtttgttctgctgtgagagaaggaagcagagcagcttccacagtgtccacagggcctctgcagccacccactgactgctttcgccctgctattctcaccttaggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataagtaagtgctggtgaaaagcagctgtgggccgccaggcacagtaagaggacagcccttcccagcttggttggcgcaagtcctcatgtctctaggaagcttgtgatagtggttgggaggagccaggaaggggcacctgggggctctggaagggcttcctcaccccttcccattctaaccgaagggccctctttaccttgcagaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtcatccttctcggcctctgttccacagtcactgtgtgtctgctgggagcatgctcccaccccacccaggagaggggtgccttccaggtaaacggttggttcagggtttgtgtgaggggaaataagcggttgtgacatggaaacagactctggccctgatgcagcctctgagacccactagtgtccaaaggttcaaggggagatccaggtaagggaggcacaggaagaactggaaataactttgccttccatgggatcacggatcaggcactaggagcatctaaggggctgctccctcaggtgagggacgatccctctcaggcggactgggtcgggtcctctcatccccagcacttctgggcatgcattgtgtgcacctctgctgtttctttccctggtcatttcctgttctaatatgtgtttgactccctgcgtttggaaaaccctcccttaaccagccatcatccccttccctccatcaaaccatcttcctggccctttctacaggaagcacatggaaagagctttgtccacccctccctctctggaacccacttcattcttcacctgcactaaaacaagcagctctcagtcaccaaccacctctaatgttgcccaatcaatggtctttccttctctgttctcccatctccttcattgcttcctttttctcctatccctaaatgcaggaaggccccaaagctagcattgcgctcccctgagccgccacactgcctggctgtcctttccatactgtggctttagccctttctccctagggccaactcggcttgggtgcatgatgggtgtagagcagggcttgctcttgtcccgtcctgcctacaccccagttcagtaaacacacacctgccccaaaccttggagtcatccatgacccattctcaaaccccagcccccaacctagctctcttgcaaatccaggacggtgcaaatccacccacagcccccacctccataacgccccctcactgggttccctgcttctcccctcagtatctccagcccttcctcagaagccagaccaaggtttgtggggttttttgttgtttgagatggtcttgctctcaccaagactggagtacagtggtgcaatcacagcttcacctcctgagctgagtagctgggactacaggtgtagcacccagctaatttttttgatgtttttgtagagaccaggtctcactgttgcccaggctggtctcaacttgggctcaagtgatcatcccaccttgacctctcaaagtgctaggattacaggcgtaagccaccacacttggcccaaaccaacttgacacgggaggtcatctccagtctcaaaaccatttggtggctccaagcacgcttgccatgccccaaaagacctctgggaccccagctgccctgctctaccttgcacgccagtccagcactgttcctcaaggggccgaggacgctctcaccgcagccttggtgtgtcagagccaagatgcacacataacctaggaggcccaaactcgactagggcatcactgggtccctgcgtcgtgccaggcactgcgctaagtacctctgtgcgtttaattcctaataaccttcaaggcaggtaacataggacagccacacgtcagctgagatgggaa

SEQ ID NO: 16786 - DNA, 35784 bp, Human; identical to SEQ ID NO: 16785

SEQ ID NO: 16787 - DNA, 148609 bp, Human; identical to SEQ ID NO: 12860

SEQ ID NO: 16788 - DNA, 29905 bp, Human
caggaaaggaacactatgagacaaaagcatgtagaaaaggtaagttcacttgcaaagatgtgcagacttagtaggactggatcactgaataagaaatacaacagatattagaccgcgagcggtggctcacgctataggcgtgagcacgtgagcactttgggaggccgaggcgggtgtatcacgaggtcaggagtttcgagaccagcctggccaagttggtgaaaccctgtctctactaaaaatacaaagattagctgggcgcggtggcgggcgcctgccccagctactcgggaggctgaggcaggagaatcgcttgaatccgggagagggaggttgcagtgagccaagattgcgccactgcactctagcctgggcgacaaagtaagactccgtctcaaaaaaaaaaaaaaaaaaaaaaaagagagagagaaagaaatacaatagatattaaaggaaaaaatgtaaaggaaaaattaccacatttacatttgtcttttcagcatagatgacatgctcacgttgaggaatgtgtgtcacaagaattgtgtgtgacatatccccaaatttccacattcaaaagtcagggataatatggtattcatccgggaatcagtaactcatgggaaaagctcaagatgtcattcactttggagaccagatgtaaaggagtagtatgggtactttgtctcagggtggaaagtgtctgttatggttttcttccttcccatgggacttgttgcacactcttacaatggcggcaggaccggcacgcttgcttgcacagctgtgagctgcatgaaggcagggatggttttggtcttatccgttatggcatccccttgtggcaagttaggtgttcaataaatatcggtggaatgcatgtgattacacttcatgccacagtatataaatatgattttaactggacagggaactgcaaaagtttcccatattgatcctttttgcaatcttaattatggtactctgagctgggatattgcctaaactgtctgggctacaacaaactctgaaggggcttttacttccacgtccatagtggttgagggttcgcgttgtgtgaacgctggagcctcacgtgagtagctgagtagcgaggatggtcactcccagataaacgaatacaggattctcgcggctgggagcggtcgcccggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgtgagtcctggggcttcttccttcccgtgcgggttgtcaggcggggacagcggccggggctcttagcggggcgacggcgggagggggccgggctgccgccgcctccttccccttcccctcggggccaggagtgcctccgtcgcgttcccggttcgctcccctccggctcctggccggagcggcctcctgggactggaggttgggggaagacacgcggcttctgggacccccacctcctcccttgcgggagggtgctgcggcctcccgctcccaccttccccggctcaggatccgggggacaaggatggggggcgcccgggatcccattgtccggatccaggggaaggggacggcgttcaggacctgccccttcggactgcgatcctctcctcccgtgacccgcggatcctgggggccggggaagggcggagaggggttgggggtgcctagatgcccgagctgggtctgcagggaggagacagtgctcgggacccctctggcccaggtcggatcccggaaggaggggcggcgctcgggacccctctaccctgctaccggatcccgccgagggtggaagggtgggggcaaggggtggggagggaggaaggggtgtcgggctgactccccaccctccgcttcctctgccgccggcattttctttcttattattgaatgttaagtgtaaaaataacttctatattttctatttttttttttctctcttattccaggaagagcaaccgaggtttcaatctgcggtacgtctcctactctccatttcatttttatttccgttcagttctattcctttttggggtcagagagaaaaagagatcgtactattacttttaatattgtagtaaactctaatgttaaccactaaggtgaggtggggcctggttctggagggtgggggggttgcaaatcccattattctagattctcaggtgataagttcagtgattctaggtgagtaagaggagctgtatgcaaagaattgaattgttctgtagttttcagataggggatccagatgccactatgtaagtggaaatgagaaatgcagcattctggtctggtagtattatttcagggcaaagtggtcagaagatttatttaggaacaagtaggttttaaaccatatctgtataattgtgtgaagctgaagccacatgcggtaatcgcctttaaccaagtcatgtgactgctatagacccgtagaatctagcacaacatggtattctaatgcaaaaattggaaatgtagaggagccaaacgttacatcatcaaagtgtcacataaagttattatggtctgattctctgtatttgaagaaaaggtataaagaaaattaaaaaatagctgaagaaaagtggcattgcagagacagctttgctgaaaggtgatggatgagaccatatagtgttatcaataatttcttagggttttgatattaatgttctcagtagatggttctgtggatttagataagcactaattccatgtatttggagtctgagacagtaatatggatgtttcatgaatagatttgagggaaaaaagaatacacacagaataaatcagaatcagcgaggggaagagaaataagtatatcagagtgtctaatatttgatagttgggagcagtaagaaatgtatagaatgggggtaaaaagttcaaatgcccatgagggccataaagaataaagaaggaagaggtgagggcttgggtactggagagcagtgcctcttctaaaaagtcagcactactgaactccagtggtttgttagtaggagtgaagggtcagtattgccagatcttcctatttttaattttattttatttatttatttttgagacagagtctcactctgtcaccaggctggagtgcaatggcgctatctcggcttactgcaacctccgcctcctgggttcaagcgattctcttgcctcagcctcccgaatagctgggactacaggcgcgtgccaccacacccagctaatttttgtatttttagtagagacggggtttcaccatgttggccaggctggtctcgatctcttaacctcgtgatctgccagcctcggcctcccaaagtgctgggattacaggcatgagccaccacgcccagccgatcttcctattttttaagaaagattagaaatctaaaactttatgttatttttctgatttttaaaatgatgtgtggaacaactgtttgggggcttgttagaatttgcaggatgtcactttgatacctctggtataagaacttgataaccacagggtaaaggcaagccatctcagttatacctgctcttcattagagcaagcaaagattgtgcaggttgtctaagcagataggcattaagaaaacttatttattgagagctgatatttccataaaatccggggatgtagttgttccaaaagtcttaaaaattatccctgggtaatagtcattaaagataatttgttttattttatttatccttgaagtattctcatatacttatgcatatatttgaaaattgaattcctttttcacatttacttttatccttcatgtttggggcctagtctgttgaaaactttttttttccctgcaagtctccagttgtaaaatctgtgctagggcttgatcagagctggagggtaaggatcgtttagccttcctttgcagaattatcctttgaattgaaattatactgacttcccagtaagagaaagttgtgttttttttgtttgtttgtttgtttgttttttttttttggtgaaattttggctcgcagttcttgaaagctttctgcttttcaaaattttcatccatatgatcgttgatataaatttgttattaaattattataatgtttctgctttcctggaatgctaatctcattgttttgtctagatgtttttagtttgctgttaaggtgcctaggatttttccttttgattttgggggtaggcaaaggaagttggtttgacactttgtttttaatttaacacatctatttgttgatatttctaaatattactctgcacaatgtaattacaacagcatggagagaaaaagcagatatgttataaacaaattttatagtatatcaaacaactattgtgactgtgtagggtaaaaaggattccattttttcccctctgtgaatgcatctgcttacttctcaatatttaatatggataataaatatattttttaaaatttaagagggagctattcttaagttttgccttagaaaaaaggtttaaaaaaagatgtggactgtgaacaaccaaatacttaggtattcaggactacagaagatgttgaaaaagttatttgaaaagggttctgtggatcctaatataaaaacattcatgtatgttttataatgtcactacaatatataggccttactacatgagaaatgtaagatactgagaagagagttaggaagttaggctaactctaacagaaagtgaaactgatttggcaaatatttttttctattgcttcagtacaaacggaaaacagcttctccaatggccagtaagctttgttaaaggaagtaaccccaaagagtattcttactactaaattcagtacatcgcaaaatcccactgatgttatttttattatattttggagggaagaggttgcattttaaagataaatttgtgggacaggtatattatattgcaagggcttccttttgctttatttctgtttgggaaatttctttaggaaagagtgtaagtatacaggaaatgtatgggttagtgtgttggtcaggaaatgcaattttttttccagtgaccatccttgatggcacctgactgagttgcagttgcagtatacttgtgaggggtttgaaaacagatttgtgcaattccacttctggacctttctggcatgaaatatttttaacttctcagagctctttgcttctttaggaatattcagaagagaacgagcttggtagcctccgagattggaattcactcaggaaactactgtctgttttacctgcagtcagttgcatggcaaaagtgctgcacaatgcatgtactttttctctgcttagagtgttgacagtgatgcttacagtgataacaaatgccagagttagttcctaaatgtgcctgtgttagggtaaaagttgttcttgtgtctaaaagaatttttccaagatgccagtaacggtgaaatagttggtcaaagaattcagcttggtttttaattaaaatttcctgaccaaggcatccttctctgaaatggctatagtatgaggccctgtttggattatagcatttgccagttcttttaggcaccaaaagaaaaaagtttgaaaacaaatacatacattagataatgttggaaatgtataccaggcaatcagctacaagcaggacaggtattggaaaattgaaatccatgtctttctcttagggagcttggtgagtttatcccatcctacctgcctattattttatgttataatttttgggttgattaaaatgaatattttaagttgcttagaaattgagctttatcctatcttgttcttatctatcagaagtaagaaatagatcttttcggatgagatttttgggtctgtgtattctcgtgtccttagtctctaataagaatagcttgataagaatcataagcaacacaagcttccctctaaaatacaaccttcacattttgtaaaggtagtaaatattgagtgggcaactaattccctatatgctgagaattttctgtattagaattgagatggttccccttataggtggggttagctgtcaggtagcctgtaagacatggcattgttctggagaaccttgtgcatcctggaataatgaagcatttatttccccgtgctatttgcctagaacttggaggaaataagattactgactgatgtgatgccttgaacaaagatgcagtctctctgcagtaagttggaaggaaataattttaagagatttccctcaattttgaacagacctccttagcctagatgacttcttgccaacatagcaacttcttggctaacaaaataatgtttgtcttcaacatctaacaacacttaagatacacgtgcttggtagtgtcaaagatggacaaattgtaggtgaagatttttattctgtctaccagtgtggaaagttgggtagaaatataactgagaggctgaataaaaactttggcagagatgtcaaagctggaagtgatttggtgcgggagtttctgttgagcatctgtggaccactgcatagccccttagtatttctgttagggatgccctggaggaagggttttctggcagacatccagacgtacaaatccagcgtactagaagagtgggcagcatccagccactgtaaccataggatgtgtaggggagatgtttgggagcctgctgtacagtccaagaatacctctgtggtctcctagaatagggcctaattaattccacaagggggttttccgtaccatttgttttcattactgaacatcattctcagtacaggctcatctgagtagagttttatttgttcaagacaattgtttgggcttgttttttaaaaccagttttgcatttgggggaggatattagatgccttacactgggagtcttcacccagtttttcttcttcaactctgaaatcttggccctctcaaaaagggttgccagcaagcaaagacagttaacaaggcagtgataaagcctgcaaactagtcctccaatgggggtggggatgaggcgcgggcagtgttatcggtctgggtggatctgtggtttggaaatgtttcccacagagaattctcagccttgtgtaaaggtttttctgtttttcatgtgctctttcaaaacattagtgataacatttaattcacagttgcctggaattaggcttgttagttctgcatgtttttaacttgttctttcaaatcaagcttggggaagagaaaaatacatccttgccattgtctctgagagatttaaaattgactccactagtagctcagggatggacatggcagcagggattggtgtaagattccactcttctgctagttaaattgggcctggaaccactacagaaattccatccactactttgagaacaacagtccccagcccaggctttctaccaggcagtggactgctgcctttccttgttgagccaacttctcaaacttggctggctccccagatgagaagccaagatttctgctcatgatctacagccaagttcacttacaatcctccaaccgagagacttgtccatttgagtcctttcagagctcagtgaatgggagggggtagtgcattgtggggatgattttggtgttagattatacttagctccacccctttagtgcaggtccacgtgaaaccaagtgcaacttcattctagctgtttgagatttgcagggctctcccagaaagaaaacagacaattagaattttatttgtatcaacaagagggattgtgggtaattctggtgcacagctcttagctgggaggagggccaagaatcagggtgatttagtagacaggagtatcttgggctgctctggagaccaaagatgggcaattaatttgcatgtaaataaaccaccttaggtagtatatagcaaacaggagccgcagacacatgccaaatattgtctcttggcctttaagctccttaggtatagtcgcagcccaacttatctttatgtagatgatcagagggaacaacagtaagttcaaaaggactagatacttaaataggttcaattctgtcgcactatttcatgctactgttagaaggcatctataattttgcgctaaagttgtatgatacagagtacctacctctaccctcaggttatgtggtgttccaaacttgactgtcctctcagcttcatatttcatgtcactatagttcagtaaacattcattttacagtgaatccagacttaacaagattaggacaactttagaagtgctccaggcatctgccccaaaaagagagatatgctatggagaaccatggttgtcatgggaaccacatgtccagttcaacagagctgtaggtgaggtattatgtttaagagaccaggaagtaactcagatgactacaggtgctcccagtctcctcttcctctgtaatgactgggacttttaggattaaataacaggagaatttcaagtcctttcgttttcacaactcttgatagatttttgtctgtacatcttctctagtacaaggattcatgtgaggcagcattattcttgtgctaagccaagttatttactcttgttccattttttgaatttctggccctctgtttgtatagatttaagctacctgaacttcccatgtacagactggctctctagattagctcagtgcaacgttgtgcattcaaggtgaatgttcagagcataatttccgtaattcctagagtgtaggtgtgatgaagttcttcttgctttgggttgtttgtgttccatttggaggggagacccctctgatggggacctgctgaagtgctcttatcatgctctccagcgctatctcttctgcctgaagccagagcattttgccattcctgatttggtgttggcagttttggtccatctccagctgaccgttctttgtgattccaagcaggctaaggctttgacttggatatttagatactgccagttagcctgacctgccacaggtacctgagagaatttattctgagtatgtggtgtcagaagttgtgccctctaagaactgcctgtcaggcactgcctgtgtgcaaggaagcccttggcaggatagcaccttggatctacttttaaaaaataggaactcagaattcagttgtcatcttatcagctctgtcataatgatctcagattcatgcatctaggttttatagaggttttagcttctgttgtatgatttggtgagaaggtcttaaactagtgccttttagtgggcttgggactcatggtgatggtttcacattaaagaagcaccagtgacttaactctttcttcccctggacacccatctggggaatctcttacagtggaggtgatcacatcttaagaaggggccactggagctttctctagtcacttcctaaccacagactggtggctcttctgtcacataagcaagttgggggggaccactgatgttacaggagagtcacactttgtccccctgaataacttttattttacttatgcatgagctggatgcatcgagctactttggatgttcctgtcgcaagcgttgctcacccctttctccccctttagcagagcctaattctggagactcctaactgcccacctcgagaaatccttcccagtccactcgccagggacagtgctgacagcgtgtacttccaggctgtaccccacccaccttgtaccaagcaaaaggagtgacattcctaatgtgttctttctcccattcttctaggctgacaaacgggctcatcataatgcactggaacgaaaacgtagggaccacatcaaagacagctttcacagtttgcgggactcagtcccatcactccaaggagagaaggtgagtttcctgagaaagctgagtagctggccactactagcttggaacttgttgcagagcttagcagagcactcacctattgggaaggaaatgtagtcagagatattcaggtagcatggttgccttatttttgactgtttggaggatcactgcacaccttacgtactccagtttatccttaacaaaatatgtcagatataatggagctatttgtgagataatggtaggagttatcttttaaaatttgtattatttgtaataaattcaagaaattataactatacactatagtataaagagtggccaagagttcgtttgggataacagtaaagattccagaggtcattaataccctagacctccatgagaattcctttcctatggttcaaagttaatactttattgtaaatgagcacttgcagaaatgtgtgtaatgtatgtgaaaaacaacctgggcaccattgattttccagccccaataattgttatttccaaggcgtataaagagcattttaagctgtgggacaaaagacttgagtgaagagacatgttcatgtgaaacagaaaaaaaataaccattcttccccactcccttctggaacctagtgttttccctggagggctaggcaccagctgtttctacatttgaaaaacaaaattagaagctttgagtaaaagcctatgggttagggtcactccctggaatttggagaaaacatctgcatggctagttccatccttgacagagagtgtagttgtctgtagcaattcattggaataactggcaagctgggaagaggacctgtgtttttgctttagtgatccagtgttttataaagaaggaactattctgttaagaacaatctttgcttttgggtgcactttgatttagttctgtggtgggggtcctggatttgtttggttatccaagatcaaatttggaacccttatgctttcattttttatattgtcactctggtaagttatggcctctatactttatctaaggtgtggctttccatgtggcgtaaacatggagaagttctgacctttataaagaacaaaacaggccatgtacatacctggtattgcaaaaccagaatttgccatgggttaagcctacttagtgtggacttgatttaatgaccttaaaccaaggtacttacctggaataacaaccttcctgggtacaacactaagtaccacggaaatctttatgactagagacagactcacccctttagtcaaagtaaacacatgccaaagattatctcttaggcttctttgacctgttgacagttggtgcttattcctgtaccatagtatcaattaaaattgctttggtaaactatatggaaaagagctgccttctcctaagtctcacctaaccaggagtggcactggggcagtgtttctcaaggggtgagttgcggaccacccacatacgattcactactgaatcagcctttctggatggaaacctgggaatctgtatttataacaagcagtcagatgattcttaggcattcttaagtttgaatacattgggagaggtgggtcataggatcacaactataccttttccttatccagcctattttacaatgccataacattcttccttaagtccttataattacattattctaaatcctattttctcctttctttcttcaaggaagttaaaggtttgaatttggtagtcttacaaatggaatagtctgtcatttgttgtggctcatttatttactcattcatgccattcaacacatacttactgagggtctgctacatgccaggcactatcctagatactgggagtacagcagtaaacaaaacagacaataacaggagctcttgctctgatgaggaaatgattaaaaaatgaagtaagaatttaaaatatatgtattatgtcaggtaagtaccatggagaaaaacagagaagaagagttgcaattttaattatggcagagaagaagagtgttgctggcaaggtgacattttagcaaagctttgaacaaagtgaagcaaagagtagtgcatctgtctggtaatgagcattccaggcagagggaatgcaagtgtggtagcactgagacaggaacctgtaagcattcctgggccaggcagggaaaacagaggccagagtgggtagagtggaatgagtgaagggatggtggcaggagatgctggcagaaaagtagcaggactaggagagaggagtggtccaggggaaccagattctagagccagtcaacaaaaccccaatttgagaatttactagataccattctaatttcagaatcctcctatcctgtgttataatccaaatatgtcctactgacagtgaatgaaggaaatgtctataagctctcaacctcttcctctttaaaaagcgagctgccagcgctgtttcataggtgccgtgagtcgaacagaatattttggtcccttagacttatcagttctcactaaacctggcgtttttttaagtgtggtatttgaactaaaggaaataggctcattcttagattgtggtaattaaggttatgacattatgtaaataatcatgaaatgattattttaccatgtgagttttgggaaacttagattcttaaagggaaagcctttgatttgggtctctctgtgttccagtctcctttgacttaagcatctttatgtttcagctgacttctcccttagcatttggattatctgtcatatgcgtcctaagccttttgttttttaaagagaaagcaatatgttaattgaattggatcctaaccaataataggggatacttgtgtaaaaaagaaagaaagctttaaatgtgggacccaaactctatttaccctttgttttctgtatttctactataaattaaacattttaaaaaatggttggctgggcatggtggctgatgcctgtaataccagcactttgggagacaggcaggtggatcgcttgaacccaggcgtttgagaccaacctaagcaacaaggcaaaactgcatctctacaaaaaatacaaaaattagttgggcgtggtgatgcttacctgtagtcctggctacttgggaggctgtggtgggaggatcacttgagtctgggaggtccaggctgcagtgagctgtgatggcaccgctccagcctggatgacagagtgagaccctgtctcaaaaaaataaaaaataagaattacctttttcttgaggaaaaaaatcagtaataattgacattgtattgcaatgtaaaattaaatccacacagcagttgtataaggtatggtactgttatttgacagttagttattactgctgttgctcctgtcagtgttgttaacaggctcaagatcactatcccatctgtaacaggacaggggctagaactcaggattgccagttgcaagttccatctttttcctataccatatgtgtaagcagtttaaggatattttaaagaaatcttgcttaaatacttgtatcttgtcattgtcctgggagcttcccctggataggcctattaatcttggcagtgtgtcataccacggctactacagaaatgctatcctctgaggtggcgtatgtaggtaacactgaaatgcagggtattaaggatcatttaaagcctataatttctttctgagttcacatagttgctctgagctcaagaaaatagaccattacagttggtggttcatttgggttttgccataggtcccagagttagcaagtagaccctcgaactctgttgtttgagtcttttgtgttccttgcagtttctcaactgtatgtggagttccactgttgttccactgggaacaataggatggaattagaatcatcagccagccaaccagagtaatggagtaagggcaagatcaactgtggccccctccccgctttttttttttttttttttttttttttttttttttttttttttttttacagagatgctacttttatagaaagtattatttaagtgtccttgcttgggtactagggagtgttacacaatggttcactggcactaagctcaccatacttatgttggggagcaagacctgatagccagcctttacatgggagtataattctgtcctccatctcataagccccagtacctgagccagaatgattataaccaaccacactgtctctttatcatggatggctttagcagtaggttattttcatcattgccatttgtagctctacagtggtttatagtaatttctcatcttttaagtctctccctcagtgcctgttgttatcaaactcattgctctctcaggcagttgagctctgcatttctcccttatggggagagctgtgttggagagagagaatataacttcaaatgaaaataaagaaaaacagaatttcttgattttgaggtgagaatttgagggcactgcctctgtcagttcctatcacagattctggcacatagtaggttctcagttagtaaattgtggtggagagagagagccagaggaaacagcaggcttgctcagccattaaagaaaacagcaacagtcaatattatgtgctcaactatataagtaagaccttgtgagtgctgtagaggttaaaagacataatagatggtgtctacccttgagggtcttgctctgttgttgggaaagaggattacatctaacaattaacaataatgagataacatgctgagcatcagataagagctttacattgagttaatctcagtttcatttccattaaaatctggttttcttaacaggtagatgttgaaaccaaatataatagttcccttatggcagggaacatgattcttaaggataaaggctctcatagcatttatacttttatgtacacacatttatatattatacttaatatatgaggttttatatatatttgtgtgattattaaatgactgtctgctggcactacactacaataagtaccatgaaggcagggagaatgtctccttttggttatatttcttccctcagtgcctgcacatagtagggagcatagtgaatatttattaactgaggggaggaatcccccatcaacctggccacattattttgggagatggctcattcctgttgatgcgtttaaggctgacagttcattcggtaacctatgtctatagcatatctgagctgctagagggattgtcgtttaaatgaaatgtaaactatagccctatccacttctcctcattactcattaaggttatattagctagtcagactccaacttgggcaattatctttttaaagtttctacatcttaaattgttgcccatagttgcccaagtctcccttaggctccaggctcagcaattgtaaatgcatttaatttcttataaattatttgcatgctgctgaaaacctccaagggcttttcattgcccatttaggtaaggactggtattccatgttctgtaaataagatacccagcttacctacctgctttttcgcctccttcctgacattaaccttccagttactatacacccttgtattagtccgttttcgtgctgctgataaagacatacctgagactgggcaatttacaaaagaaggaggtttagtggacttacagttccacgtggctggaaggaagcctcacaatcatggcgaaggcaaggaggagcaagtcatgtcttacatggatggcagcaggcaaagagagagagcttgtgcagggaaactcctgtttttaaaaccatcagatcttgcaagacttattcactatcacgagaacagcatgggaaagacctgtccccgtgattcaattacctcccaccgagttcctgccacaacacatgggaattacaattcaagatgagatttgggtggagacacagccaaactatattattctgctcctggcccctcccaaatctcatgtcctcacatttcaaaaccaatcgtgccttgtcttaactcatttcagcattaactcagaagtccacagtgcaaagtctcatctgggacaagacaagtcctttctgcctatgagcctgtaaaatcaaaagcaagttagttacttcctagatagagtgggggtacaggcattggataaacacagccattccaaatgggagaaatcggtcaaaaaaaggggctacaggcctcatgcaagtccaaaatccagcagggcagtcaaatctaaaagccctgtaatgatctcctttgactccatgtctcacatagaggtcatgctgatacaaaaggtgggttcctttggtcttgcatagctctacccttgtggctttgcaaggtacagcctccttcctggctgctttcacaggctggcattgagtgtctgcagcttttccaggtgcacagtgcaagatgtcagtcagtggatctaccattctggggtctgcaggatggtggcactcttctcacagctccactagagagggccccagtagagactgtgtgggggctctgaccccacatttcctgtctgcactgccgtagcagaggtcctccatgagggccctgtcccttcagcaaacttctccctggacatacaggtgtttccatactccatcctctgaaatctaggcagaggttcccaaaccccaattcttgacttctgttcactcccaggctcaataccatgaggaagctgccaaggcttggggctggcaccctctgaagccgcaacctgagctctgcattgggccctttcagccacgactggagtggccgggatgcagggcaccaagtccctaggctgcatacaacctgtggaccctgggcccagcccacaagaccagtttttcctcctaggcctctgggtctgtgatgggaacagctgctgtgaagatctctgacatgccctggagacattttccccattgtcttggggattaacattcggcttctcattacttatgcaaatctctgcagctggcttgaatttcttctcagaaaatgggattttcttttctatcacattgtcaggctacaaattttctgaacttttatgctctgcttctcttataaaactgaatgccttttacagcacccaagtcacctcttgaatgctttgctgcttagaaatttcttcctccagataccctaaatcatctctgtgaagttcaaagttccacttatctctagcgtaggggcaaaatgctgccaatctctttgctgaaacgtaacaggagtcacctttgctctagttctcaacaagttcctcatctccatctgagaccacctcagcctggactttattgtccatatcattatcagcattttgggcaaagccattcaacaagtccttaggaagtttgaaactttcccacatttttctgtcttcttctgagcccttcaaattgttccaacctctgcctgttacctagttccaaagttgcttccacattttcaggtatcttttcagcagtgccctactctactggtaccaatttactgcatttagtccattttcatgctgctgataaagacatacctgagactgggcaatttacaaaagaaagaggtttaatgacttacagttacatatggctggggaggcctcacaatcatggtggaaggcaaggagaagcaagtcacgttttacatggatggcagcaggcgaagagaacttgtgcagggaaactgctgtttttaaaaccatcagctctcacgaaatttattccctatcacaagaacaacatgggaaagaccaacccccatgattcaattactgctcactaggttcctcccccgacacatgggaattgtgggagttaaattcaagatgagatttgggtagggacacagccaaaccatatcaacccctcttctgtttgcccaggaatttcattctcagcttatctgagtgctttgcttttctcaaggtccaaccccagccacactgcccaggtgacttgggggttccatattgatgagccctgctcacaaggcctacctgcagcctgtcctctatttcctgagttccccccttccctcagtctccagctccttgccttagaggccaatatcaaatactgcccctcccttagaactctcccttgaacctctgtggccttttgtgggacctctcctcagtctccctaatttctgtgattaacttatcacctaattaaatggtatgctcctgtagggcagaaatctaattattccttctgggagactgtcatacagaatgagagaggtctcactcccccaagagtactagagagctcttcacctaacatttttcacatcttgagattcggaaggatagagattgattactaggccttgcctttagcatttttgttttctccaacaaaattgcaaaaactttagaaaaatgggaagaagaaaaaacatgaatccctccttcctctaacacaactacagccttccctttggctatgacaaatgctgcccaacagaaatttagcatgagtcacaattgcattttaaatataacttaaatacaattaaattttcgagtagaaccaattaaaaagttaaacaggtgaaaatttgaataatataatttatttagcctaatattcaaaagtaagtatgatctcaacatgtaatcaatatatttaaaattatttattcaccaagtctttaaattcaacttaacagcacatctcaattcagagtactcacatttcaagtgtttattagccacatgtggctagtgactatcagatcagatagtataatccaaaaatagactctccgtaccccccctgccccatttaatgtgactaaaattagacatcatcttaaagtggatgtgaaaagaaacctgcctcctttttttctccccaaaagctgctattgttcaatccatggatttattgatggagtctaacaagcaaggaaatatagtgttatcaatttgtgtattccttcctggtctcttcatctacatgctccccacagggaaagtactatttatagcttgctgcttttacataatatattttttcgctaggtcatacagtgtgctcatgtttagtcattaggcatgtttcttttgggcaattggggttgcattcaatttttaaaatttaaaatttataattataatatggacatctctgtatatgtagccatttccatagactccaagaagttggatttctgggttgaggggtgcgagcatctgacctttttccgtgtgttgccaaaatgctttccaagaggattgtttttatatcctctttcttccatttctttctttttttcaagcaaattctaaagagtagtcttttggtagtgttttgagagtaccagtttcattatcactggaatttttttttttggaagagggtaactaattcagtaaacaaaagttagtaattttgtattctatttattacttgtgaaattaattgcttttccacatgtttatttactagctctatttcctcttttggaaattgtgtactcctgtccttcatcgtcaaagtttgatgcagaaatgccacaccttcatttcaagctaccaagtgcacaagaaaaaagaatgcaagatttaaaaaatgattgttttgaccccttacacaaatgtcttactcctggctttaattaagctgcttgagggctgatagctctgccttaccctggtaatcagcaaaatggtcctgtggctggggaggccctggcagcaggaagccttcaaggagccatgggtctgtgctgactctggccttacaaccttccagcctcctttgctggcattgatggggttccatttttgaatgaactagtttaatgtggatccaaatttattgtgcatattctttcgttttggttttcaaaagatggcttattcacatggaaatgtacaccagtttagccctgggccctccctttaccttcatatgtgtaaaagcttacacaggtttcagaaaataaatggtttcattttctctaaaataactagtacaaaataaaacagatgtcagttgttgagtccagcagtacctcttttttcatccctccagatatggcattttggttcttaggggaacaagacagctgtaacatcagcccactggcatctgttttgggcactgaagaggaaaagtgttcagtagagttaagattattgtttctcacgtcagcattgggaccctagggaagggcagtggtgttcctaatgttaacaatctagcactactattcttttcctcacctctccccacccactttctaaaacaacttgaagttttacagaaatccaagttactgtgataaaatttataactccagaaatatttggaactcttgccttacattgaaaatttttgagaaccattgctttaaatgagatttaataaccttggacttcgtctgaagcatcagtgctaacaacttcaggagtcatttggggccttaaacggttctatttagaatccaagtcttttgggtctgaggccttttgtgacatatgtagtcagttcttgctgtgatgtgtggggtgggtggatgctgttcaaaagcagaggtctgacagtgggtgcctctgcttgagagggttggccttccctctgtctgcttactgccttgggagggaatgcaaatggacacgtagctgcagcataaacagtaggagggacaggaacctggcagaccctctgccacaccctgggtcccttctacattattcattttgcttttatccttctgggctgccaagaggtaatgaagccagcagtgtactgtgggaagctgacatcccccacctaaccttccacttctgccctccagaccagatggttaggtcagttctctcaagctcgcttgcatcttgaggcttttcctttcaatgtgtttctgctagaagcctgtttagttctcacctgtctttaaaatagaaagaaaaataaccttccttcaatgctgctatcctgctattacaaactaccatttttcacttttttttttttatacagggtctcactcttttttttcaggctggagtgtgttggcacaagcctgtctcactgcagcttcagccccatgggctcaagagatcctcccacctttgcctcccaagtagctgggaccacattcgtgtaccaccatgcccagctaatcttttgatttttttatagagcccaagtgtcttgctgtgttttctaggctggtccccaacacctgagccctagtgatcctcccacctcagcctcccagggtgctgggattacaggcatgagccactgcacctggcctacttcttacttttcaaccaaattctgaagactagtcttcatcattgcctcacttgcaactcaattcttatgcctgttaccggtgcagagacaatttaccattgggcttcggctgtcactcctccaagaaaaccaccttcactagggtcttccatttgacgtccttgtaggcaaatcaggtgactttcgtagtccttttcctcctccaactttcccctccatgacaacagtgtccctgcaattctattgatctttttaaattagttccatagcttcccctgtgttcccaaagtatgagtgtcctggaggcttggattcaaatcctgactcaacttcctattagtttacataacattgggtaaattacagctctgtgtctcggtttcctcatttataaaatagggaaaacatcagaaggttgtgtgaggatgcctgacacttagtaagtactcagtaagtgttagtgctgccattgttaccacccccatcatcattgtcacttgtgttgctatgtgcagccatggctttggagcaagatctcgcaaggctgcccagtatccctttgtgtggctcccagaggtgagagagaggcctgctgagccctttgcgtttgcttacatggctacatgggaggcctggctacctcttcagtcccttcagccaccatccaccctgtctcagggctccatccaagccatttaaagagccatttctgttcacaaagacagaatcaaaattatgattctgctaattataaaaactatcaggaaaaaaattttcaggcttttactgagtacccaaggcagcacttgctctgtggacatgttgacttaccaagttctatctgatcagtcacactcacatgaagataggcagttgactcagctgacttagagcaattttcagaaaacagaaactgaaagtccagggttattccatagtccatgccataaatcccagggtttcttgctggtttcgtgtttgctggtcacatattataaactcataaagacaaggaaggccctgcccccaccttcatcctgtgtttggccacatgatcttgtatggagtggaaagatgggaggggaggattgcaggtgagtctagcatttttagcttcagccttttgctttttctttcctggactacatgcacatgcaaatttggggtatttctgtattttgtgctttaaatttttttcttgttgggccttaattcttgttgggtaccctgggaagagtaaaataaagttaactctgaaccattcttttggacttgctgagggatcagggcaccctaagtgaccaggggcacttctgctttcagcagaggatggaggaagggctgtgcttagcattctgaaggcctcgttctgagtttaaaccaatccagccttctttggactcctgttgttcccaagacactatgttctgaacatctatgaattttatcttcatccaaaaattaccctgaaatggaaactgccatccctcacagatctttttctctcttctggcttgttttgctgtgcttactgctcacttttcacttcttgatcctaattccctggtttcatgtataaatatttgaaggagaaactggtagcaaaaaggctgttactcagtctggtcattcattaaaagttatcactgaacatttgcaagtgctctctggtttcagagattgtgcattttttcccttgtcccggatgcacatgggtagttaagagctaatgttgccttctgggaactattagttgaaaaaatagcttttacataggcaaatttaaatagagggatgtaaattacatcagtgatggaaagggtagactttggagggctagatggggtcttagagaatttctagtcagatgaggaataggcaaggtgagaaatgtgtctgcagctacagaacccattaatgacaagcatgcagagcactcctctgtcctctaattcccaaattcttccttgccactctaccacctcttatcaatactaatcatttttcattccatctccagtatccagagaggaaggtattttaattagtcccttctaattatgtgctccttttttccaccccattttgtcacctaataaaccctaataaggtccctttgtagaaatgggaaacagtgtctgaagtatccattgctaggctaggaactctcattccttctgcataagctgactgactcaactaaagaaacgcatctcactttttccccatcccatcttgactgtgctattccaaacgccaccttggtctaacacagggctcaccatttcagataggagcgtgttgcatgcacacatgcagcaccaaggccaatgcgtagcacacagtaggtaatcaccccagccagaagccatctttcccgtggtgtctctagtctctgctagtcaggttacgcttgtcagcactgccctgtgatatttccatgtatagacatatttatctcctcaactagataggaagtaagctttggggcaaagaagccatgactaatacattttgtttccccacagtatctgcctagtatcttgtacgtaatttgcacctgataaaaatggttgattatgaacaatttccttgaggaaattaccttaagggtgctaaagaggaaagcctggaaattctagtacttgtgaggacttatgaataagcacgggccttacaaacctttctgaaactcagcccaaactgaggcctataaattgagattgttaggatttaatatgagtagatctggttttgctagccacggtgtacatgttttctttgtctttctcccgctgttgtgttctggttgtttaggacccattgggcttgtaatacagaattgtcaagcactccctaccctgagttagaagctttccggctgctcaggagtctctggctggaaggccatacttaagctactaggctaccccgccttgagcttcgcttggctttgtactattctaccagtttggctggctgcctggccataagttactctgactatgtttgtagcctggagagaatctcccagacaagtttgatgtctaggggcacagtaacatgacatccatgttattgacttacgaacttactctagcaaggcagtacccaggcaacccacagccattgtagaggtgtggttgtttcctgaaatggcccaatctcatgctcttcctgtgttgacatcaagcaccgacagctttttatgaaagtctctttagccaggaaggctgaagtagtgacacagcagcattgttcagttcggaatagttaacagtggtttcagagtttggctggaatcttgggtcttgatgaaacacattgtacccattcctgtctcaagccaggccctagcagaattagtgacctaaagctttcatttaagtagtattttaatgtttccagacatagccaagctaaagactttaaagcaacctaaagaaccagaggagatgggaggagtacagttcaggagtcggatggctctgagtttaaagccaggccatgctactgtgcagctggtgattttgaataaagcggtgtacttctctgatccttgggttcttagtagagctacctctgagactaatcttgtgagttaagctctgtaaagcacttggcaccttgtatgtcacaaagaaggccttcacggatgcagtggctcacgcctgtaatcccagcagtttgggaggccgaggtaggtggatcacctgaggtgaggagtttgagaccagtctggccaacatggtgaaaccccatctttattaaaaatgtaaaaattagccaggcaacgtggcatgtacttgtaatcccagctactctggaggctgaggcagaagaatcacttgaacctgggaggtggaggttgcagtgagctgagatcacaccactctactccagcctgggcaacagagcgagactacgtctccaaaaaaaaaaaaaaaacaacaacaacaacaacaacaggctgggcgcagtggctcacacctgtgacctataatcccagcattttgggaggccaaggtgggcagatcacctgaggccaggagtttgagaccagcctggctaacatggtgaaaccgcatttctactaaaaatacaaaaaaattagatgggcgtggtggcgcacacctataatcctagctactcaggaggctgaggcaggagaatcacttgaacccaggaggcggaggttgctgtcagccaagatcacgctgttgcactccagcttgggcaacaagagcgaaactctgtctcaaaaaaataaaaaaataaataaataaataaagcctacagtagccattattgtatttcttcagccttttcccaccttaccctctcgtttccagccacccaagcagttgctgcaggccaggttccctcactgcctggattgggtttttattttgtcccctgtgctttttctcatattgccacaggcatcccgggcccaaatcctagacaaagccacagaatatatccagtatatgcgaaggaaaaaccacacacaccagcaagatattgacgacctcaagcggcagaatgctcttctggagcagcaaggtgagcacccgagctcgtggggcagctggccctgctgtgctccagccaggtcaggctttggcacctgggcctgcagagtcagagccagtcatggagtatgtgctcagtagcaggcttggtcctgcttcttggggcctgagtaactgagtgttagagccgtcctgaggaaggacctgaggcgccagtgaggagacagtggaagctaggaagttggacatctggagacttgtatcttttctggcctgacctctccccttcttggggctcaggtgctctgcctgcagtagggatcacacctggcatcaggtgtctgaaaagagctttgaggtccttggagtggaatgtgctgtgtaagtaccagagactccaggtgttcagggacagtgagccctccccattgtcaatggtagtccaatcagggcagcctatgggctaggcccatgctgttctcaatgctcacacccgccttttcctacaaccacaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaatgggttgaccttccaggctcaagctgagctgaaccaagggatgggcagtgggtggtgtcagtgggttggttactgggccaggcagcctgcatgtaggggctatttgaaaagcccaggtattttatgtgtattggtgacttgcttccaagtgtccagcttgtcattccaagtggatcttgtacacgagagctaagccaaaactgttctttggctgatacgtcttatgtcatcctttcctgctgttgtgtggcctcacaccttgtggagcctcatgctcctgggccagcttctcctctgttattgcactgctgaatcccacagggagctcacgctccagtctctccacggggcttccacggcaggacggtgacatcacaagccttctcttcagagttgggtgggattgcagagtgtctgctggctcccaggtccagctgggaaaggcgggagggaaatgaagtgtgtgagtgaacagccacccgaagggagctacttctgagcatcttgagcctcgggggccaacaagcaagcccttaggaagaacaggctggaccctgagtctgagactcggttactccccaagtctccagaaggcagtaacacactcccttggttgccttttagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttaaagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatccttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgt

SEQ ID NO: 16789 - DNA, 60788 bp, Human
aggggaacaaactgtgctccagtcctttccccagctgccctcctgaaacctgtccgatcaagggggataaactgtgctccagtcctttccccacctgccctcctgaaacccgtctggtcaagggggataaactgcgctccagtttggcctttggtcccagccgcagtcattccaccggatgaccctggggaggcctcctcctgcagcaggccttggtttttctcccaaggcaattagggtgggtaatcctggctcctatcttacctcacaaggatgtggtgggatggattcatcaggttggggaaaatgcagtctgaagtgagtctgtatctgaaaaataaggctgtagccctgctgccatctcacacttgggctggtgaatgtgcttcagtgcctccgtgatcatgtgcctggtggatgtgcatgtgtgtgctggtgtgtgtcagtgtgtcagatatgagcctgtgtgtgtgccgtgggtgcacacacccacagagggagtggtctccctcacagctcactggctgtcaacccccatcacaggtctgcctcacagcctccctgcctcccgctttgctctcttggttgtgaaggctctgggtcccctattctcttacagacttgatcttggagtcccttaagatccctagaaagaggaccaaatgtcaggtacagatgaagaaagctaatagttttcctagggtccagggcattgaagaccaagcctggctcccctggccccctcctcacttttctcccctgactccacccctgccttcccgttacttcttaaagttctcaaagctttctgtgttctttcttaccttcaggactttacacctactctttattccctttgcttggactcttgtcctttcccacctgtcccttcatgggtacctccaagcttcctttaggaataagcttcaacttcccctccctgataccagtccccgccgagtccccacctaagccagccatgacacacatcacaccttcttgtagttgcttgtttaattgtgtgtctctgccaccagattccaagctctgtgaggacatgactttcctgtcttacttgcccctgcctagtacagtgcctgccacctagttggagcttggtacatatttgaattaactgtaaatgaatgaatgagtgagtaggaatgactgatgacgggtgagggaggacccagtgctcctgatgcgctggttcatcacatggactcacaatgcacggttccattgtccatgggatgccccgactgccacgtgcttgatgggacagcaggctcctttgggttgctcagtctgtcctggaattcaacaggagacctcatctgagcacctggtcatgctccaaagaagccctaaaatgcgaggtcagctttctgaataccaactgctgggaaggaactcagagggctctcagaaagcctccgggaggagtgaagtccccccagtgcagctgccccgggctggtggcgtcagtggcggcttaactctctcatccatctctccccatggttcccatatgggtcagactcagcctgtttccagcctctcccttcccctggcctgtccccatctcccccaccaggttaggtcctggcctagtcctcagggtgagggttgctttccccagcttgtgccctgctgcctctggctcccaggagagcttcctctctcccggggtgctccccgcggcggggcggctggtctggaggaagcagctggctgcgactgacgtctccacctgctggccgtcctgacccttgctacgtgcagctctccatccctgccactgctgccggtactgttgctgctgctgctgctgcaatattttataacaaacgacccagagaccctggtaggaagcacgcccaggcagatgacacggcgttctgcttctgtcaggatctactcacgttggatgctccgaataagtttccccggagaaaaagtccgagggggtagagagataaccctctgactgtgttgctgtcccccagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcaggtactgtttggggccacaagggttggagggcattctcacagtcacaaggttcacagccctccccacctagtgtgaatcctctgtgtgtgttgggtgagccctggcatggcagtgatggagacgtgtttgtcgggctcagggaggtgggggtccccttgggagggagctcaggcagcctctgcccccaaggcctctgagaagcaaggaggtgctggagctgggaccaggtggggcctgccctctgcctctgtcctgagtgacctgcggccaagtgagaagtacgagagtctgggcaaagcagtgtctgagggctggacagccgggcgcaggttcacagggcctcctggttaaccccgatttcctgcctgggcctagagagaggaattaccatagtcctctctgtagtcccaaaaggagtgattggataggaaatcgagaacagataacatcctccccactgcctcaggaaggattttcttgatgaaacctttcatccttaaactggaattagatttttgcttagcaggttcataatagatctctctgtgtgtgtgtgtgtgtgtgtgtgtgtagatgtgtgtgtgtgtgtgtgtgtgtgtgtgtgtgtgtgagagagagagagagagagagaaggtgggggtggagaatatcttaaatctctagtagaaatgacttctcctccccctgttggctgatatctgattcttgggattttttttttttccccaactcctgtgactattgcctccctgaacttgacccagggtaagtatattccgaccttaagtcttcggccaataagaaagtttgagttacatggggttgtgtgtgtatgtgtggaaggtgggttccttcacctgatccaccagtcagcagcccacactggacctgtttccctatcattgactgttgccgtcttccacctcctaagaagagtacaaccttccccataaacactttctggagtgattctcccgctgcccccataccttatggcccaaattgaaggttgtagtaatcctcttccccactccctccctgtactcagctcccagataccacagtccctggcagaccttgaagcctgagcagggccctggacccctctgggaccataatgacctcacatcttgggagtgtctgggcttctcatgccgggaaaggaatgctgcggtgtctcatctcccttgtcatgacaaggaatccacttgggtctcagtcattacccctggtgtccttgctctttacaggaaactctctttcttctttctttatctccttctcaccctccttgaccccacaaaattctcccttggtttcccttggggacggaccataacggtgacccattgcttttgtgtatgttaatttaagccaaccaaacttggaaccattggctttgtcgtcagtctggttttaccttcttatatctctgtgctggctggatctagctgcaatgaccctggcgatccaggtggagggagaggggtaccatattccgtaagatttgccaaagcaaggtaagagtggggactggcctttgtgcagagattcttttatcttttttaagaaaccaaggtaaattctattttaacagttgcttgttgtactcctactatgtttaaagctaaacccctggccaaccatgaaaggggagaggggaaccacagagatgaattcagtatagtgtctgtctctcaggagttcaaaatctattagggaaaaatgaactatgttcacaattaattagcatgagtggaattagagaagaactgtaggatgggcacataaattaaacagcaatgagagagccaaggaagagatgcaaggaaaatcggggaacagttcatggaggaggcagcctttgagctgggaattgaagggtgtgtgtgattctggcaggcagaagggccccgggtttctccagttggcctgtgtgtgttgtcaccacgtctgatgagctgcttgggaagttggtggagacaggttaatgagccgagcacaaagccgggcgtggtagctcatgcctataatcccagcactttgggatcctgaggtaagtgtatggcttgagaccaggagttcaagaccagcctggccaagagggcgaaactccatctctactaaaatccaaaaaaaaaagaaatagctgggcgtggtggtgcatgcctgtaatcccagctactcaagaagctgaggcacgagaattgcttgaacccgggaggcggaggttgcagtgacccaagatcacgccactgcactccaacctgggtgacagagcaagactctgtgtttagtggtcagtcctaggttgatcaggaaagagcctttgctgaccttggctgtgcctagttgagcctcctcctcaccaggagcatgcatctgacttaccagagaatctgaatgccccccagggagaggaaaagccacagagcatagaattgtatgcctgggccttaactattcagaacatctggccaacaagtaaatatgcaagtttgaggtcctttcaagattttcaagaacaaacaacctaagtggtttactggcttccttctcctgagagtccactctaagtgacctgggcttgagctaaagctttggaaaggtctaaatagggtggccagatgtgcccattctgctgggtaggcagaatggagaaagggagcatgtcagccttcctagtctcaacgtcttgactttttttcccttcagtactgttgttggggccaccttagcagcctaggcaggggtgtctttcaaaagaaacattagggagaaggagctctcagccactctcccactcacaggaatattaaggcaaggaggggattcagccctgagttgcttataagatagcagtgatctacttcataggtatatgtggcaaggttggggagactggcctggcgtcttcttctgaaactgaaggtcctggggtgaggaggaacatgtcacaagatccagattcaagtcctgattctgcctctaatgccaccgcagtggaggatcactgactccttttccatttttataaaatggggatgatagtattttctcaaggttgttgtgaagagcaaataagataaagtttacggaagtttttatttataataaaatgctaggtgaatgttagataatgttagtactaagaaaatttcccatcggtgttttctgtcctttctcttttcccaacttcagacattcaagatcatgagcttggtctttttccttgcctgttgtaccttggcctgttccaggacctgtttcttccttcttaacccccaccctcctttgccttggaagttctgagttggaaggaaaagccagggaccaaggaaaccaggctaatgtttgtgcttggagctctgggctctttccccttcccccagacctgatgcccatgagatgaagccccatgccatgcaggtctctctctctccataagactatccagtccacgaccctggctgtgtctccgccatctggctgggtgacatgggaggcccaagaaacgtaaggatgatgggtcttgtcaaatgcttttccagatgagacagtttctctaggtccatctccatttaatgacctatggttggaagacctgaattggggtgactggatgtgatcttttctgcttcttaagtaaaattcctctcaactccaaaggaaatactccctgttctgcctttcataccactcccaggtcttccttcctggacctaaagaaacaagccatctggctcatctgtcctagtacataaaaacctgacctctctccagaatgaatgactttctttatgaaactgggagtcagcctaactaaagtgaaaaggaagaagggtaggaaaatgttgcagaaggctcctgtaagggggtggatttgaccttggcaatgccaaggggagggctgggatcccagcaggaatatttgccctgtagatccctgagcagattttagcgttttaacatcagtctctaagctggccgcctgtcatgaggttaagtagcaggtagccctgaggcttcttcctggactggagaccatgcttctctcttttgatgactgcctctggcaccttcctactttctggacctgttttcagggattacaggaagagcagcagctgaaaagcccaagttcctatccttccaaaaggttccagccttcatgtttcaatagaaaggctccccccatctcctagagtccccctaattgtcacacagccccatttcttctccttccccttttcatactgggagctgccagatgagcatttgtggccgtctggatgaagaatgaaacactgcaggctgcagggaacttaccagtcagaatgcccatcctctgtctccctctcctcaccccagaggaggcatctgcctgcctgcacactcctccccttccctgcacctgggtacagactccagtgactccagtgaggatgctgcctcagggtagatgtggcccagaagggagagcagggagtggaggaaccccacagaaagatgccccaaaaagagaagccctgtgcatgagcctcattcccctttctctcttccctcccctccctccttccactcccctgccttacccatgcacacagcttggcatccggcatcccatgtgccgcccgctgcgtgttttacagctcctcggctcacagaggcatctcgcagtgcagggagcagtccggagcctcctgcgaagggcctgtgggaaagagatggccttcacgttctttctcagtcttcctcctgttctttggcctgtggagcaatcaccaaaggatagactaaatagggcctctcattttaaaaccaggtgcacagaattgtgttgcccactcaggttttgcctttgcattcaaatccaagtggtgctgcaagctagagatgaccttccttcctgcattgtctctttgtagccttctttctggaagtgagatgaggctgaggggtgaggttggttgaggacaattccaagactgctgtgggacagcaggtgcactacagcctgtgtccctgcactctgaagcacatagttgctgccactctgagccttaactgtcttcaggacccactgcatgcaggtcccgaggttaagttctgtggctggcagacattcctcggatgctgctgctccccgcccacctccttggctgccaggaactccccagggagggtggtacagacctcttcctgactctgctgctgaagggccctgagagtgtcctcaggacatgtttggcctctccctcaggccccttttcccttatgtacaggaggatgctgatctcaggtgccccagttgcctaggagggctttgtgtccagagggcaagtgatttctcagggagcagggcctcacccccgtggacgggcatcagtagcttctttgttaagttgacagattcaggtgcagctgctggagaacaaggcaccagttgtccatgttccccccatgtctgtctccaggtacccgtaaccaacaaagatggtggtgtcattaatgggaggtttgtaatgtttttgcttctcagatttcaaaacataaaatggggttttatttagagactacatattgggaaaatatactatccacagaaatatctatcattgtcagcaaccattttaatgtcagagggaaaaaaattggatcagcagctttctctgggaggtcagccatggtgagattgtccccctgcccccaggcaggacacagtgtagataaacctgccagctacctgtgcagataaacctgcaagagatgtcagcatgcccctgcactgtgtggcccggggcaggtttcccctgcccaggacataatgccttccattgtccccttaccactcttgataaaagctattcttcctctctcagaactctttacagaaccaaggctgcttcccttctatgggtgactgctatctatcattgtgaagatgctttatcaaatattaatacactgaggttaataataagactctgttctctccccgggcagtgcagtctgagtgaaccacgttaatagcctcctccatctttgggacatttctgtgggatttgttcccaagggcaagctctgaccccaggccttgtctgtgtttatggctctcaggaaaagccagcacccattctccctgccccatgtgtcccccacatgcttcttggctgaggaggtgccaagggtggtgtttgcagagcatctgtagcaattttccattttccctttataacatgtcactgagacagagtgacaaggaggctagtagcagccgagtctctgggagcattttgcctccaaaccctttggccttcagacttgggaaagtagatcaaccagagaatcttacagtctagtgagacagaggtagatcaaataatcccacacgtgtctatgtgcatagacacacgtgcatagcaaattatgacaaatttgctatgaagatttgctgggaactataaagtttgtaacataaactgcagctctcagttcaggggataagcatgtttgagtcagagtgcagggttggtggtggtgataggagggcaggcaggggccacttcacaggcctgataggccaccggtgttgccaaggtcctgggcaggaagcagagaaaaactcaaaaggggtggctgtggagtttaaggagggaatatatattgatttagggtaaattgatatcttgatgatgttgagttttttattcaagacctcagcgtgcctttccatacagtggcagggttgaagggtccgagagagggagcattagctgtgggctgcaggacaggagctgagccttcagtagagggtggagggcaggagctgctgccagcccatcaaagtactttcagcagggaaatgacacggttagatttgggtttttagggctcgctctgactactaaggatcaccctctgtagggagaacaggttgtggagaggctgtgcagaagtccggtaaagagaagacgctgtttgagctagcttgttacccataggtgaggagaaaatggtctacctggcaatatcactcttccgtcatcctgccgctatcgttaggggacctcgatcaagtcactcttctgctccttggggcctctttatcctcacctgtaacaccaggggcttgaactagatgacgcccaaagcccttctagctctgacagtttgagcagaagccacctatggagtggtgttgacaatgtgcctctttaccctgaaccatgtagctttggttcctggcttggggaagggaactgatccttttcagcaaatcggcgcttctccagaaactctctctgttcactaaaggcatcacctaggctgaggccaagtcctggaccatcttgacttttgcagccccatgttctcagtgagtgtaatctctctatgcagccaccacctgcatgcaagacaacaatgcctgatattggtgcagctgcttcgtgttctaggtgcttttgttcagatcatctccatgacccttcacccactctgtgaagtgggcagcttatagctgttgtcatctccctagagatgaggaaggtcagaataccaggaagtggccaagacaggactaggatcccggggttttaaagtcatcacagcgctgcttgggctgcagccctcgggcccctattgaatgttcttcattcttacctcacatgctccttcgcgcttcatgggagatgcccgcttcatgggagatgccccttcccatttttcttccaacaccagcctttgagcctcttggctcctgcctctcccctgtccccttaggatctttgtcttccagcacacttttgggaggtgctgctttacttaagaacctccgggctgttctgtacctggactataatgttcacattccctagactgtcctgcagctgccttgctctggataaattcactgcttctcacccccactcccaaaacctgcttacatgcacacacacacatacacaccttgccagttgccacctgaggggctgtgaatatgacctcctttttcttccctgccattctaaaaccattatcatcttcaaactccagatgaaaactagccttcttcaaaaataaaaaaaaactttttgatttaaactggtctacaataacttgttttcttttgcaataatatataaagatcctattttatctaaaaatgcaataggagctggacgcagtggctcatgcctgtaatcccagcactttgggaggctgagcggggaggccaggagctcgagaccagcctggccaacatggcgaaaccctttctctactaaaaatacaaaaaattagctgggtgtggtggcacatgcctgtgatcccagctactcgggaggctgaggcacaagatttgcttgaacccaggaggcaaaggttacagtgagctgagatcacacaactgcactccagcctgagcgacagtgggagactctgcctcaaaaataaataaataaataagcaataagataattactttgatatctttttaacattttattaacaagaatatatatttaatatagaaaatatgagaaaaacagataaaggaaaccagagattttgttaaagtctcatatagacactttaatgtctatagatgtatgactgtataggtctgtgtatatattaagtgttatctataatataatcttagaccctctttcatgtaacaatatgctatgaatatcttttcatgtcagcaaacatgcaaattattttaatggctatattgtctccctttgaattactataccccaagctcagcctcccaagtagctgggactataggcatgcactaccatgcccggcttctgaccactttaaaatcagtcttatgggttttattcttgcatttgcattttaaggtatgtagtaagcatcctaaagttccatcttagaatcacccctagctatatcgcaaatccttaagggttggggaaatcgctgttcacaaaaccagtgtgatgaaagttggctgaaaggaaaattccttccctaactggttaaacagaaaccgtagaatttgtgccatcatcatttatgatgtgtccctgagagtctgccccatgctaggctttattatggattggcatctgtgtcattgaggttcatcacaagttcatggcagttaaagtatggctcacttggccaggcatggtggctcacgcctataatccaggcacttttggaggccaaggcaggtggagcacctgaggtcaagagtttgaggccagcctggccaacatggtgaaacctcatctctactaaaaatacaaaaaaatttagctgggcgtggtggcgcttgcctgtagtcccagctacctggggaggctgaggcaggagaattgcttgaacccaggaggcagaggttgcagtgagccaagatcgcaccactgcactccggtctgggcgacagagggagactccatctcgaaaaacaaacaaacagaaaacaacaacaacaaaacaaagcatggctcactctggttccccaagctcttggcttcctggcatgagaaggagagaaatcccaaattgtgaacctgcaaagagctcaccatgaaatgattgttttcagaaggctcatggtccatgggcctcccatggtgccttggctcctacttatctttctgacctcctagttttacctgtagcttaaggctgtgagcgactgaaaatgcagacttcctcaagaaagaaacttttttgacttttcatctattagtccccagggtttatgaacttcatatcctatttttctttatgacatctgttgtttcatattataaaaccaatatatgcccactgcaaatattttagaaaacagagaaaagcaaaaaagaagaaaaaattacccacaatcttaccatccagctataacaacacccagcattaggatataggtttgaaaatctgaattttcccccaaaatgcattacaatatcctttcctgtcattgaaatttattcaacaaccttaatagtatcctcattaatataccaaaatattaaatcatcccttgtttttgattatttaagttgctattttctattgttgaaagcaaatttttttaacagaaaaggagggagaggcacaaagccctcaaggaatgtaatagaaagccatggaagcaataaataggtggacccagaaatgggagatgaagcttccaaagataagatacttcaactttacagtttggtttaaggacagctcctatttttaaaacagccccactagggacttttgatggtgaacttcccagatgcccgtgacgtcaggaggtgaagcaggtgctgcagtgggtggggctggcagctggtgtgctgctcaccgagaagggaggagggaggagccacggagaagcctggagaaggagtaacacaagaaagagactgcgccgtgaccctgtggggaggcatttatgctttaaacccccatagggagtattcagagggcagaacctcagaagtagctgtgtgggtgtcgaggaggtagagcgttccttgctccttacagacctcactccccttttgcatccaggggccaatgctcctgccatcagccttgctctctccttttcacttctcttatgggctcaggtggttaaagatgcttatgattttggcctggtgaaaaatccctaaggcaggaaagcacatgaaaggaattaggctatcttggaaaaaggaagaaaataaaaacatgttaatattttctttaggctgggcgcgttggctcacgcctgtaatcccagcaccttgggaggccgaggcaggcagatcacctgaggtgaggagtttgagaccagcctggccaacattgtgaaacactgtctctactaaaaatacaaaaattagctgggtgtgttggcacatgcctgtaatcccagctactcaaattttttttaattaaaaaataatcaaaagattttaaaatttaaaaatgcaatgatttttttttaccagtgtatgaatagatctgtaggataaattcctagaagtggaattactgggtccaaaagcatgtgcatttgtaattctgatgggtcttgccaaattgcctttcgtagaggttgagccagttataccctttccagcaatacatgaatgttttttccccacatccttgccaacacaagcattttatcagacttcttgatctttgcccaactgataagtgaaacatagtatgtttgtgtactttcattttactttttggcttttattatggaaaattacaaactggtaaaaaagtagagacaaaagtataatagggtcattacattatcacctaaatttaacaattgttgatattttgttatatttgctgatctatgttgggggttgaagcattgttaaagtaaattaaagatcatcatactttccccctaattactctagtatgtatctctgaaaaacatgaacattttccacctaaccatgataccattattacacctaataaaattaacagtaattccctaaaaatataacctaatatacacttgatattcagattttccaagttgtcttaaaaatgtctttatgattagtttgttcaaacaaattaaggaccattattagattgtgtgtttgcatgtgcgtgtgtgcatgcacgtgggcttttaatttggacttctattatgagtgacttgtacaattttttatacatttaagagatgcttataattttttctgttaactctttgttcacattactggtctttttccttgttaatatgtaggtgctttttgtatattaagtaaattagccctttataatgtatgttagatatatttttgctcatttgtttgactttgcttatggtgttttatccaatataaacttttttttttcgaggtgggtctcaatctttcacccaggctggagtgcggtggcacaatcatagctcacgacagcctcaaactgagctcaagtgatcctcctacctcagcctcctgaatagctaggattacaggtgcatgccaccacacccctctaatttttaaatttttttgtagagatgcaaccttgttatattgccaggctagtctcaaactcctggcctcaagtgatcctcctaccttggcctcccaaagctctgggattataggtgtgagccacaatgcctggtccaacacaaacattattttaatgtagttgaactttcaattttttattttatagcttttggattttgtgtcatattttgaaagcccttccctacactaacattgtagaaagcatttaccatgattgatttgttgttgttgttgttattgttgttttgagacagggtctcattctgtcacccaggctggagcacagtggtgggatctcggctcactgcaaccttcaactcccaagttcaagcgattctcatgcctcagtctcttgagtagctgggattacaggcgcgcaacaccatgcccggctaatttttatatttttagtagagacggcgtttcatcatattggccaggctgatctcgaactcctgacccaaagtgatccacctgctttagcatcccaaaagtgctggaattacaggcgtgagccaccacgcccagcctgattttggtatttttatagtttcattttttacatttcaatttttgacccacatgaaatttatcctggagtatgaggtatgaatgtaactaacttttcctgcttggccatccagttttgccaatactccttattgagtaattcatctttccccttcctattagaaatgccacctgtatcagccattaaatgcctgtatgtactgggactatttctgtcccattggtatatccatcttttcatatgctagtacaacacagttttactataagtttacactattctttgatagacaaaacatctggaaaggttggtagccctttattactcttattttttggaatattcctatttgtggttgcatgttttttcaatgaagtttttaatcatttgtcttttttcccacaaattcaaattgtataatttaaatatatttaaaacactattaaatatatattgatttagggtaaattgatatcttgatgatgttgagttttttattcaagacctcagcatgcctttccatttgtccagattttcttgtgcctgcctcaggagccttttaaggttttcttcgtatgcattttgcatacttcctttgagatgtaatctgaaacattttgtgtctttattaacattgggggccttacaaattcatatttcaggaaatgaccctgccacaccttcagtgcttccttttgcctctaggattaaatctaaacttcttagcctctcattcaaagctttccacatcctgtttaaaacctgctttcccctgtaatcctagcactttgggaggccaaggtgggtggatcacgaggtcaggagttcaagaccagcctggccaatatggcgaaaccccatctctaataaaaatataaaaaattagctgggtatggtggtgcacgcctgtagtcccagctacttgggaggctgaggcaagagaatcgcttgaactcgggaggcggaggttgcagtgagccgagatcacaccactgcactccagcctaggcaacagagcgagactccatctcaaaataaacaaataaataaaccaaaaacctgcttttctctaacctgtagctattccctagcccctgaataagctttggcctttttttttttttttttttttgatacaaagtttcgctgttgttgcccaggctggagtacaatggtgggatctcggctcactgcaacctctgcctcctgagttcaaacaattctcctgcctcagcctcctgaatagctgggattacaggttcttgccaccatgcctggctaattttttgtatttttaatagagatgaggtttcaccatgttggccaagctggtctcaaacttctgagctcaggtaatccacctgcctcagcttcccaaagtgctgggattacaggcgtgagccaccatgcccggcctagctttggccttttatgcctgtctgcttggactcattctgtctccctggctcccctccccttcacaatccaaagcggctttcttcaccaggtgccccctcaaccactccaattggaaatgacctctctcttcctggaaccctcgagcattgaccatatgtgtcatgtacctgatatggaattcagtattaccctgtgatggcttttgtgttattaaagtgaactgccacttatttattatgtgcttgcaaaagttaattggtgggtttgagtattgtttccttaactgtatcttaaggccttggggagagtgagctgcccaacgcccctgcagcacctaggacagggcccactagtaatagcagcagtagtaatgacgataacaatgagagttcacatgatggcaagctttctctgtgccagcccgttccatgtacaaactcacttattactggatatatttgagggttttagtgtcatgggtgtatttgacctgaaactaaacctttgaagggtttcaggtcacccagtcccaatattcagacaataattctgggtcagagctgatcagggaggaagatgagttttctaggcaaagacctaacacatagcagggaatgaggatggccacaacccgggaaggaaagggaaagaaaggaacagagagggccatgcacggtggctcatgcctataatcccagcactttgagaggtcaagacaggtggatcatgaggtcaagagatcaagaccatcctgaccaacatggtgaaaccccgtctgtactaaaaaatacaaaaaatatccaggcgtggtggcacacacctgtagtcccagctactcaggaggctgaggcaagagaattgcttgaacccagaaggcggaggttgcagtgagccaagattgcgccgctgcactccagcctggcaacagagcgagactccgttgaaaagaaaagaggaacagagaggaatgagatgccggggtttgatggcagcagaggctgtcagccagtccatgctggtggactcacccccttcctgcactggcagggttagggctctggaaataaggcctggctcctggcagggctgtgctgaggcctccttcccatggtgggtcccagtaggatggcctgggtcccctggggacagcaggcccagtgtacagccacctctcttcctgtccacactaccagggttcccagcctagctggctccaggccaccgcctctcctgcccttggaaggcttgggatgagcatctgggctgtgcgggagtgaatgtgctgagcatgccaatgccaggcggctggagccagccagctcatggaaatgcctctcaccttggggccttttctccccttccaatcatcattagcctctcgaaatctttctgtgtctcaacattgcaaagcgttttggggctctggggattctgggtgatttcactccagccttcaaataaaaggcagctaggaggccacctgcctgtgctcaaaacctgtggctcccacgtttgagggtccagggggcatcattcatgtggtaaaaactggggagatctaagggtgctttctgatatttctgcaccaataaatgcaccagcccagtggcctagaattaatccatgttcccagctagaatcactcccttaccctttgccaagcacagataaatagttctcagcacccacgtaatgaaatgtttgcattcttaaagacaggaaaaggaggaagaaatactttcactttgggggacacctacctctaaaggggctaaaactttcaccccccttagtcagaggctccacacctgacctgaagggttagctacttaaagaatagatctggtttctagggaaaaaactgtgggactgtggctggctctgttgaatctaaaaatgccccaaaataagtgcaattgctttccgtccagtatggcatcaaactccctttagttacatttcgctgaagcagcatttgaaatcaggaaagtggtttaatttgctgttgacaaaagggtaaggggagttttctcgctgaaactttgcacagaggcccagaataaatgaatgccgtttaaattttacatgtatttaggattcacagtcagtagtagtacttttcctcttcttggaagtcttatttagatggctgctgtagaattcttcattcttcatgtatgactcaagccctcgtcatatttataatagagtctgtctgcctcaaggatagggaccatcagtcttgtccttgagttccccaccaccacccagggcctggcacctgacggttgtacggtaaatatttgctcaatgagtgcacagaagaatcaagggtctgagttcctaataccaaaatagccatgaagccggaaggcatctgatgcagcaagcctcaggaactgccaggattctacccttgaggcagaactggctaagctcctctttttgttattgttgaatcaagatatttaataatttaaaaagccagccctttcacggttgaggctcagtcgagcacacagcctgctccgaccgggcagaccccgctcctggctaggccactccaggtatgtcctggctgtgatctccccctccactgccatgtaccctccccagggatcctccacaaccctcaggcccagcctcactgccaagtcacctccttccctgaatcttcaaacctaagtgcccagaagctaattgccaccaaactgttcataaatccagagagggctcactcctctcttctcaccttcaattctatcttatttgtttttcttcttttctgctacttttctttttttctccttctcccctcctctatccttttctctctcttttttttgtgccatcccagtcttctgtcctctctccagcatcttgtctgagcttccccaggtaatgctggtgcctaacttggacagaccaccagcattatttgtacagaggcagtaagaagtaccccacctgaactggtacagcatgggccaggggcttggactgggctgatgctgatttaggataggggtgtcatgtcaccttcccagggctgagaaagatagcgtaaagccgcagacagccctcagcccaaaccttcattatccttacccccacatgagtcatacattctacatatcctgttcccttgctcatcattttcctccccctatcaggaactccttgagggcaggaaatttgttttacctctgtgtgtcctcaggcctagcacagcgctgccacataataggaacagaatcaatgtttgtacagacagccacaatacagctatggagtactgatggtgcaccaggctccaggccctggagacagagaagtgaccaagacagatttccctgggctcagggagcatctaggagagagaaggaaacgtaaatgcagggagcagggcacatgaagggagacccaacccaagcgccatttatactggctcttaaaggatgaattagtgttaagtgaaggaggtggggtagagtggaggggttgagagacagcattctaggcagagcgaatatttgatgggttgatgggtaagcctggcactgaaatctgaattcaatggcacaacagtacagagtagtctgactgatacagggaaacagatgctgaattagaggtgtcctgatactgtgcatagaatatggtggcagtgcgagtgatctccttattgcctctgttctggtggcatgtggaccggtattgctacaccttgatggcaaatgctccaaggaagggagtggaatgaatacatcgacttcctctgccaagcatgggggtaccctgggcttaaggtaaaaccccttggccccatgtcacactgaccctgccaacctcaggcacctcaccaaggttcttctctccacctagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctggtaaagtcccttctgtgggccccggggctgctgccatcggcccctcttcagcaaaggcatggtttgggggcatctcaagttctcctggccttcccagttttctctctgctcctttgggaggctctaatacttagaatgggaagcatccgtgtggctgactggtctctctgaattcctcccagaacttcttgcctcctctgaccactcccaccccttcatgcttctcccagaagccatgcagagctcctgactttgggctctgggcatctgtagctggcctgtgatggcctggccctcatctccccatcgggctaagatgcatccctcttggaaccaagaggaaagtgtggaagccattttactgtgtgttttaccacccttgcaagtggaaatttattagaggctgtctcagttgtaacccaccggcaatactgttgaccccaaagaagaagtagatgaaggtttatgttttgctcagcccagagtaagctttgtgtccttgggcctatcaggcaggaccctcttttcctccatttcccccatgtgtaaaatgagggcaatgatacctgtacctgatgaagttattctgagatcctcagagtttgaatgaaaaggcttgaatgaaatattgccttttcaactccatgctgaagttctgcctctcaccctgcattgaaattccactagagagagttacccatggggaacccatcagatgatgcagttatcactgggggagaggagaaggttgattggcagggatgaacccattatcaatcaccaagctaaaaattactcttaacactggctggcagtaaacagttcttagaactgtgcctggcacatggtaagggatcaattaaccatatgttatgttaccgtaagcaaatgccgtttattgcccactcagagggctttgttcagccccagaagggcaccgatgcagcctggttaccgatctctgggtgcttgttggagggaacctctgagctttgctaaaaggaaagcattgaatagtgtcaatgaatgaccatgggacttggtgtttggccaagagggtggagggtgggtgcttatgacaggagctggtccacgctgcagcctctgggatgactgtgcagtccctccatgcccacgggggccactgctgtcccccagccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccaggtgggttcctggggggtagaggaagtcgagggagccctcaaggctgcccagggccttagaatcttataaaatgctgaacagagtgtgggtgttagtgcacattctgggaaggctgtaaatctgccacatgggacagtgcttgtaggaaggagtaaccatcttctgtatcaccccaagtcactgaagctcagggggagctgctcactcagtagtatggtcttttcagggagaagatagaaattaattggtagctgggttgatatctggctggaagattagctttttagcctcctccccctatacatgtaacttcttggtttttgaaatagatacagaaaattgcaaaaattgtgtagaagatctgtgtgtatattttccaatcagaaacttttctcttctcaccctgaaattcaaagtccagattatttgtaaggaaatttagaaaggggaaggggaggaaaacagggtcttgcacctgctggtttggggacagaaagaaccttgcccaaggaggtgagggcaggagaaagaagagagcatacaactcgcggactaaagacctcaaccaagtggccccgcatgtccgatctcactctccatgggtgcataacattgaacaacaatagcagcagagttggggagaatggaaaggcaagaggagctgctaatgaaagtatagtactcatcagcattcatgttgttccacagcctcaaggggcattgcacctccagaggaggaatcagggcatcttgtcactgattctctgcattctattagagttatccaattacagctgtctcatccctgtgccattttggctgactgaggcagggaagcaggctgctggggcacagggcctcaggatgtggtgttgctgcggggctggcggctactccttgagggcaagaaatttgttttacctctgtgtgtcctcaggcctagcacagcgctgccacataataggaacagaatcaatgtttgtacagacagccacaatacagctatggagtactgatggtgcaccaggctccaggccctggagacagacaagtgaccaagacagatttccctgggctcagggagcatctaggagagagaaggaaatgtaaatgcagggagcagggcacatgaagggagacccaacccaagcgccatttatactggctcttaaaggatgaattagtgttaagtgaaggggggatgagggagggagcctcccagggacggcaggaaagcacagatccagatgcacatcctcttcaaatctctcttgttctgctaccctcagattcaggacattgtggtccaaactcaggaaggtcgtgaaacacgctcagccaaggatgcgttgctgttgtggtgtcagatgaagacggcagggtatgccctgggaaccagctgttagcacatccaccaccagccccttgctccgcacaagcactgccatctccagagggacattagacatcatcacccagaactacagctgcctccctgtaattgatgcaaagtctgtcctgacctgattctttgaggcctggaatacaggattcttttccaaagttgcctgcaggcagactggggggtctgtgtggtgttcacatctgatgggggagcctctgtgtgtggttagctgctgccccctcttggtgacctggctcaagaaaggacagttccatttctctcctggtatattggccctcaatttgtacacttgtttgggactacaaaaaatctaattcttagctcttactgtttctcttggatgcagctaccctcatgttaatgtcaccaactttacctccagctggaaggatggcttggcctttaatgccctgatacacaagcaccggtaagagggaggggacagccgtggggactgactgagacagcctccctgggaatatttggacacattgcacttaacatggagtcacagaaatgtgacctctgctgttccttctcctctccccttcagcagcccatagcaccttcactttccttaaatcccagcatgcctgccgcccacttccctcatatgccaaggctcacacctgccccctctcctctgctcccatctcctcctttcactcctcctgcctgaccacctccctgcctctgtacaatgtctgcttcatgctagggctgccctcctggtggggatgctgtggctactcccttttcacagtccagttttgtccccaggcccgacctgatcgactttgataagctgaaggactccaatgcccggcacaacctggagcacgcattcaatgtggctgagcgccagctgggcatcatcccgctcctcgaccccgaaggtgagccacacccacccctgccagcctttgctgcagcagtgggggatgcactcgctgtgctagaggagctcagccgccaggacttctggaggccggcccaggtgctgggcaagctgtgggcacagtgaggggcagtggccaggccaggctctgatctgggcctgcttctctgctccatgctggttcccatgcctgcctggtctgtttggagatggactttggatccttcttcttttcttcttttgtaatgtgtggttctaaaatggatttcatcacactcttccattcttgctctgttggttgtcacttgctgcctgtagttgaacttgatgctggaggaatggggaataaaccctctgagcctgactttcccgacttccagtttggtcctgagagtacacccttttccctaacagatgtctttacggaaaaccctgatgagaaatccatcatcacctatgtggtggccttttaccactacttctccaagatgaaggtgctggcagtggagggcaagcgtgtcggcaaggtacaagctgttttggaaccaaagtgtcactcttcccctgtttgtcaggtccagacagagtggccctctttccaaccaaagaaagggtgaagagtacagctcacccaccccccaacttcctctaaagctgaccttggcaacattgatggctcctgagctgaattccaaagcaggttgatggtctgtcctgaaaggtaccacagctggctgctctgtacctggcgaacacctggtccacctgagacccatgtctcatggacatccccacaggaaccctccaggcttttatgtggtttgtttattgtgattgcagacctcttaggcacccacagtgtaccagaaactcacccattggtatagaccctcatgccagattccttccctctgctagatccttagctcttagagtataggtaccatttctcattcatctctgtgcctcatgtttagtaaagacaatggctggcagcctttgactcctcatgaacatttaaaaataaacaaaaccctggccccctagtggctggcatcctggcacagcaagcttaccaatcttctctagcactggggaggggaactgcacccaacccttaacaggccagctcgctgccgattggcaagaggagggcctcacccaattccagtctactccttctgccctaccagcacacttgggctcagggaacaaacccagcctagagcactccagggcttaggaggtgggagccccatttcgtggcaccttgattgtggtcctcattgatatcctcagtggtggcattgcccttctgatgagaataagtaagaagatgattccttaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtaagggccctggcacatgggagggtggtcctcagtggctgggaaactgaccaccaaaaggtagagccaggttctgggccttatgaagtgtgtccacaaggcacaccctcaagattagagagctgtatgtgtgtcacctgccttgtgcccctcttcaccactcttctcccaagccatcagcttagagaaaccagcattgatgagaaacctcgactcacgaccaaagacagtggcttctcccagatatccctgaggaggaacaggagggaaatcataggcttctgagtctctttgaagaacccaggctggaaagctcctctctggtctgccactgagctgtgggcttgttttctgatgacctctgtgctctcagcccctgagctctctgcatggggccttatggattgtcaagttcatccttctttttctctcccatctgtcactgctcagcaacagaccacttagcctgcttctcaggacctctgccccaccctagtgtgtgcagagcctgtgtgcatatgcttacacacatgtgcatgcaaacaaccgtgcacacacatgcatacctgcatacacataaccatgcatacacacaactgtgcacccatgaacatgcatgcacacacaaacatacacacacaaccgtgcactcatacacatacacctaactatacatgcatttatgtgtgcacacataactatgcacccatgcacatatatatgcacatacaaccacatgtacaaatgcacatacatatatacaaccatgcatgtgcacatgcacacacaaacatgcacacatacacacatacacacggggcattccagcttatctgccattagcttgtccagatcctctgaaataggcttctagctcattgatggtaccttctgctctgctcttccccccatctcccacactctgcattcatgactttcaaatggggaaaggtgaaatgctgagtctaggatatactataaacaagtatctggtttctagtctgacagtaacccatttctgaagccctaaatccaatacagttagcatcctctatgagtctaccagtcactgcacacagaggtgttatctcttggctgtgtagacagtgcttcacggtcacagttctcttaagtgcctgtgagcactgagatccattaggctgggctcagggtggggaccttgcatatagctgatccttgactgccaggtcaaggatgcagaaatgggtggacacttaggtacatgcagaaatgtggaagtacctgatacctggagcctgtaccccatatgctagacaccgatcctgctgacaattcttgtctcctacacctacaagcctctcagagcccagcctttcctgccttctgggaagcatctggcctgtaggacttgtcaggagatctggctcattaggacctgggtgaaagctgttttcagtgcaggatgctctcccacggaatatgctgcttctggggttttattgactcacttaataaggaactgaccagagagctagtaagaagccctcatcacttgcagcacagagaaggttttttaaaattttttttgtattgatccgtacaacttgatatttacaggaattaccagaatacctcagcttcccatgtagaggcaaatgataaatgctgtggtggccattgtgttttctctggtttatattgtaaagacccaaacccctaatagatctcagttggtgaaaaggatagatgttttaacaggtaagcagacctacagattctctttagtttttctgtgtttttaagggaaatatgctttgctatctacgcttcaagatgccacagttccgtgttgactttagcaaaaaaatttggccatgagatcttaacatcagtcttcctacttctgttttcttgacaggtttcaagagaaggggaatctggaagttctactttttaccatccagtcccggatgagagccaacaatcagaaagtgtacacaccccacgatgggaaactagtgtctgacatcaacagggtaccacagcattttccgttatgcattgacagtagattgattgaattcccgataaggacacagtgaatggtcattggaccagattaaaccaagccactttctttgatgttattaatccacatgttgactatttgggggagttatcgaacctggttctgaggggtcagactctactcccccaccctccttcaatccccctgttcagatgccctgcatccctgagtttttttttttttttttttttttttttttttttttggagacagggtctcactctgtcacccaggtggtagtgcattggcacaatcacagctcactgcagcctcgtcctcctgggctcaagtgatcctcccacctcagtctcagtagctgggactacaggcatgcaccaccacacctggctaaatgttacattttttatagagacagagtctggcaatgttgcctaggctggttttgtactgggctcaaacaatcctcccaccttggcctcccaaagtgctgagattacacgtgtgagccatcacacccagcctccgagtccatttttttggagccagttttgtagcctatcctctgtagaaccttgagtttgtctttgaagatggaatattaactacttataaccaaagggaaatgcctatgacatttcagaggcttggaggcttaccaccacctggcagttcatattgaacggaggtagccattagtcaataagaacttactgagcatccagagaggtgaaaaacattattttgggccaagagtctgaggcaggtttaggggaagagggaagtgagactcatgagcagtgccctctgaatctttgatgggcccagacatgaaagccaaaggcttttattgatctttaatctgctaccacgtcacccaagagcatcaggctgtaccttgattccagaaatcactcagtgttgggtgaaaggggtggagcccccaaagtgaggcatttctcctgtgccccaagaattctcattccatcctttgtgcaggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggtaatgagggacatgctttgggtgacaggagaggggacattcttcagagcccccagctcttggctgggctggagtccaagctggcttctcacagcctctcctcgtgccttgcagcacagctcccccgtgatccagtggatcaagatttgcatctggggaggagctctccaggatttattaaatctcatttttaggaaagagccttggagtctagaactggccgctgaagttgtcttatgtgggcctgtagtgtcaactacagctggggtttcagttgatgttaaattgtggttcttgggggatatggtaaaatcacagactgcaccttgtctgtgtcaggcatgccttttggactctggtctctggtgctgtgacataattctagctaagaattgaccccagggctgattcttcatcagagcatctgttccctctcacttaaagcttggaatcaaattagattctgtccagaaagggggcaacaagtattctgagagcactggagagtgtatgcgcaccccagatagcatgtgaataaaccatctgtttgctggtgcatgggtttccgagtgagaagcagccccttcctgccccaaatccaacaggtccactcgaggcatgtggggagtgccagcaggctgccaaggggctccattagtaacacgcaggctgcatctcccacgcgggtggcacggggagtaaaatcatgaacttctcttagagtctcttgtgagacattaatttttggaacttgggtctgataagacaggctgcaaaagtaaggcagaactagctgcttcttgggaatgtgctttcccatctagcactggttctgaagggagctgccctgtccctgagtttggggatgagcccctgggtgtctgactgagctgcctgtttttctcccggtggggcaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggtgggccctgggggccgcccccgccatgccctgcagtgctcaccttgggtctcagtggccctgcagttagcataggcttccttagacacctcccagccagtcatatctctgagtcaaaatagagaaactgaggcagcaaagtgtctagctgcacctgcctctctgcctcttggtccactctgctccagcaggtgataccagcccaggtccatggtaccctggtgaccgagaaatcttgggtttgtggcagcaccggtgccaaccttcagggccttgaagagacagacattaatcaggaacctggagaatcaagctcttagtaattacaatttgactctggttagaatccagacctcccagcatgagggcaacctctcctctctctctgccgcagtgggtctcagctgaggacacacatcagactgcccctggagctttgtgaaaatacacatggccaggccccaaccctgagaccgatgcagtagatgagtgtggggcttgagcatctgtaagatgttctatggatgatgctgatgggcacccccagtaggcactctccctctggagcttcttccatcctcagcagcagcccttttctggctgcatttggctcacccttgctcagattactagagacatgccctttgcaggggtctcttctcctaatgtgtaggtctcttcacttctcctcatttcctttctgctgttctctttgccaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaaggtgagaccaagtctgtctccccttttgaggcttccaatgccagagcctcacctctggcctaacaacccaacttggataaatctcctggaaccaactttaaagttctgttactttcatcaagtaatggtccaagaaagaagcttgagggaccagccaaattctctagagagcaggcaactgcttcggtaacctataatcaccaaggaggcaccctctgtccttcattctccttgctagttcaagttatggctgagacaatttaggtttccagattcttgttttaaataagagacctcactgcatctttcaagaatgaccttgaaatttttttaattaatttaaaaataattttatgttgtacatttctattaagaactaaccccactttttatcttccttaaccctgaagttcagtgggaaataattataaagaatctgtccaccctctgagcaactgggacccccctgcatccaaccccaaagccccagtgacatggcagcttcagggttgtgtagttccaacctagcagcttatctgaagcgtgcccataaatgaagcccatcccccactttgtcctccttccccctatttcttccagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggtcagagttaactcatcttttcctcacgtccctgtacccaggcctgggcaccatctcccacctagtttggtaatagtctctggatcagcaaaggtctctttgagaggccctgggatgtcctttgttgcaaagtcctggcattaggagtcataagttctattctggctctgtggcctggggtacttcaccctttggggccttgtgttcctcaaacaaagggaatttatctagtccagttattcaattacttttcagcaatagcagtctttgctcagatgaattgtgtatggaacccccaggtcacacagaggaaaaatggagctactctggagaaggaggttgagaggccaggaccctgccagctctagctttctgtggcagtccttaagccaggagactctgaggggccacagagagaatttgcaaaccccctgtctgcaaggccactctcacccctggtgttctgattttgtcagcaccccagatgatgaggcatgccccagtctgtgcagcatctcagcagctgaagcacagaattcaggcagtcaggagaaggagaggccgctctctggaacagtgccaaggtggtgctgcactgatgctggagagtcctgggctcttaccctagaaggatcggccttcagaaccacaaattccccccgaccaccgccccagcagcttttccttatcttacccaggaatggagcacctggctggaaagggtatcttttgggttaagatgtcaaggcattggactcagagtccaaaagcaacagccggaaaagcagaggcctggaaggtggcccttgtgacaattgacatcccccacacaaatacacagtaacctctcttcagccctccctccccttcatatgtctctcttgagccagaagcccgtgtaggaagtaactggctctctcccggcctgttccaggcaatgctaactcatgaaatcaaacccatgaaccagaaaggagggccagcatatctgttttcttcctcctgcctcacctgggcaaatggtttaggcagtggaaggagaaagcaagagctacatgttctggagactgggggtgccactggcaaggaaatgtctgctgccgcctcacccatcctcatattttcctttgcccatatcaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggggtgtgggtagggcatggggcgggggcattgtctctcaacatctgacacactgctgggggccgggcccaaaatttagtccacctagtatgcaccaacacttctataccctcaacattcctgtcttttttttttttttttttttttttttgacacagaacctcactcttttacccaggctggagtgcagtggtgcgatctcggctcactgcaacttccacctcctgggttcaagctattcttgttcctcagcctcccaagtagctgggattacaggcgtgcgatacaatgcctggctagtttttgtatttttagtagagatgtggtttcaccacgttggccaggctggtctcattcctggcctcaagcgatctgcccacctcggcctcccaaagtgctgggattacaggcataagccaccgcgcccccaccgacattcctgtctgtctcagccacagtccccttcccagtagtactggaactatagcagcaaggaggaatgattgaggtggtgaacagcccagggagggagagagacgagtcctgggaggctcgaatgctgtgcctggggagggtgggtgtgtatgtgtgatggagggcacatcccaagtgtgcccaaacttagaatcaggccatatgcttctcatgctatatttccctggacattcttgggcagagaaaattgctttctgagagctcttaagtactgtccataaaataatgctcctgcctctgccaaatgcagtatcgataatgaggctggcttgaaggaagaggagaattagcagggagccttaagcaagctttgtggccagaacaaaaaataggccccaaggagcctttagagagggggtgctttcagtgtggggtgaaattgcccatgagttcctggaggatctttgaggacaccgcaaatgcctgcattccctgtctttaccgtgggccctgcacatgcaatgccacatgttcaccacctccccattaccccagccccttccccacacctgtgcctgagcgttgctctgcctgaggcaatctgggaggtgggcctagggaagactccattgtaaagaaagggatcggcacagtggagagttcactggggggctaaggggaggcagcgatgaccagaattctttagagccactagaatgggatgattgtcttagcagcccaagctgcagagtgcggtttaggagattcctttgtcaatctgatgttttacaaaggaagagaatacctcttccctcttctttcgccttgtaggtaatgagtttgtgtgtgttggtgggcaggaggtggtagagattattgcaattgctgcataattgaggaaactagagcaggtctaaaccagagaaacttcctgagaggaagaactcatcagctcaacaataaactatagtctgagaatgttgatctttacagacccctaaaacaggccccatccccaagagaaaaatatcaaggtacctgccatccttaagtgagaaaaaaacccgaggcatgaaattaaatttgagagttgaaaggaacctgagaagtcacccagtctagccagtgatggggaactcactccctcacccggcagcctatctcatttttgggcaattctttttggttaaaaagtttgctcttccattgagtggaaatctgcctccttgaaatgcgtacatattgattctggctctgcccttgagagatatcacacttaccctggttcctcttccgtgtatagctcttcaattatttttcagaacaatgctcattctatacctccacccccagtgtcgcctcatgcctctgcggttctttccctcagggtgcattctccctccctctacatattccaaatcctgtctctgcatgagccagtccaagtcgcttgctttccagttttccagatgaaaagcaatcttttcctcctttgtactggttttgagcttcatatcctatcttacattctaattatttttgtccccaaggactttcctgctagactatgtaaacaaatgaagacctgtatctatttatattgcccaagggctttgcacacctaatacatttttggggttcctgctgtttagagtattattttcctagctatgcccttggcttactctttttattcaggtctcagctcaaatgtcagcttactggcatggcccccgctgaccgccccatggaaagcagcacatccttcctctcactgacccacttggcctctatattgttaccttcttttattttttctttgcgcttatcaccacttgatggattatagacttgtttatgtctctatccacttgaatgaaagcaaggactttgcattactctttattaattaattaattaattttttatagagacagaatctcactccattacccaggctggagtgcagtggtacaattttggctcactgcagcctcagcctcccaggctcaagtgattctcccatctcagtctcctgtgtagctaatgctacagatgcacactactatacccagctaattttttgttttttttgtagagatgaggtctcactatgtttctcaggctggtcttgaactcctgggctcaagagatcctccggcctcagcctcccaaattgctgtgatttacaggtgtgagccactgagcccagcctgcatagttctttgtcatatccctagtgcctaggtcagtgtctgccacaaggcaactgagagttgcttgataaatgcttagtacatgagtgaactgggaaaaaactaaggtttttctgccaagcttatgtgtgagtcattcaaacacttgatgaatgtgtgatcatctttcaccgtatgctttccagttgaagaaaaacctggcccaggaccaaacctagactcttgatgttgcctgaccagtgataactagagtggctctatcaacctcctccatctcaaagacagtgcagtggagggggcaagtgtaggtttgggaagcagactagacccaagctccagtgcatcttggtgtggcctccacccaatggctacagtgaggccactccaggaaaggcctggaaaatcactatggggcctcttgcctggggacacagccagaccctctcccaggaacacttccctgtcgattccagggctttcaaacaaacttggagaaaaccccttgatttcctagcctcagagcaccatctgtgtgccagacaggcacggaattcccagagcacggggtcttcatggtctaggatgggagccgagaaatctgcaggctctctctcctctctcgtatccctggtctctcccagcctgtctcttatatctctctgcagacctttcaaatcatactggctgctgttgtcacaccttgggaatgcacaacagcgctctctgtccagtccatctcctagtccctcagcctccatcccctgaggcagggtacaaagatgaatgagacacttggtcccatcctttaattggtcactccagtggaggcactgggggtgtgttcactgactggggctttgtgtccagtgatgggttgtgtggaggtcacgtgagcaactgtcaccccattgctccttccagctgccttaatcctcctctctgcctgttaggtgctgtgcacatgaaactttatgctatgttatttgtgagcttgtctgaatatttctctaaatcatacaccccacagggcatggtctggttatgtctatattctcccaaaggccaataaaatggcttatacccctgtgggtgttcgagaaagatgggttcgattagagaatgagcattcagcctgcatattacagtgatgcagaatgagtgaacctaggcccaagggcagtgtccctagtggtctggcctggctgatgggcagctctttgaaagaggcttatcgtgtactgcagactgaccccaggcccccaggcatccgccagaccttagcacatttccgtatttcatagcaacactgcactcgaaggttaagattatgctagtcacttaaattatcatcacaacttattcctccccattctcttcttccctgtcctcttcttcctcttctttttcaccagggcatcttttctcttagatccaaggtgatctctttcaggccctaggagacgttgcatgtggccttgggcatttacttggttcctctagggcagctggggaccctatgtcctgaagcattcttgaagttaatgtgagccttttaattattttgatatttcataaactctggggaaattgtatatttgcctgaactccaactacatgcatagactttgctttcatgttcctttacttatggttggagtcacataattaattgccccctgctgatcaaaagatctgattgacagttatatatgtcttgagtaaaattggagaagtgaattttgctcacctacacttcgttaggtagatttttttttttctttttatcatacaaagtctgtggggggagacttgtgggaaatgtgggaaggggtcagggtctcctatgggaagaagagctaagggagaaggtgtctctctcctccgggctgtgtccccatccggcaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggtagagaggcattcagggctgggacaggcgggtctctcagggcagtagctcttgtggtgagtccacaaatgtgctgtaagactcagggaccacattactcttgtcttgtactctgtattcactcatgggggaaatctttgtttctcattaggggccttttccagccttgtgtcccaaactacgccttgttcttgggtctatcagaggctagagaagcgcattttgccctgggtggttagccttccatgtggctttaggcacactgtttattgtgtgcccctggggtaggggtgggggcaaggcctggggagtagtgcctcctccctgtactactctagggggctcattcataccgtggcctgtgtggctgcacgtggtgctcccacttgggaggtgtgctcatcacctcctccgtgtgtcttcatgccttgtctggaaacttgttccaacaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggtactcccgggccccagggccacgaggcccccagagccacacgggggtagtgaggaccccaagcttggtgaggaccccaagctcggcactattgtgactgtgcttttggcttcctttccaggcacaggaagaacaacgagaaggcccaggaggcctctgtcctactgagagacaacctggagctacagaacttcctccagaactgccaggaggtgaggctccagcaaggagtggctgctttcctggagattcctttctagaagcagagttccctcaaggcaggaagtccacagggatcctttctagctcaagagctgtgggattccatgagcggggacctctgggtacttaattgggtcattctctggaatcttcagttgcactgttttttttttttcaaatctgaaaagtcatccttaacctgtcaagtctaggccagagtttcttaagagtagtctagggacagtctattttagaatcacctaggacccagtctgggccagctttgaggatgtgtgacctgtgtcacaccctgtgctttgcttagaagggccctgggctcaggttaatgctctactcttgccatcttgaaattcttcatgcttttgaacaactccattttgtactgggccctgcaaattatggagccagtcctggtcctagttaaagcagacccctgggtcccactcaggccagatgaatcagaactttacggggtgagacagagaaagaacattttaaacaaacctgccagttggaaaactgctagctcagaaggtccttgctcaacctgggaccagctgtacaaggaaggtctttaatccgccttcccaggtccctccattgacagtactttctacatggaatggggttttccctgacttctttcttgtcatactccttttctctcagcccagacaactttgttttcattgacctctgtccttggcttcttcctcaaataacattttttcctgtgtttatcaaggatctctcaccctacggccaaaggacggatttatccacctatccagtaaacactcgttgggttcctagaatatgctaggccctgtcctaggtcctcaaaatatggagaggagcgtaaagtatccctggtctacaccacacacactccagtggggaagatgcacctgtgcccacattttagccctggcctgtcatgggtaaagttgcctgtgctggtacagagggatccagaactgcagatgggttctcttctgtgcttgcacttcctccccatggccttctccttctgcagccagggatgggcagcaggttctgctctgccaaagaaatatactcagggatagtcagcccactctttatgcacacagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggtaagtaaagtgattgggcggcgggtgggtgctctgctcagataggcttgcctggatgggcttcacccagggtgtggaccctgtcctaaagcttgctgacagtacagaacgtggcagcgaacaacttttctaaatagtagctaaaccttcagagctcctgatgtagtcagtcttagtacacctggtcagaatcagtgcctcttctgggtcacctgaatctggggacagcccaggacactgaggacatctagttagagcttcagtgtccagtgccaggacagcagttattaatgtttgctttccattgccttcaccagggctccagcactgtcctgcacagggctggaggaataggcaagatgatcacagtggtccaggggagccattaatcctcatcatttggatggacagaaccactggggagtggtcgtttccactccttatagatggcgaaccaagggacccctctgtagtgagtttgcccagtggacaagtccaaatgtggctggaattagatgtggaaatcactacctttgctcatctctaccatggctgtccatgaaaaagcagccctaggatcagactgacttcttaacctccctgtgcctcagtttctccctctatgaaatgagagtaataataggaccttcccagtggagttgtgagcactaaatgcttaaagacaaatgaaacatttagcatagtacttggcaattatgagacactcaataaatattaactattaggccaggcacggtggctcacagctgtaatcccagcactttgggaggctgaggtgggcggatcacctgaggtctggagttcgagaccagcctagccaacatggcgaaatcccatctctactaaaaatacaaaaattatctgggcatggtggcatacgcctgtaatcccagctactcaggagactgagacacaaaagggcttaaactggggggcggaggttgcagtgagccaagattgtgccactacattccagcttgggcaacagagagagacgctgtctcaaaaaaaaaaaaattaactattattagtgatatagattcctaagtccaatttatatcacactgtgcccacccaaaaatgatacatctatgcagatgaaaaccaggtaaggcaacctcagtaaccgaaggaggtcagcgaaggttagtgcacaacctcaggaactcacggggcagtttctgcactgactgtacctggatgggtctggaatcctttttctcacagcagctgacccttgtctgcaactcccatgctgcggtctccctgagtcattgcccccagcactgctctccctgcccagcttcccctaccagccatgtctaaccctttgaatatgaggaccttttccttatctgtggtggtgcatatcatgaaaattatgcacaggctttttttttttttttttaactcatcaactattgtgttaatgtattttatgtgtgtctcaagacaattcttcttccaaagtgtcccagggaagccaaaagtttggacacccctgctaatgctggggattcagagttcatttcagttgagtcttacccatgttctatgaagattctttgccttactgacctcctcttgggtagcctcttgcaaccatcaggagcagggctgatccaaggcccagtcagcccagaatgtgagctctcctccttcttgcccctaggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaaggcacgtgagtgggttgtagactcagagtgttaggatagaagggatagtggaagccagtctgacacctttatttttaattttaggtttgggggtacatgtgaaggtttgtcacatagataaacacatgtcatgggggtttattgcacatattattacatcacccaggttttaagctcaatacccaatagttatcttttctgctcctctcccttctcctaccctcccccatcaagtacaccccagtgtctgttgtttccttgtgttcataagttcttctcacttagctcccacttataagtgagaacatgtggtatttggttttctgtttctgcatcagtttgctaaggataatggcctccagctccatccatgttcccacaaaagacatgatctcgttctttttttatggctgtgaaatattccatggtgtatatgtatcatattttctttatccagtctgtcattgatgggcatttaggttgagtccatgtctttggtattgtgaacagtgctgcagtgaacataagtgtacatgtgtatttatggtagaatgttttatattcctctgggtatacccagtaatgggattgctgggtcaaatagtagttctgcttttagctctttgaggaattgccataccactttcaacaatggttgaactaatttacactcccaccaacggtgtataagggttcccttttctctgcaaccttgccagcgtctgttattttttgactttttaataatagccattctgactgatgtgagatggtatctcactgtggttgtgatttgcatttctctaatgatcagtgatattaagctttttttcatatattgttgcctgcatgtgtgtcttttgcgaagtgtctgttcatgtcctttgcccactttttaatggcattgtttgttttcctcttataaatttaagtttcttatagatgcaggatattagacccttgtcagattcatagtttgcaaatattttctcattttgcaggctgtctgtttactctgttgatagtttcttttgctgtgcagaagctcttaagtttaattagatctcatttgccaatttttgcttttgtttcaatttcttttagtgtctttgtcatgaaatctttgcccattcctatgtccaggatgatattgcctaggttgtcttccaggccttttatagttttgggttttacattgaagtctgtaatccatcttgagtttatttttttatatgtctaatgaaagggcccagcttcaatgttctgcatatggctagccagttctcccagcaccatttattgaataaggagtcttttcctcattgtttgtttttgtcagctttgtcaaagatcagatggtggtaggtgtgtggccttatttctggactctctactctgttccattggttgatatgccggtttttgtaccaataccatgctgtttttgtcactgtagccttgtagtataatctgaattcaggtaatgtgattcctccagctttgttctttttgcttaggattgccttggccattcaggctcttttttggtttcatgtaaatttttaaataatttttctaggccaggcatggtggctcatgcctgtaatcccagcactttgggaggccaaggtgggcagatcacctgaggtcaggagttcgagaccagcctgaccaacatggagaaaccttgtctctactaaaaatacaaaactagctgagtgtggtggcacacgcctatgatcccagctactctggaggctgaggcaggagaatcacttgaacccagcaggcggaggttgcagtgagccaagattgcaccattgcactccagcctgggcaacaagagcaaaactccatctcaaaaataataataataataatttttctagttctttgaagaatgtcattagtagtttgataggaatagcattgaatctgtaaattgctttgagcagtatagccattttaatgatattaattcctcctatcacatgagcatgagatgtttttccatttgtttgtgtcttctctgatttctttgagcacagtctgaaactttaagcagtcctactcttcctcttaactggacttgcttttatcatgcaaaaatgtctcctggtttctaatccatctccaaccccttttgcagtgggtaggacagagacccaaaatgatgcatgagaaacaaaacaggcactcagaagagggaaagatgactgggagcatccaaggagactccttggaggaagttgagctcaaattgggccttaaaggatgggtgggatgcagatgaatgaagaagatggaggggctgtgcaggtgccaaggctggtgctgacaccgtccccttgtgtctcagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacggtgcgtgggccacagcttctccctacctcctgaggctgagccaccagctgccatcagagtagctggctgccacccagagcaatttttggcagtagatgactggtcacctcaccccttatctcatagggttcttgtgaggattacattaaatggaaagctcaagccagtgcttttgttgggaatgcactgttcacttgctagtattgctcggtgaagagcatggacttgggtcagacagacttgggttcgagatccagctacattaccttcccactgtctgactaggagcaagttatttggaacctcagttcaaaatccccaaatattctaacctataaaatgggggcaaaaccctgatggggtgttgggaggaactggggagacactgccagcaaagctctgcgccgcccatggtgagcactcaggaaaggttggccgtgattgtcatcagctctctcctgcctcctggtctctgcagctttgggtggaggagaggctgcctctggcccagtcagccgactatggcactaatctgcaaactgtgcaactgttcatgaagaagaaccaggtgagtcctgcgtcacctcaccagccccacccacccctcctcacccccacctggccccacgggggtaggcccagccctgacctgcagaaggctagcaacagcagattattgttcttgttggtagctttggggtctccaaaccgtattggtaatcttatagcagaaagagcaggtttttgtgattacagagcaaattctgggaggatcacagaggaggggaggtagttggggattcagggccattcagcctccatcaggcacaggtgaatgcaggatctcgggggcctggcctggaggttgatgtgcttcagtagctgtgtattcggtgtatccagtggtctgcctgagaggagggcagtaactcctgatctctctcccacaacactgccttgcccctcttccagggctgagcttggcatgtgtggtgtccttggggtaagtaggccccatttctctcgacatatgaggatacttgtggggctcaaattccattaggaagccactaactttggactctgagcccttggagcaaacatccctctgctttttggcactcgcttagccctgattgggaactcctgtggccctggtcaggatcctggatgtgagcagatgccaagcactccctcttgggtcagggctgcagtgggagcctgaatcatgtaaggaagctggctgtgtggggtcgcagcggccaggggaatggccacagacccttcttggacagagagaccctccctctgcatgctctctgggtcagcaaggagagcccaggaacttagatcccagataaaagtgacatgtcccagagtgcccggttagtattgcagctccttgaggaaggaaggtcatggcagacagcactcccttcccccagcttggcagcagctgacatctgctcacaggaccatgtgagcccagcagcagtgcagaggcctagattatattcagagaagtttcttcaaagctgccttaggccctttgcttctggttgacatgatctagtcgcagaggctccagcagccacacgcagggacctgggctagaagatgatagaaatctagcctcagttaatgccacaaccttcagctaaaggtggaaggctggtaggacatggtatccttgggacctcagtttccttaattgtaaaatgagccaactctagtctttccaacactaggatttttgattctatgcagcctctgtaagtgttattgttcaaaggtttttaactcccctggctggcagttgctatttcgggaaaagggcaagacaaatacggatggggttcccctaaccaagaagggaaaggcagcctcttgggacagcgtgactgccctaatgaagactattttaggctcacctggctaaaccataaatccaattttatcatttcctcacctaaaaccctctgttgcaatggttgtcaaactccaatatgcaactcctttaacaagccttctgggtgagtttacacgacttaaccaggtgccacccccagatccctactgcatcaagctctgggggtagagcctaataatttgcatttccaacaagatcctaggtgatgccgatgctgctggttcaggactgcactttggggaccactgttcccagggctattcattgcaattagaacaaattccacaaggtagtacatgaagggctctcacccctggctgtacactcacatcacctagggaacttttagacagatgaatgcccaggtctcacctcagatcaattaggatctctgggggtaggcccctagctgcatctgtttccctggattattcagtgggcaatcaggattaagaaccactcttgcctgacctgacccctgcctgcttctgaaactcagctcttctcactttgccctccttcacagtattccagctcttctggccctctctgtggcctcagacggtcccagctcatgtccaccccagagcctttgcacttgttcagtcctcttgccaggaacactcacccccagatctctgtgtggttgcctccctcccgtcattcatgtcatggtcaagtttcgtatcctcagagaggccctccctgactcccttagctaaagtggctcctgccacatcgcagcagacattctccatcccactgttgtcttttcctcgtagcccccagggaggaaggcccagcctttgtttattcatttatttgcatgtttaccttctatttcctctaccaggttgtaagctttaaagtgcagggattttcatttctcttgtttctatattgtccctattacctagaccagggtctggtacatagaaaagaacttaatacatagttgttgaatgaatgaagacagggaagaagactttaaatgtaagtaccctgcacagatactagaaagtaattggttaaaaaggaagaaatacccttttaggccgggcgcagtggttcacacccgtaatcccagcactttgggaggccgaagcgggtggatcgcctgagcccaggagtttgagaccagcctgggcaacatggcaaaagcccatctctacaaaaaatacaaaaaattagccagatgtggtggtacatacctgtagtccaagctacttgggaggctgaggtgggagaatcatctgagcctgggaagttgaggctcagtgagctgattgtgccactgcactccagcctgggtgactagagtgagaccctatcttaaaaaaaagaaattaatttttagggcaccatgcagaggtcataagatctcagagtaaacaagcaaatggagctgaaaacatgggttgtttgaatgcaactgcagagactataggaaattgtaaaaattgaggttctgagcataaagtgtaaaaatgcatttcagcaggttatgtgacttgtagatgtggttattttgtgcatattttaaatgctggccatcactgtgctgctcatgtgggctgctcttgcccctgccttccaattttaaaggccacaggaaaattatatagagagggaagaaacaggtagtgaggtatatggagctcaggagcccacacaccagcagcagctagcccagtctttaggacccagaaaacaagtaacacgtgtcagggcctcctgaagaaaaaggtgaccagccaccagggtgggaggaagaggctgtgttcatgaccaaaggctcaaacagggactaatgcaaagctcacaaaaatatgagaaatagaagtagggaaaaacaaaagctgagactgtaagcaaggggctgctgtcacctgttcttttagatggaaggcaaaaactgtgcccacctgagctgctgggttgggcgtatcctgcgtaaatgatcctgcataaatcctgcaaaagctgttagaataaggtatcaaaaaggccatttttcttttccttccaacacatacacctaaggaatcaagctctgctgaagcacaggaagataggggacagtcaagagcacaggctgccaggtcaggtggagctgtgttcaactccggctctgccactgagtgacttcactgctgcatgctggtctccacatgcttatctcagcaggccacctgagggtgcaagaatggtgcacatgaggtgcttagcagcccgcaagaggtcattggtagttcttatcgccatcacctgctctgctctagcaacgggggtgagagggaccaagggtgtcagagctgtgctgccactgctgaagcagcctcccccgcatggtgggaaggccctgccccgagcccttccttctggccgcagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggtctgttcgggcaggggataccagccagggtgcccaggcagagaggaagagttgaggttggctgtcggtagggagccttgtgagtccaactgtgtgaggagtgaggccaggggaggggcacaaggaacccacagactccctgccctcccttggtgcctccttgaacacacccctgcagggcacacactgaagccaggtgcctcctgtttacccacttaggtttgctctaacccaagggttctctacttttctttaccctggattctgtacgctatgaaagagatggggtgagaggtgacaggtgggggtctctcaaagctggaatgatataggatgttttcatggggacaggggttagagcacaaaaggaagggtatatgtcggatacgaatcaggggagtccagagaggaaggtagggcacgggcattgctgggaaatcagaagggcaggaaggaagcatgtgtggctctcctgcgggtgtcccacaagcctactcccctcctccctcgggcacctccaggagtgggggcacaacttgccaagggagggatcatggccagactgagctctggcgctgaccgtctgctgcctcctaggatgaagagggcgccatcgtgatgctgaagcgacatttgcggcagcagcgtgcggtggaggactacggccggaacatcaagcagctggccagccgggcccagggcctgctgtctgcaggccaccctgaggggtgcgtgcgccccctgtggtgactcggtcaggagatggggattgagccaggggcccaccagccaacgtcccttcagatttaaaaggaaaatggaaagagttttcccatcaaatagggctggagaaaattgctgcgggactggtgatggatccaatttcattttatgccttggttttgtgtgaatcacttccagctgggccatcgaggccctggttttcgaaatgatcagagaaggggttagcaaaactaccctcttggtgacctgagagcaccaattttccgaagggttacaatatgctaagggacactgaagactactttagcttttatttttatggtccagaaggtctccaggacttcacagtccagacagaaccatgatgtaggagtgcaggtggaaacctgtgcccacatgggctgcgaggttttgtggatcctgcataaatggaagcccactgggccacagaccacacactgcccccagccatggccctgtcctcagctgccattagggtgcccaccactgtgggtcctcagcagccaccccagaggtttccctgggagccacattgtctgggcccctagtatgtcttttccctccctggagggctgagcagagctgttgctgcgggagccccactcaggtagtgctgctcccccagcctctctggaagaacaatggaggcgttccccatttgcacttgtccctgtaagcttgccagagtgaggggcaccatgggaagcacccctccaggacagaattccaggacacagtgtgtcatcccctgaggctagggtgtggccccttctctccccagctcttccccggcaaagcccctgtcatttctccagagcttcactccctacctatccctgccagggggctgtggttggcatatgttggctccctggagccacggctctgggttcgtggctgccgtctctgagggcctttttggttttgaattccagggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactgtgagtagccacaactcctgctgtttttgtctttctctaatgcggtagacgcagccagccgtcactcaagacacacagagtgctgcataggacgtaacctccccagtgtgaggcgggaccagccgatgcaggcctgccctggggaaggtgtgacagcgcagctcccggagctgcagttgctgcctgggaaagtctttggctaagctggtgacacctgtaacccctgtgccccccataaccacatttctgtctgccccatgcctagcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtaccttcagccccctgccgcccacctgctaccaatttccaggagccctgggtgtcagtccccacctggctgtcagcaggaaaacctctaggataagtgccaggaggttttgcctccttagacagccaggagctcagggctgggagcagtggctttcagatgttccttagcttcagaagtcattctttaaactgaatcctcacaaaaggccaatgcatacaatactatacggttgcagtttctccagttgtgcagtactattagtggacacacgcacagcacttttctagcaccaggtgctcttctgagcaatgtatgtagccgctggaccctcatggcagtcctctgaggcagctactaatattccctgcactttgtagatgagaaaagggagaggtagaagacccataagtttcccaggaacatgtaggtacgaagtggagccagggctcagaccctggcagtgtagctatagaccccacatacttagccaccgggcacttcagcctttccacatgggagctggagagcccccaagttctactgttcagacccctgccccatcactggagtgccctccgcagatccgtagggtgccccagagcttggtgtgatagaaagggcaaatgcaagggggcccctgttgctgagggctcccccagcttccagtgcagcagggagaggtaggctggctgcgcaatcccaggccagccctgcagggcttggggacagaacaccagggttggctgggcccctggttcatccaaaaggggacctcttagggaagtgtcctccagctggagtggagggcctggtgtgtggctgttgcatttggggatgccagggcccctgagataggtgtagccccactgaggtcttaggagtgaggtttcactgtccccagggccagcctcaatcaggggatctggtgcaaccacttccttggagaggcagcacacagaatggttaagaacggggactcaggagcacggtgcaaatcccagctgtacccctttactagtgtgaaggaccctggaccagttacttagcttccttgtgcctcgttttccccatctcagaaacagcaatagtaatagtacctccttcctgggtttgttggaaagacgaagagagttcatcagtagaaagtgtttagaacagtgcctggtatgtagttcctctcattagtgtattgttgaggagatcaaagggcaggatttcctctcactcccaaaccttcacaaagttcaagaggtatcttgggtaggcagaggtgttaaagcaaggagtcttctcctacagcacccactgggtggaggctgaagatcctaccttccagcagtgccctgggcagggaggccaggaggaggtagctgcccttccagtcctaggcccacagcacctagggagcaatgtccagggaacaatgtctgattttgcctgaccacaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccaggtgaggggagtgtccttgaggcagaggcagctcctctccaggccagaggagcccggccaaccagggtgctgcactgtggctcctccgtgaagggacagtcctggactatcgttccatgaaaatccctgggggacacttgaggcctgaggctggatcgaggcagaaatggcctgggtcagcttccactgggaggaccaatcgctccagagtcaggagagtcctgagtgtagagagagagacatctgtcattcaggttctctaatgggaacagtgaccatggttgtcagtgaaaataagcaactcacatatccaaagctgggcaggtctaagactgcgcattcttctcccagccctgggatgtgagggggcccttcccccaaaactcaggaagaagctcatcgtccatgagaggaggagtcaggcatgtgggcagtgagagcccctgcagagatcagaccactctgcccagtctgtgtcacttcatcagttattgctgatccatctccatcctattgcccctaaggtgtctgtcctgatggtcttacttttaacatccttatggagatataattcacataccacacttcatccatttagtgtgtatcattcagtggtttttaatatattcgctgttacacaactatccccacaatctaaggttagaagattttcatcactccgcccctattagcagtcactccccattcccctctcttcctagtccctggaaaccactactcaactttctgtctctctagatttgcctgttctggacatttcatataaatggaatcatacaatatgtggtcttttgtgactggcttctttcccttagtataatgttttcaagatgcatccctgttgtagcatcaatcagtactccattcctttttattgcccactaataatcccaggcttctttggggatttctgtacccactgcccatgctctggccactgagcaatggaagataccagggcatctgtgttcctgctggggctgggctggcggaggaccccctggctggccagagagagaggagggagcacggtcacactcccacaggcagggggaggtgggcccctctggttgggacacagaggcaggccagagtgacccagagttcccttcttcccttgtcctcctgtcccccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggaggtgaggggactgcaaggatggaggcgagctcctccgtctccgtccccactgtgccagccaggcagcctcctgggagggagatgagagctgcagcttttctgaggagcttgtcttgctctcactcatggagatcggggctacacacaggcccggggattggagccccagcaagcgcactccctgccttaaggagctggccactcagtaacggagagcagcctcataaccggcctaacacccacaggtgcacacactttggagctggtgacctcctttaataggagaggcgcatgggcctcagagaggttaaataacttgccccaggccacacagctggcaagcagctgggccaagacttgaagccagggctgtaggaccaaacctggcattctttgcaggacccatctgcgcactgcctcagatggtgaagggtgagccaagcctgagcttttctccctttcctccccatagatccgcgagaaactgcagcaggtgatgtccaggaggaaagagatgaatgagaagtgggaagcccgctgggagcggctccgcatgtgtgagtacagccctggagccagggcccaggggcaggagtacccccgcaggagtaggggaatggggaggtgccacaatgggtggattttcactactgcctagagaggagccccccacagcactgctcttcagcaaagctctggggccaggggcctcagcggtccaggcagaaggccagagtagacacgctgctggaagcctcactctaactagccagcgtgcccccactccctgcccatcctctgccgcacttgtccccagcctcatgcccgggctggtatgcctgcagagctatggcctgggggaggagttgggggcccgggggaggggctgggggcctgggggaggggttgagggtccgggggaggagttgggggtctgggagaggggttggggtaaggctctgaggaatcccagacattcctcatgaggaatgtcaagcacagaaccggctcttcgtccttcagctgggtgctgatgagaggtggggaaaagccaccattcagggaggagctgtgagccaagaagggccaactggtcccctggccactcatccagcatcatgtgagacagccaagggctgggaagaatgttcaacacagaagactccttttcagagacatctaaaatacattttgttttcaaaatagagttctaattagtgaaaaatatagcttaaaaaatataactattgggccaggcatggtgggtaacatctataatcccagcactttgggaggccaaggcaggaggattgcttgagctcaagagtttgagaccagcctgggcaacatagggagatcctatctacaacgacagaaaaaattagctgggcatggtggtgcacacctatagtcccagccacttggtaggctgagatgggaggatcacttgaacccaggaggctgaggctgccatgagccataatcacatcactgcactccagcctgggtgacagattgaagccctccctctaaaaaaatataactattgtgaagatcggttaggggcccagtgtggaatggggtggctgcaggcagcaagcgtatccatgtggtttagggacacctattcaggccacctgcctgaccactggccccaatcaggagtgaacgattgggtgctaacaggccctgggccttgtggggggtctgtgtcctgttccccctggcagtgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacggtgagcagggaacagtgctgggaggctcaggagggtggcaactgtgcccccaggggtctcatgtaaggactccaggccagttgttaggtacttagaatggtgtgacaggcttggccagcagcgacaatgggaaggaaagacaagtggcaggaagtactgacctccgaatgcaaaggacagaaggggctgactctagaaggaacaagtgtcagggcatgtgggggtgcagggccgcatccagagggagatcgtctgagaacacaactcgcctctgtggctgctctgacccctgggccttctcctcctctagcttgagctgaaagaacgccagattgcagagagacccgcagaggagactgggtgagtggtggccgtgtgtccagggagctgaatgctctgccaagtgggagtagggggtgcctttcatcagaaacctgacattgggaccagttgcatttgacttctcacactgggcaccctcgtcaggaaggcccagagtgcctgagcatgagcgcagaggaccttttgcttccccagtcacaggcgggctgaaggcctggtgcgggaggagggggctgggagcagtggctgccaggcgaggccccacctcggagccacctgaacacggggccccacaggctgttctgcctggaacctggctcccttctgaagaatctgccttggcttttccgaagaagtcgctgggcggctccttgccaagcaccatccaggctgccggctgactggagggggagctatttggtgctcctccctgtgggcgcaggtgaaaagccaggcctcgcaggaggcactggcctcagaggggtgcttgtttctaaagagagactgtgtcttccttaggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccacaccacatccccatacacacatccacacacacccacacacgcatactcatacagaccacaccccccatacacacctcacgcacacccacacacccacatacacacatatgcacacacaaatatgcacacaccacacccatccacatgcacacaccacaccccatacacacacatccacacactcacacccacacacatacacactcatacacaccacacccccacacacacacacatgcacacaccgcaacctccacacacacacacacatacatgtgcacacaccacacccccacacacacacacactcacacacacacacaccccaatcactcagctgtcccatcccacctgccccaccacaggcatcttcagtggtgaagtgggggtgcccatccttgtaggcgattctttccccctatgcagagccctctcctctttccaccgatctggcctgaggcctgtgggtcagtgagtctggatatggagctggttctggggcaagaacagacttgaaggaagcctgcaaaattgaggagaatcccagggctttgagtaacagaggtcagccccccaacttgtcggaaaggaggatgagccagaggcctggctcaagggacagggagagcccaagacagcagctgccagaggcctagggcatgcgcctcaggaccttacctggagcaggccccttaggactccatggggtctgtgcagggagcctgggaggctgtcacccaggcttagggagctgctctggggagcagctgaccgagaagaaagcaagaattcagcacacggcttgcacggcttccccctgcatgtccccgctgtggcaggctgcactgggggccaagggagccacagatccttcctgcagcccacctctccaggtgtcccgtgagcccgcctgaacctgggggtgaggttaggaagactggcattccacatggaagtttctggtacaccagtcacacccagaaacatatacagatagtgaggcctccctttttcagcccttctcaccctctgagagagacagatgccctccccacccacccccatccaccacccgcgcgcgcgcgcgcacacacacacacacacgcacacactcctctgtggcctccagcctggccagaggcctccctttcctagctgcaccagcccaccatgcccagcagagggcactgctgggctcctgctgaagggtctctcccagaagttccctccgaagctcccgtcatcgcatgtggggtcgcctccctgtctgtggtggactgtgtcccagcccctttttcccagcaacagcccctgccggaaggagagcgaactctggggggccggcacagactgcggacacgggctagggccctgcaccctgcccccgcctgcttctgccatgcgtccctgtgtgtctgcatgtggcggtgtcctggtgtgcgggctcctctgtgagcaccagagcgactccatccactgtctgtgtcatctgtgtctgtgcaaatgtaattacttgtgcatcagagccgcctccagccaacacctgaatgtcactgggttggggggaataaaacctgtttggacctgatgatctctttgggggaagaagtgagcccacatttgagaccctttccggagagccagccactccagcagatgggaagactggcttgtgcccggtaccggaaagaaaccagatggtgactcaaacgaacacagacccaaggcctc

SEQ ID NO: 16790 - DNA, 78630 bp, Human
acagtaagatgccaatacagggggcagtataatgagaccatttcacattgtgcagccttatccatgggtcctaacccatactgtccccttatttccagatttggtaatattctggtgcctctaggtcttagttcagcaacagtaccactaaaatggacatggtggtagtatttatccacctgaggtctttaggccagcccagcctcatctttgaaatttttgtgagtgcttctatttactaccagagactgagaacaggggaatggctggttgtcaaatgtcactctggtctataatccctggatcctagacatgtgacatggaatggagtgggaacagagtgaagtgctctgagcaggaagtaaagcttgtctccaagtgtacccggaatgtctgttatcataccttctataatctcctacatacaactcccccagtttaatctcttggtattataatttttggtgtagtacttttgatgcatgccctaaaataaattctcttctattgcttgtccaaaggtagcagcgttttcctaaaaatcacaactttaaacttggttgttctggaggcaagtgtgatgagtaagtccactccataagaatcaataagaatttcttttattctagctgggcgtggtggtgagcatctgtagttccagatactcaggaggctgaggcaggagggtcacttgagcctatggtttttgtttgtttttttgttttgctttttttttttttttgaaacagggtctcgctctgccacccaggctggagtgcagtggcacaatcatagctcactgcagcctcgacttcttgggctcaagagatcctcccaccttagcctgtcgagcagctgggactacaggcatgcgccaccacgcccggctaatttttttgatatttaatagagatgaggtcttgctatgttgcccaggatgttctaactcctcaagtgatcctcctgcctcagcctcccaaagtgctggggttacaggcgtgagccaccgtgcccagcacatgtcttctaaaagctgctgtttcttcctttttcaggagttctttcccatactgttcttctggatgactcctcgtcatccttcggatctcaaatgaaaggtcatttagagaggcttggcctgaccatacaattcaattagtttcttacccctttagtctctctcatagaccctgttattttccttcatctcatttatcacaagtcttcatatatttattgcgttggatacattcaattctgtcgattttcttagaatgtaaggtttccaagggaagggacttcgttttgttcacttttgtattcctagaacctagcacaatgcctgacacatagcaggtgttccataaatatctgcggactgactgtctatttcacttatccttgttccttgtactgcatttcagttctcgctactgcagtgtaacctccaagagacaggagaaaatcataatacccccctccctccatcactgagtgatactgagacggcgtccttgcacgtttgagcagctgctgccttctcctgggaggctgtcaagtaccccaaggtgcacaataattcttttagtaattgcctgactgaggcaaatcagtagagctgtcagaaatgctttcaaacttaacattcattgggttcttgggcacctgaaattgcaaacaattgcattacaattaagtgagaattagcagaatgttacagttctttaacaatttgcgtaacaaaccgaggcgtcctacgccatctcgctgaaatgaaattcggatgtagacacccttgcgcttcaggactctacgctcttgcagcagctcctctgcccaatggggggcggcagcatctcagtaactcactcgaaagacgggtaggcgggaggagacattcgcgttcaaaatctttttgcctctatccgctcgccgtagcgctttagcccgctcgagtttcaatgcgcgttgttgcttaacgaagcagagtcctacacactgtctgctgctctcctgatcatggcttctccgagttctttcacctactattgccctccatcttcctcccccgtctggtcagagccgctgtacagtctgaggcccgagcacgcgcgagagcggttgcaggacgactcggtggaaacagtcacgtccatagaacaggtgaggtggcaggactgggcgaggcgcccgcgcgatgtgttctgggagcgcgagtcccgttcgtagggccgcccgggtgcggaactcaccggggaactacgactcccacagcgcaccgcggtgcctttcctctgggaagctccgggcgcccaggcttgggcttcgtcgtggagcgtttgcgcggccagcttggggaagggtcgtttcaaggttgggcttggaggagagggcagtagccgagtcccctctgccctaaagaacgagaagaatcgtgttctatgcctggaggacagaggcagcccgtgcgggtcggacagcccactctgttctgccagtacttcgggaggttctggggtgcatagtgcacttttcccaacctgccctcagcttctggaggcagagagcagggccaggctgctgtcatgccgtttcacgatctgtttaatttttgacctacagtgccaggtttgggggcccgcctcgtgggtgggcattttggtagtcattcagccatttgagcaccagctacgtgtcggacacaatattaaacgatggaagtacaaggaaataaaacagctcctgaccaggagcctggttgggggacaggcaggaaaacagtttggaaagtgatctaatagaaagaatggattttggactactaatcattccctaaggcctagaagtaggatcgaacctatcattttgaaaagtgtttggcgaatgagtatatattcatatgcccaaaaccatagttttgtttttcttcttattccctaattggaattgttcccaaggttgctatgtggaactgtttatccatctgtccctaggagaagtggttaggataattcttaacactaataaatgaacattctgctgcttactgaaataagatctcttagtgagatcagtctccaggctttaccttggagagacctgttttgtatttcctactttaagttggaagcctgtactttggcaaaattagtaacaataattgttttattgtacagttatgactaaatagaattataaatttataacagaaacaagggcttgatacgtggttattcacaaagtagcagagaaaatattttaactggagatttaaacttcatggaatttagggtagcaaaggaaatcctcacctctcgaatctagctaattctccaggttggtttgcctaccagtgtgtcccagggaaggctgactgcaaaagattgtaaagaaatttcccattgatgaaaaacctacaggatctttgcagaattcctaaatgatggattgctgagttgattcaggtcaagtgttttacttattatctgaccttagactatgggattgcctttttttttttttttttttttgagatggggtctcgccctgttgccaggctgggatgcactggcttactgcaccctccgcctcccgggttcacgccattcgcctgcctcagcctccagagtagctgagactacaggcgcccaccaccacgcctggctaatttttgtattttagtagagacaggtttcaccatgtggccaggctggttttgaactcctgacctccagtgatctgccctcctcggcctcctagagtgctgggattacagtcgtgagccactgctcctggtgcgagtatctttcaaatctagacccaacggtatggcagacagtaaagaatcttatatttctttttcatgttgttattccagcacacattattagagtctaggatgaacagtttcaggtagtaggatgataatgttgtatctcatttttgtggccttcctcactgttttaataatcatgttagtgaccatttattgagtctcagcacagtgctaaatgctctccatatgtggtatcattcaatcctttcactttttatggatgagaagactgaggtttagagacctaccacattggtaggttaatgatacattcatcaaaagtaacaaccttgttaggaggagttgtttacagaggatatactagtactctttcagttttaactaaagcttccatttactgatagctcaattttgtgccattgccagtaaaaacaaattgatggctgacacctgtaatcccagcactttgggagttcgaggcgggaagatcacctgagcccaagagaccaacttgggcaacatagcaagaccctgtctctaccaaaaaaaaaaaaaaaaaaaaaagtagctgagcgtggtggcatgcacctgtagtcccagctacttgggaagctgaggtgggtgaattgtttttgagctcagaagttcacagatgagccatgatcgagccacggtactctagcctgggcaacagagtaaaaccctgtctcttaaaacaaaaaacgactatactgattttggtactggcctgggcaacatagcaagaccctgtgtctatttaagatgaaagcttttcaaattaaaaaaaaaaacaaacaaaaaataaatgcttgttacctgcttcctatctgattatcagaagactcggtttatttgttaagcaataatttggtaataggagttaaacctataaatagtggaaggagtccttagctgtgagtcgtctgttccattcgttgattctcattcattcagcaaatacttgagcgccttctacgtgccaggcactgttctagacactcggcataagttgttaaacaaaagaggccaagttgatgcctttatgaaactgtttctaggccaatgaggcagtcaattaaaagagttaatatctatagctatctcaatataaaatgttaattagaaacgctgtggagagtaacaccttgggatagaggggatagggtgtgtcaggaatgggtggggtgggagcaggggaggtcttcatataaggtgttaaggggaaccctctggtgacaacacatgtgatctgagacctgaagtctcagatgagggaggaagccatcatggatctggtgcaagagtattctgggcagagaaagcagcaagcacaaaggaccaaggcagcagaatgccaggtgagcagggggcttagcaaaccagagagtaggagatgggtcggatcatgtagggtctcattggcctttggaagtactttaaaataccctgactgagatggagagccacttggctgtatacctgccatttactgccccagattcacttggcccttttctagcctgctctgtagatgtgccccaggagggggccctgcactgacaggttgccttgctttatggctgcgggccatgggaagtattgctgggggtgaccgagaaggagaagaatgagaccactgtatttcttccctcctgcaggcttgtgtggggtggggtttccttagacttaaggtcacatttcctgtcatgtgccttctctgcggagctctttgtctccctccctctccatccttcacaccttcaggtctatgaggagttcaggtacccctgatttaccagctccagatactgcattttctcttgtggtttccctacacctgcccacatctttgtaaatagttcctttataaactctcctcaaatcacccactttgtgccatctgtttcctgccaggacttagactgatccatgatcagagagttttgagcaggggagtgacacagtctgactagcattttaacaggctcatttaggttactgtcaagagtagatggtggggagtgagggtggatacagggaaaccagttaggaggctattgcagtatcctgggagagaggtgacggtggcttagctcacagtgacggtagtggaggtaatgagaaatggtcagctctggatatttttatgaaggtctctaccttgctaagctgttttgttaatgcagatgcagggagggcctttcatgacactagagaacaagacatggttgtattgttagtgcctgccttccttattgtgccatctggaatcatcccattgcagacactctgattcaggccagtaggttaatactgatagtctcagaggtagcagccttgccaaaaacaggtgtttacaaaagatactactgtttttctttgagtttgtctttgaacagaggcaaacgcgtcctccactttaaatggcatggtgtcattgaaccattggcatggttcattgtcaatgaagtgacttgaactctgaggggaatataagagaattattagtcttgatccctgccctcaaaattcttttatcttagagagataaaaaagaatatgctgtaaggccgagtgcggtggctcactcctgtaatcccagcactttgggaggctgaggctggcggatcactggaggtcaggagtttgagaccagcctagccaacatggtgaaacctcatctctactaaaaaaatacaaaaattagctaggcgtggtggtgtgcacctgtaataccagctactcaggacactgaggcaggtgaatctctttaacctgggaggcggaggttgcagtgagccgagattgcaccattgcactcaagcctgggtgacagagcaagactccatctcaaaaaagaaaaaaataagaagaatatgctataggcagtcacagagtgctaaattataactgctttgcacgaggattttggggagttgaaaagccatctgtgtgggctgaggtggtcaggatgacttcatggagaacgtggaactgggtgggctgtaaaaaatagagtttggggcagccattcaaggagggagagctgttttgagggaagactcaggcttgactgggggcgttaagatggcttaccaggaacggagggtgcaggttggatgtggtaggaaatgaggtgagctgggcgggtgggcccctatcagggtattaagaggcaggtgatgtgctggcttcaggttcgggcagtgggccaccacatatcctaaggagggaccagcggaacagaatcctgacctgctgttgacttatttcagcttataggatccaaaatattagtaaatggaggtggaacaaatcactaaatatgataaaacttcccaactttttatgcctctgatagaagggactggagctctgcttggttaggtggtcagtaggctagctttctgaatccattttattttattgaaattcagcatataccatattgcccaagtgtaaagtaatcctgcatatcaaaatttccccattaaaaagtccaaaaggttgtttttggtcaagttgaaaatacatgtacttttaggtatataagtgaaaaatacctgcttacaaaatttacatttaaatttgggtccatatacctacttaaaatcacctactttataaagtaacactaatttagaaatgctggttttcctcctcttcttatttataaaatgtttcttttcagactcttcacatgcatctttgacttcactatttttatcatcactggagccactttttgagtcagccaatgtggatttccggaccacatgttcagttcttgagatacatcgtttttgaatatgaataaggtgttaccactgaacagtttattccaagttacaagtatccacttgcataacattagactttttttttaagaaagggtctcactttgtcgcccaggctggagtgcggtgatgcaatcaccactcactgtagccttgacctcacaggcctgccttggcctaccaaagtgttgggattacagacgtgagcctagaattttttttttgcagtgtttccagttggtatatatttgtggtcactgcaacttaaccactttattactttttcaaatgatttctatttttttttaaagacagggtctcactctgtttcccaggctggagtgcagtggcatgatcatggctcactgtagcaactttccaggctcaagtgatccttccacctcagcctcttgactagctggaactactggcgtgcgctaccatgttcggctactttttatatttttttgtagagacagggtttccctgtgttgcccaggctggtcccgaactcgagctatccgcccaccttggactcccaaagtacaggcatgagccaccgcgcccagctaaaatgatctttaaaacgttggtctactggccaggcatggtgactgatgcctgtaatcctggcactttggaaggccaagtgggtggatagcttgagcccacaaattcgagacagcctgggcaacagggtgagactccatctctaaaaaaagtaaaaaatgaataaacaaaataaaaagctggccttacaatggcagtttacacatggaagtgtgagtttatatctccagggataattactaaatttgtgtttaatttatcttgtttcactgattaccattagccaaagcagccttaactgaggttgttttagggtattgtgtcatccccagctggtactttgtattcaaaataaggaaattgcaaaacttcctacagcaagaggtactttgtaagtatttgaatataaagtgacttgtattttctgagagagaattttttttgaaaagtcttgccttatatttcatatattaaatgactcttctactgcagcttcaatgacatgaatcttaggcagcaaatctactttctgaaacattctgtctctgggagaggagggagatataggaagcagagaagtgatagtgcctggtatgaaagttggtgcctcatgagattggctttagatagaagctgtgaaagagaaagtgccaaatgcattagttgttgtttaccacttactgaatggaaactattctctgcttttattgattggatttctttttttttttctttttttatttttattttttttgagacagagtttcgctcttgtcgcccaggctggagtgcagtggtgcgatctccactcaccgtaacctccgcctcctgggttcaagcgattctcctgcctcaggctcccaagtacctgggattacaggcatgtgctaccacacccggctaatttttgtattttagtagaggtggggttttaccatgttgaccaggctggtctcaaactcctgacctcaaatgatccacccgcttccacctcccaaagtgctgggattacaggcgtgaggtaccatgcctggcctagtgattggatttctattgattaaatgaaaaactccatgaaataccttttaaacagagctgtccagaatgcaggcatttggttagctcttcatttatttattgccatggcacctaagtgttggggaccctagtacagttacttgatccctggcccctagagtctaacacaatctctccattactgaacaatacaaactaatatacatatagttatgtatcacttaacagtagaaatacattgtcagtaggaaatttccttgtcatgtgaacatcatagagtgtacttaacacaaatgtagatggcatagcctactacacacctaggctatatggtatagcttgttgctcctaggctacaggctacaaacctacacagtatgttactgtactaaatactgcaggcaattggaacacaatggtaaatatttttgtatctaaacatatgtaaatatagaaaaggtaaagtaaaaatatgttataaaagataaaaaatgatagacctatctagggaacttagcatgaatggagcttgtgggcctggaagttgctctgggtgagtgagtgaatgagtggtgaatgaatgtgaagccctaggatatgagtgtacactactgtagactttataaacactgtacacttgttactgagcagacattatgaaaaataaaaataaacacggtatgcttaagctacactaaatttattcatacgcttttttctttcaataataaattaaacctagcttactgtaaattatttacttcatgaacttaaaaaatttttttacagctttttgacccttttgtaataacagtttaaaacacaagcacattgtactgctgtacaaaaatattttctgtatatttttattctgtaagctgttttctactttaaattttttaactttctttttaccttttaaacttctttgttaaaaaccaagacacaaacgcacacattagcctggacctagacagggtcaggatcatcagtgtcactgccttccatctccacatttcatcccactggaaggccttcggggacagtgataggcatggagctgtcatctcctaggataacagtgcgttcttcaggaattcctcctgaaggacctgcctcaagctgttttatagttaattttttaaataagtagagttacactctaaaataataatatatagtatagtaaacatgtgaattagtaatgtagttgtttattatcattatcaagtgttatgtactgtacataattgtatgtgttatacttttataacactgacagtgcagtaggtttatttacaccagcatcaccacaggcatgtgagtaatgctttgtgctacaacatcatgaaagctgtgttactaggctgtagggatttttcagctccatcatagtcttaacgggactgccgtggaatatggggtacgttcttgaccaaaacatccttatgtggcacattactatattagtttatatcatatatgtgtgtatagtttataagttgatacatacttagtttatattatatattttaaagatatatgtgtatattatatatgtatatattttatatatatacatgtgtgcatataagtgtatgtatgtatatgtacgtatgtatgtatgtatgtatgtataaagcctgaccagcaaacttgaaaacattctgtacacagaaacacctagcctggggctgggtgcaatggctcatatctgtaatctctgcactttgggaggctgaggcacgcgaatctcctgaggttgagaccagcctggccaacttggtcaaaccctatctctactaaaaatacaaaaattagccaggcctggtggcaggcacctgtagtcccagctactcaggaggctgaggcaggagaatcgcttgaacctgagaggtggaggttgcagtgagctgagatcatgctattgcactccagcctgcatgacaagagcaaaactctgtctcaaaaaaaaaaaaaaaaagaaaaaagaaaagaaacaaccaagcctgggctgggcaccgtggctcatgcccgtgatcccagcactttgggaggctgaggcaggaggactgcttgaagccaggaatttgagaccagcctgtgcaacatggtgaggcccatctctattataagaaagaaagaaagacagagaggggagagaaagtaagaaagaaaagaaaagaaacatctagcctgtgccctgtcaggagcaggggtaaactcaactcttgggttccctttttgccatatcgtgagtgatcagttgcctcatgattagagaaggtgagagaggtactgttaggcttaacatttgttaggttatacattaaataatgggagagctggccttggaacctaacagttaggtataacattgtgttgatgggaaaacaaataaggtctaaaaaccaatgaactttgagaacacagcttctgcgtatgttgtggcctgcctatctaagtaggtgtaggggatgaggtatcacaaaactaagcactttgaaatccttttcctttatttttctaagaaatttatggttaacaaaagtataataatgtaattaagagccatttttctataactgagaattaacatttgctaacatctttttttttttttttttttttgcttctggttatttgtttaaaggaaaagcaattagaaatatagccaaagcctcctttaaccctatccccagttcagtgtgcctgccacccttcccagaagcagcccttatcataagttgtgtgtgcatccttccacttcacttttaatccttttatgcattcataaacaactggatttgtgtttttaaaaattcacataaattgtcacactgtcattttgccttttttcatttcacagtaaaaaaaaaaatagaaacagagtcttgcttgatcagttggagtcttgtcagatttctctgatggtcgtaattttggaaagacaatctccctttagaattgtgagagggtcctgaattctgctaagatgtaggtgtaaaggataaccagcgattattccggaggtcacaagatttagagctttctcaattactcctgtagataacatcccaattgcagaacctaagattggctgtttgagatgtcttttcagatttttgcatttctgactggctgactccacacagacaggtcctgtggccccacccacaggctgactcagtgccggaggaccatcttccttccacatccctatgatttcatccccaaccagtcaacattcccattccctaaccccctgcccaccaaactatccttgaaaaacctccaaacctttgggaaaattgatttgagtaataactctgtctccagtgtggtgttgccagctgcatgtcagttaaagtcattctttattgcaaggctgtggtcttagtgaattgattgtgtctgtgcagcaagctggaagaacccgttgggcggttacaaaatgagtaaatctcaaagaggtggcatagacttcaggtttaactacagtgttcaactgaaacaaagaaggatgttggggaggcccggaatggggaggtgaccgggaaaagcacagtaaacaaggataaggtttgttatgcaggtttaggcaggtgccttctccattggtaagagttcctagtggcttagagtcatccttgtctccctggtacagaaagagaggcaaatggagatttccttttatagatgtaattttcccttacaaatgaggtaacttctactctgttttcagagcttttcctttgtctgctgtttctcaaaataatcagctcaaagtaatccttatgccaaagaagcctatcgtgggaagacatattctggtctcctacagtcatgttttgaggtggcatattctggtctcctgcacattcaaaatgttaggttatttagagaatttttgtttgttaaacatttaaaaggtttgttatctttgtttatcctttactagttgagaagaaaagtacgttactgtttttaaattatgaatgaagaaagtactatttgaggtaaaactttgcgcatcaacctctgagctgaaatttagtgactattgccactactaaaaatcttgttttatcaaaccttcaacctaaattaacagacagaggctctctaaaagaacatgacacttatttgggaatagtgtattgcagtgggaatctttgtgccacagtaaactatgtgcatattcaaggaggtaaaggaagacaaaggtttttcaaggaataatgaggattatataattcttttaagataattattattggctacaaggatcagtaacaagtgtgaccagtctgagattggacaggcaattgctggacagatgtccttgtggagatattttttgtgtaaggttgtgatgacctttgtgcaggattgtggtttttgcagagtcatttgggatagtttttgttaatcaggcattgatgcatgagaaccctctcttcatagctgtccctggctttatttgtcaggatttttaaacacaagtgactccattttgattttgacagtgttcacaaatgttagcattgcatcagaatccactggaggacttgttaaaagaagttgggtggaccccaccagctaagtgaatctataggtctatactgagaatacctgagaatttacatttcaaacaagtttagcttagtttctggagaacctgtttcttgagtaagaggaatggtttctatgactcatagcagcattattcataatagccaaaaaatggaaacagccaaattgtccaccagctgataaactgctaaacgaaatgtgatagatctacacagtggaatattatttggtgaaataatatgaataaaaagaaaaggagtactggtacatgctacagcatagatgagctttgaaaacattatgtttgtgaaagaagccagccacaaaagaccacagcttttatgattccatttatatacaattccaaacaggtaaatttatagagatagaaagtaaattagtggaccaggcatggtggctcatgcctgtaatcccagcactttgggaggccaaggcttatggatcacttgaggtcaggagtttgagactaacctggccagcatggcgaaacccatctctactaaaaatacaaaaaattagccaggcatggtggtgggtgcctgtaatcccagctacttagcaggctgaggcaggagaatcgtttgaacctgggaggcagaggttgcaatgagccaagatcgcagcactgcactcaagcctgggcaacagagtgagactccatctcaaaaacaaagaaagtaaattagtggttagcagtggggagaatgataaactggatttgatgcttaagaggtggggggttacttttcaggggagtgaaatgttctaaaattgattgtgatggatgcacaaatctatgaatatgctagaagtcattgatttgtgcagtttaaatgagtgagttgaatggtatatgaattatatctcaataaagctgttaaaaaaatacaccagttcttagttctccatgggacctgttaagaaaaaaaagagaaatataccagaatatactagttcttaaaagaaaattattcattgttatgaacagctgacctgtaatacacagatagtcatcagaattcataacttgacttttcagatatgagttagttactaactgcattggaaaatcacttgttcattctgaagaaatgattaggaactccaaagagaaggacactatgttgggaaaattttaagcattttccaccttgtggtatgacatatttccatgtttttgtcaggtgtcttagcttagaaataaacctccatttttcttgcgttgtacttggctgctttcccgcaagaaagctgaagatgggacttctgattaaggagttcctggctgggagctttccttcctagacatctaagtgccagaatgccaaggggaagatgggttcatgcattagcctttgaatattattaagtcgtatggatttgaataggcttgtactggggtaaaggaagtgaattttcttcccacttgattttgtgtcattcagaattcattaactcacttagataaaacagtacagttggtcttccatatccgtgggttctgcatctgtggattcagccaaccacagatcaaaaatatttggaaaaaagattgtgtctgtactgaataagtacagacttattttcttgttattatgtcaatctaaaaggaagaagctcaggcaaagttaatgtaagtagagagtttatttgggccaagcttgaagattgcaacccaagagcatagattcaagttgccctgaatatacactctaattagcagcagttacaagtaggtttttaaaggacaagaatagttacccagggccaggtgaggtggctcacgcccgtaatcccagcactttgggaggctgagaccggcagatcacgaggtcaggagatcgagaccatcctggctaacatggtgaaaccccttctctactaaaaatagaaaaaattagctgggagtggtggcacactcctgtagtcccagctactcgggaggctgaggcagaagaatcacttgaacccaggaggtggaggttgcagtgagctgagatcgcaccactgccctccagcctggcagagccagactccgtctcaaaaaaaaaaaaaaaaaaaaaaaaaagaatagttacccaaaaagctggctgaaagaaaagcaaaagaaaagaagaggcgattcctaaattgtttaccaagactctacactaaaattacataaggtatacattattctttgtatcacaaattccaggaacatgaagataatggatgaggcagctagggaggaatgaaatgcctttaaacaactgcccccggacatgggtgttgggagcataaatgaagtcctatacttggtctctctgggcctgataaattttgcatacctcacataactcagactgctctgagctatttttcttttctcgattgcagttacattgtactaggaggtattataagtaatctagagatgatttaaaatacaggcgtgcactatataacaatcaacagactacatataccacagtggtctggaaagattatagtactgtattttcactctaccttttctgtgtttagatacttttagatatacaaaggcttactattgtgttacatttgcctacagtattcagtacagtaatatgctgtacaggtctgtggcccaggagcagtaggccacactatacagcctatgcgtgtggtaggctataccacccaggttggtgtgagtatactctgatgttcccaccatgatgaaatcacctaagaaggcgtctctcagaatgtatccctgtagttaagctactcgtgattatatgggagggttgtataggttttgtgtaaatactccagcattttatatcaaggacttgagcatccacagattttgatatcctgggagatcctggaaccaatcccgcatggatactgagggatgatggtatatcataggcaaatctttatttaatgatcttaccaatttcttatatatttttctatcccattcagcttatacgcatgactgagaaatgcagtctgtgtttcatttaggctggtgctttattttagctgcatgagtgtcaggaatggaaaaagaattatgattctgggacaactttcttattcctcccaagtcggattctcatggtgacgtcagtctgttttttgaagtattataaccttttaaacagatcatccttcaaattcatgttcaaaagcaaatatcaaagcgtattctaaaaccagatgtaaattaattttagattggctgccatcgtagatgattcatatcactgctcccctcatcatcacagataattctttcatgcttctcaaagggactaggagctctacctcaatgggtatttcggaaataaatgactcaattttgaagtttcccagggagatttttatgtatcttgaaatctcaaaaaaaaacatgtctcactacaaagattaggaatgccaaggaaggtgaacgccaatcctgttaaccagacgctccctcattactataccttgtatacaggagctctcccatgagaccacattgtgtccacaaccattgcctgatgcactcagcaagtcaatacaccaaggggttggctgggcgtggtggctcacgcctgtaatcccagcactttgggaggccgaggcaggtagatcacctgaggtcaggagttcgagaccagcctggccaacatggtgaaacctcatctctactaaaactacaaaaattagctgggcggggtggtgggcacctgtaatcctagctacttgggaggctgaggcaggagaatcacttgaacccaggaggtggaggttgcggtgagccgagatcatgccactacactccagcctggatgacagagactccgtctcaaaaaaataataataataaaataaaaaaaaagaaagaccggggttgcagcagagaaggaggtttagtcatagggtcacctgatgaggagatgggaagaatcctcaaatccctccttgaggaatttggggttagggcttttaagggttttggagtgggctgaagtgcggagtgaggagtttgttgattgattgaaaagtgtagggtgaagtcattgacagggagataaggaagctgtattctcaggcagatcctgttcctttgtgggggttttcaaactgattgctggacttcaaagtctgaaaaacatcttagatgatccttaaacaaaagtcttatgattctaatgtcagagatcctggctctgtaggaatgatgggatacaaatggtcagacgtttagcaaccaggaagtgggctgaagtgcagcctgattcatgcttaattataactgtatttctgtccagaacccagcacgcaatttttgtcaaccatgtggggcggttttagcattatggtgtggtcttcagaagagaaagatctgatttcttttgtgacctgactttctgagatccttcattttatgggactgtggagtcctgtgtgtgacgtaggaccagaatttgctatttgttttggtgtttcaacaattgatgttgttataaatctcccagatgattttaatattttaactgttcagttttacaataagaagcatgactgtaggcagaaactaattatgtatttgagagtggtgagttaatgaacatccaaacaacttcatagagcaggaagaatacatatttcaagtggaggggagaaaaaaaatcattttccctctacccttctaatttctgggttggaaccactataacaaaccaacagggtaacaaaagaaaaacaagcagaagtttgttaacatgtatgcttcatgtatacataggagatacccaggggaaaatgagtaattctgaaagaggtgatctagaactccagcttctaaagcattttcaactaaaaacagagaagattgtgggcgaagccagttatggggaggtgaacaggacaagtatggtaaataagagtaatgtttgttatgcagatttcagtaggtgccttctccattgataatagtttcctctgatttagtcatccttctcttttggtacggagagggaaacactctcacaagtggagatttcctttatagatgtcaatttccctcaaaaactggtatactctgttttcagagtttctcctgtagctgcagtttctcaaaataatccttatgctgttgaggcatattttggggtggcatatgctctcccacacaagcaagagacatctgtcttcatctgctcccagagtaactggtgccagggaaccaaacaccaaaactgccattagtttggatattatggatttggtttctggaaaagtccattgtgatgccagcatggtacaggggattccctctcgccttgtcctaagcctgtcatcctgcagaacccgtcttacagtactgtgaagttccagaccataccaaccaaccctcgccaataggcatttgtggcaataggaagaaaaagctgatggaggtctcatctgtatttgttttctctctcctatctcctgcatccttaccaggcaaaagtagaagaaaagatccaagaggtcttcagttcttacaagttcaaccaccttgtaccaaggtaagctgtggttaggagtttgaggggatctgggagaacaccaccatgcagcagcctttcttctttcctccttgagcgaatctaaccacggggagcatctgctgcaagaatggtgtttcttgtccttgtggttacctggatatgctaagacccccactcctccctctggtagaatactgtttagagcgattctccactcgagctgagctgccaggtgttacatggggattcccctcaatgcctcaattctgaggtctgaagatggagagaggaattccaggtttttgtttagtggtggcctgctgctctggtcttcagatgagaactctcaggtttttctttttctttctttttctttttttttttgagacagcgtttcgctcttgttgcccaggctggggtgcagtggcacaatctcggctctctggaaccttcgcctcataggttcaagtgattctcctgcctcagcctctcaagaagctgggattacaggcacccaccaccacactcggctaatttttgtatttttagtagagacagggtttcaccgtgttggccagtcttgtcttaaactcctgacttcaggtgatccacccgcctcagcctcccaaagtgctgggattacaggcgtgagccactgtgcccggcccagatttttctttttcatattgtactttgaaacatttagagtccagggagatggcaagggatggattattatttgactggaaaaacatgggaagtttgagtttctccatgcctactccctgttggtaattgtgttccatatcccaaggatgaaatttcaaacaagaaatagaatgccttttgttttccttggagcttagcaagttgaagtcttctaagtcctgtgaggtcaggtattttgaaaagggaattataggaaaaaatttattatttaatttgaacctttattttctcttccagtgttttgtaatatgtcacactagaatttcataaggttatttcattcttgtattagtacttctcatgcagtcagagtctttttttgaaaccattatttgttatatttccagccatcagaattgatcagtagcctaaaactgtgtggtcaccattttatcttaatgatggaacactttctcttcctttcttttctttctttctttctttctttctttctttctttctttctttctttctttctttctttctttctttctctctctctctctctttctctttctttctctcctctctctttctctctccctctctctttctgtctctgtctttctcactttctttcctttctgtctgtcttgtcttgtcctgtcctgtccggtcctgccctgccctgccctgtcttgccctgtcttgctctgttgcccaggctggagtgcagtgccctgatcatagcccacagcagccttgaattcctgcgaatcctttcagtgcagcctccgcagtagctgggactatgggaacacatcactatgcctagcttattttatttttgtttttattttttgtagagatgggggtctcactgtgttgctcaggcttgtcttgagctcctggcctcaagcagtcctcccaaagtgctgagattacagctgtgagccatggcacctggccgagagaacacttttccttgacatctctgaacaaagtgtggttaggtcactggctgattcactctggctgggaagttgcaggtctgaagttcagcctttcctccttcatcatgtctcttgacttcttgagatcttctaacagactaaatcctagcaagtcagtctctaggtacttctgcttactggaacattataaataggtccagctttgtttgttacctttgtgtctttttttttttttttttgccaccatttccttaagaaactttttctgattagccatggcagaaaacagttggaaaaggcaagtgttcataaggaaagacaggtgggagggttaacttcatctttgttccctggggaaggaaaggaggaaaaatatcagcttactagtatagtctttcccttaactgctaaaccaaatctctgcattaacccaatgctctgacctcaataaaatgaattattcctcttgtcatgagatacagctagagattagcaaatgacgccatttatttaaatagcttgggagaacgagctctcttaaatataatggtatccttggcagttcgctgcccctaggcacaagctggttcaagcttagcctccccagaggggacaagacttcataatggtgagggtgtgggtgattgcttttggaggggctttgttgttgtggttgtacccccgatgactcacccgatcgggctgagtcactgtccactgcctgggctctggggacacacagcctctgtttctcacatgaacctttgattatttgacattcccttttcacttaccatcaggatagagcccttggtctctttcattccttttttaaaatttgtttttccttagctcatgagctgaagaaagacttttattcacactgagatatgagggaaaatgggaggttatagtctgggaggaagcagttgttttttgagagtggtggtagatgatattaaaggagtgaaatcccctgattcatagctggtaggtcaagtatgggtgggaaaaaaaaagtgttcctcctgggctcggatccttgtggaaatagaatatatcagggctctgggttagtttcaggaatttcacaattacccgtttttatcattgttgcctatgaaattgagtgttttaaaggatgctaattaatattggagatactatacattttggctgaatggctgagtatataattcaacatatcaatataaggctgaagccaaacatcaccatcatagaataagcgaggatataagaataaattagaaaatttatcagaattttaaatcattatcacagtctcaatatttaacatattaatagtcaaaatttaaaagtctgacactttaatacaggaagtaaccttcactgttagctgaagtgcatggttagctgttagcagtaaatctagatggcagggcttgtttgtgtgtctgaggtcatgatgctgatcaaatgggacagactcacacacatgcccaggaccacagaccacgcacaggtccagggatgcctgtgatgatgctgaagtaggcatttgcctattcagtgttccagggccaaagctgaatagcagactgggctgaaagtcaagcctggagctgaatgtcagtacattctatacttaatccccttcccagaaatgattttcttctctaaggttgggactgtctacctggagtgaggtagtcagtcccaaggagctttttgaccatgcttttcatggttttgtttattcatgtctgctttcccatgaaaattcattttttcttccctgtgggtattgtcacggtttcacacccttttgaatgtacccttttgcatttatcaccttggctttaataagaaacctgaaatgcataaactacacagatacctcgctcacatgtagtttttaaatttgttttctcctgggcaaggagacgggtgctcctcagaagtgagaaatattgataatgtccctgtgctaatagagccctggaggttaagtgctgacaatggctctgaagccagaatactctgagttaaagtcctcaaagcaggtctctcacaggcaccagcttagctcccgtgttttctactattcctgtatgtgatacaattttagaatttcccagatcctgagcaggtagaggatgtattcccttcttactgttgttctttccaaggtctcacaaataagttcacctttcctcgattgctttattgcttacatgccaggtgcttattttttgactagagaggcccctggctttagtgagtttagaaagtccccaggaaccagcaatggactgaatcccctgtcctctcatctgtcacaatcaaatgcatgttttccaggatggcccaggtttcgggggaggaagtggctttgctctcattccattctgctgcctttgtgtgatcctctctttcagcagcagtatctagagagtctccaaaggacaggacactctgctgggctcagggaagccagagtgagcaaggctagccctgggcctgcccctgctgggctcttggtctagtgggggaggtggacattaaacaaatgaacacaaatatacagttaccgatgggataatttgagagagagaatcactgggagaatctaatttggattgggaagttagggaaggcttcttacagaaagtgacatttaagctgaatctgtaggtggaataggggtggctaacttaaaggatggggagagtgttccaggcagagggaacagcatgtgctaaagccaggagactgaaaggagcggagctcaaagaaggcagcatgaccagagctcaggggcggagatgaggttggagagtagtgtgggtggaggcacattgtgaagagtctggaagcccagtgggctcacccctcataagaaattctatttaaatcattacccagtacacatagatgtgtaagttccttctcagacagtggaaacctgacttcccatagccttaatagatttacccacttgctctcctgtcaccctctgcacagtgagacgggggccctcctcatccacttgagctgacagcctgcatcccaccctgcaccccctcaagtcctgcacgaaacctgtcttattctgctccatgtaattgaatggttttggggctgaattgttcaggtaaaaataggaagagctctaccttttctttcttaacttcctacacagaaaagatttttggatagaggtgagttgagaatgaaggaccggtgagggtattagtcagcttgggctgccataagacggtatcacagatggggtgcattaaaccacagagatttattttttcacatttctggaggccagaagtctaagaccaaggtgtcagcaggcttggtttctcctgaggctgctgactggcttcaccaacatgttatatttcttaatttcactggcgcttcactaactgccttataatccttttattcgtctcatgtagattccctaacacacccaccaccgtggccactccacagctctcccaccatcttgactcctagttcctgagaaaatcgaggctgacccacctgactttcctgtttccttcttcccacatcagagacctatatttcgctagcttcgtacccatcatttctcgctcaaagaatgcagcatccttccttattccaggctcacctctcctactataccctcatcccagccctcctccatcctctttacagaccttccctatggatttcctctgagcttttgcatttctaatgtggaatttctctgcttactgccttgtacttttgatccagctgaactaaactaactcaaatgtgtcatggtgttttcttcattttgcctgcttaactcatgtctttccagccttaaactcaatgctcttccctttgggaagagttttctgaccctccatctcttcccgtggctgatcacagcgtttattggacagggctctgcttgtcattttcacatgtgtgtccacctctggactgtcgctctagggtacagagcagcctctaccccagtgctggacaacactctgcccacacagatgggtgctccctgcgtcctgagtggactttcctgaaagagaaactgagtctggccttctcttgtttacaatttgccttcacctctgctctgaatgctcttggaggtctctagcccttctgtggtttgttgtcttttcccctcagtcttgctgcagcatctgccactgttaaacaccttcctgaaattctctcctccctgatggcctgtgacatgacacttcctttgctcttccctagcatatgtaaactctcctgtttctctccttcactggctcctccaaacccttagagatgggtcttcccacagttttgtttccaaacttctctctctgccctctcaccttctgtggcttcacctgtcacttgtgtgcagacaaatgcttcgtagtctgtgtgtgtaacctgaatccctctcctgagcctcacgtgtgtgtccagcagcctgattgacatcatcacctgaatgcagtcccagcatcctaagacccacacatccaaaagtcagctgatcacgggtcacacactagttcgggccctaagtagccccaactgggtcagctcctcagagcttctaaccctgtctccccaccccatctgtctgcccactgcgatattttcagatacttcagtttgtaaacacatactgactacctactgtttctccaaagcacagttctgatcatttctttcctcatctcaaaaaccttcaggacttccctttgcctagtaaattgagtagaaatgccttagtcagcatcccagatccttgtttttttgtttgtttgtttgtttttaaactggggcagtactcctgctttcctcccattcctctttcatccctgtattgaggtcagattctcccacctgtcactcctcttgtacacttgatacctgtgcagcatagtagagtagccattagccacctgcagctatttaaacttgaattaaaattgaattaaaattttctccttctgccagggccactcatcgcacattcctcctttttcacacaaactttcctgatcattcctttcttcatgagatatcccctcccttttgagcctcagtagtatgtttttcccttgcaaaacctacccattctttccttgtagccattgatatacttacctcatttctgaattggaagagtttttgaggtaaagactacatgaagggctgggtgcggtggctcacgcctgtaatcccagcattttgggaggccaaggcaggggattacctgaggtcaggagttcaagaccagcctgggcaacatggtgaaacccccgtctccactaaaaatacaaaaattagctgggtgtggtggcacgtgcctgtaatcccagctactcaggtggctgaggcaggagaatagcttgaacccaagaggtggaggttgcagtaagctgaaatcacaccactgcactccagcctgggtgacagagcgagactccgtctcaggaaaaaaaaaaaaaaaaaaaaagactgcatgaaggctcttactctgagccaagtacagtgggaatttgataaacaattgtggaattgactacctagcaaagggaatggttctctttcctttgtttctgtaatctgcaagcacggggaacatcttgacaatctgtgctttttgtttccttccctagtcacacaggctcttctgccagaccaagaaagaagtgcagcctctgtgctttgcccggcctgtgcaggtggccatgggcggcacattccatcttaaagccagtattgctgacttgaaagccaaggacagcgactggctgcagaacacggtcctctggccagggctgtgggtcacacgtgggaggtggaatttcagggagagaataatagttggataaccgagaggcaggcagggagtaaattatgggccttggagaagtcatcccagacggggtgactgaaatgacagcggctgaggcagggaagtggcgaggctcagatttaaattgcttataggatggggaggcacaaagatatctgttcttagatgctggaggaagtttctgggtggactgtcattgcctggctgcgtgtgctcattgcggcttttccgttagcccaaagtcactgcctttaggagacaatcgcactctaaatgtcagctggcatggttttcagatgctttagagacattcagacaagagcttcttttctctggtttagttgctctttggaaccagagaagttgctggttatccagtcagtgattgcagggggacgtcctgaagctgagtgtttacccgtgtgtgtgtacgtgcacatacgtgtgtatggtggaagcataagctattagaatgggcttataaactgtttgtctttccaggcttgttttgcagagggagaagcacttccattatctgaaaagaggccttcgacaactgacagatgcctatgaggtaaacacattacccaggaactcttgctgtcaaattatccaccaaatcctcctcctttttctatttaaacgtaaaagactgttggggctgacctgttgcagagtcactctttgttctctgtggctctggcaggaggtagggtgctgtcacagagctgggactcagccctgaaagggcagaacctagtctcttccagagtgagtggagcaccctagataggatggggctttcttctgttactagatgatgactaaggggttcacgtgctttatctagacctccttgacagctggctaaatgccagttacctgttcacccttaaccctttgccctataagctgatctaatttctcgctcatttattgaggactattgtccaaacctgttaagtctgtatcgtgatggttacaaattttccaacttcaccactccttctagtaagtacattacttttcatatcttcattaaagagacaaaaaaccctttcttgtaataagatctaatttctatactgactagaggaccagtatagagagtggtccttgcaatttaacattactgtttaagagtagatctttaatatttcccagagcaacgtcaggactgggtgacggtggaggggacagatgttggatgggactgagcggcaggcaaagggtgaatgtgaacaggaagtctccagtctttctgccctgcttaacacagagcagcatctctatttttaatctgctttttatttgggttccacatttgattatttgtggcaatgatttgccaactcaaatgcctgtagggcccaggcaggcagcataaatcagtgaagtgggctgcatggagactgaggctaactggagaccctgtgcccttaacttctttcctgcccattactgccatctgggaatgcagacccagggttgccaaatcatctttgtttccttttttttttttcttcctccaaatgaagccggaaatcacgttttcatgtgactctcctgacaaatgttgcagctactaccagttaaacaatacacatccatgggctagatttggcctgtgggctatgaattttcaatccttgactcaagtcctcaatagttatgttacagttggtaccatatcagctaacaatttattgaacagtgtgctgaaagcttaccatgcattctctcataatttatgagatggagtctcgctgtatttcccaggctggagtgcagtggcatgatcgtgagtcactgcaacctccgcctcaggttcaagcgattctcttgcctcagccttctgagtggccaggattacaggtgtgcaccatcacgcctggctaatttttgtatttttagtagagacagggtttcaccatattggccaggctggtctcgagctcctgacctcaagtgatccacctgcctcagcctcctgaggctctggggttacaggcgtgagctactgcgcccagttgcattctcttatttaaatcttgtaactacgtgaggtagatcaatctcttgttttttgcagataatgaaatgggcatagtaaaattaagtcatttgctcaaaggcacatagcgagtaagatgaggagctgggattcaaacttaagctgcatccctggcagtgtcttcagtagctcaccagcctaccttccaggtggtgggttagccacagcttgggatatcagcatagttttgaagagagcagcttgggccaacggaaagaacactggattgactctaaaaacctaggttcttgtctcacctctgacatttgctatttttataatctgaaaaaggttaatctttggacctcatttatatattttaatttataaaactggggcagtactcctacctaccctgcctagccttgaatgctcaataatcatttatggtttaattaggatcaagagccgtctgcattttgcctttggaagcctttcctagctccccaggcagaattagtcagtctcttccacgtgctccctcaaaactctgttttcgtccattacagcatttctccaggtatatgtacacgtgttggttccagaaagacatgaggtaacttatatgtctgtccagtgctctcttcccctacaggtaaccacatacattctatatcccaagcatctcaagaacagaaaccagttcaggcatggtggctaatgcctgtaatctcagcactttgggaggctcaggcaggtgaattgcttcagcccaggagttcaagaccagcctgggcaacatagtgggatgctgtctctataaaaacttaaaaaattagccaggcatagtggtgtgtgcccgtagtcccagctacttaggaggctgaggtgggaggattgcttgagcccgggaggttgaggctgcagtgagctgagatcataccactgcactctagcctgggtgacagagcgagaccctgtctcaaaaaaataaacggtagaaaccaaattttattatcatccccccagtgtctaatacagtgcttggcacaagtagatactatcaaatatttgttgaatcagtgattgagttaagctaggaaatctcttcagagaatgtatatctccttggttctataccgagaaaatagcagcccctaacctcctggcctgtaggaagtcctctgctcagccttccttagatgcctgccagggagggatccactgggttcagggtcatcttttttttaatcctgttgtcttttttttcttttctttcttttttttttttgagacggagtcttgctctgtcgcctaggctggagtgcagtggtgccatctcggctcactgcaacctctgcctcccgggttcaagtgattctcctgcttcggcctcccaagtcgctgggattacaggcgcacatcactatgcccagctaatttttgtaattttaatagagacagggtttcgccatgttggccaggctggtcttgaactcctgaccttaaatgatccacccaccttggcctcccaaagtgctgggattacaggcatgaaccaccgcgcccagccttgttatcttttttttttttttttttttttttaacagatggtcatttcagctcctggctaaggccacaaagcaaagtgtcctttattcactgattgttgtttgagcaagggtgccctcctcccccttgccaggctgctgggagtgagacagatacagccttggcagcagtgtcttggagtgattgtgaataagggatgttttctctcctgtctctctcccagtgtctggatgccagccgcccatggctctgctattggatcctgcacagcttggaactgctagatgaacccatcccccagatagtggctacagagtgagtctgtctttgggaaatctggggtgttctctgaaattgtattttgagtttgggattttgttttgtttctgttttgtttgtttggaatggaaaaaaacagtgccacaaagaaatctttgctcttctcatgacctccggcaacttcctgaaactcctccactttagaaaactaatgtaagctggtgggtagaacaagactttgaacttccaagagaaggattctggtttcttctgtggccttttcttttggctcttgactctggtctttgagaaaagtcttaatcatcaactctgagagacaagattttgccagaaagtacagtatgcatttgaacagcttctgtggggaagcacgtgccagtccagtgaacaaaaatgcctttgcctttcctacgcacctctatagaagtacctccccgctcccggtgcttggagcgaccatgtagctcttgatgggactggatgtgttactggtgtggcatacaaatgccatgactctcagttttcctaaacctgatcgatgattagagatctaagcaactgagcttcttcccaagatccttgtacagatggcattcgtgatctggcatctcattcccagacactcatcaccatttatatattaaagaagaaaagactgatcatgactccagtcctagggatacctggaataagaaagggcagccaggaattggatccaagagatccactgagaggcagcatgggctctaggcagcatctcgaatttctcagcttcctctggtgctcttgaggtcgaagcatctgggatgagagacttctgagccaggtttgtttctccacagcacaaggaggcagctgtgctgggacacacagaggcctagccggggcccctctctggtcacagagcccctgcctcagtcacattgtcaggtcagaggaacagaactgcacattgtctcattcattctgtcttaacaataacctctcattcttgccttcctgggcagggtgtcttgtgatgaatgtggatggggaagataataaagaattaggccattaacccttgtggtacgtaggatgctttctgagggagaggcaagtgcattgttttgatcatcgggatgccactgcaagcctggctgcttccagcactggaaggagagttggacacagtttctgcagtaacaggaatttaattgtcaaagaaaggcccacgtggttttttttttttttttttttgagacagagtttcactctgtcacccaggctggggtgcagtggcacagtctcagctcactgctgcctctgcttcccgggttcaagcgattctcctgcctcagcctcctgagtagctgggattacaggcacccaccaccgtgcccggctaatttttgtatttttagtagaggtaggctttcaccatattgaccaggctggtcttgaactcctgacctcagctgatctacccgcctcggcctcccaaagtgctgggataacaggtgtgagccaccacatccagcctcgtgtgtttttgaaataccagctcgggggcctggggattgtttgggaagttttcccttcactcctacacaatcaggatatttggaaagttttcccttcactcttgcacaatgggaaagttgggtgtgagagaagaaagaaaaaatggggatttctgtgagcctggatctgaacgctggatggaggaggccgcagacccatgaaaaactggaagagagaatcacagggggtgcctgaggtggaagaactcgagccaaaatcgactgagtttttttctaggctgtgtacttggtgttttatagtgaaggcttttctgaggaagtgtcagcgccgcttctggggcaatgtcacataggaagagaggagcctttaaagggcctttcattggaagcaatctaaattaaatatcaacagtagagaatgtttaaaaaaaattttttttaaatgtaaagctgggtgtggtggctcacgcctgtaatcccaagcactttgggaggttgaggtgggtggatcgcttgaggtcaggagtttgagaccagcctggccaacatggtgaaaccccatctctactaaaatacaaaaattagctgggcatggtggtgcatgcctgtcatcccagctactcgggaggctgaggcaggagaatcgcttgaacctaggaggcggaggttgcagtgagtcgagattgcgcctttgcactccagtccgggcaacagagtgacactccatctcaaaaaaataaataaataaaatacataaatttaaaaaataaaacataagtcatttatggtgcagtacattctgtgaaatactatataaccattaaaaaatgtataaatgtggccacgcatgatcacacctgtaaccccagcactttgggaggccacggtcagaggaccactggggcccaggaattcaagaccagtctgggcgacatagtgagactccatttcaaaaataaaaataaaaatagctgggcgtggtggtgcacacttctagttctagctgctcaggaggccgagacaggagttcaggggtttgaggctgcagtgagccatgatggcaccactgcattccagcctgggcaacagagcaagaccctgtctcaataaatatatgaatgtgtatatttgtatgttaaaatatatgtatttatatagagagatgtgaaatgaaaatagtttaaaagatttaatttacatacattaaaaatatagatgatgatatgcatagatagaaccagaaagatacatgtagtagttatttctggacgatggggttaaaagtgattttataaactttctgggctgggcacggtgtctcacacctgtaatcccagggcttggggaggccaaggtcggcagatcacctgagatcaagagttcgagaccagcctggccaacatggggaaatcttgtctctactaaaaatataaaaattagcctggcttggtggtgtatgcctgtaatcccagctactcgggagactaaggcaggagaattgcttgaatctgggaggtggacgttgcgacgagccaagatcatgccactctactccagcctggaggacagagtgagactctgtcttaaaaaaaaaaaaaaaaaaaggccaggcgcggtggctcacacctgtaatcccagcactttgggagaacgaagtgggtggatcacctgaggtcgggagtttgagaccagcctggccaacatggagaaaccccgtctctactaaaaatacaaaattagccaagcgtggtggcgcatgcctgtaatcctactcaggaggctgtttgtttgttttttgagacaagagtctccttctgttactgcactcccggctcctactcaggaggctgaggcaggagactcgcttgaacccgggaggcggaggttgcggtgagccaagattgcaccactgcactccagcctgggcaacaagagtgaaactccatctcaaaaaaagaaaaagaaaaagaagaactttctggctggatgtagtggctcatggctgtaatcccaggactttgagaggctgagacaggcggattacttgaggtcaggagttcgagaccagtctggccaacatggtgaaaccctgtctctactaaaaatacaaaaaatagccagatgtggtggctggcacctgtaatcccagctactcgggagactgaagcaggagaattgcttgaatccgggaggcagaggttgcagtgagccgagatcacaccactgcactccagcctgggtaacagaaggagactgttgtctcaaaaaacaaacaaacaaaacattttttttaagcttacttgcattttctgaagtttctacaatgatcttttattattttgtaattaaaaaaggaatggtttaaaaataagctgatttgtccttatttcaaaaaccacttgacagttaatgagagtttctgcttcacagatgccttaaaagctttacctgtggttcttctacgcattgatttagtgaacttttaaacatttcttagacttcccaataatgtattttgctttgtgcctaggaggtggttacttctaggtgcagaaaacacttgttatgaacaaagcctactggctctgacccataaggaaatagattatttttagtaagatacagataaatcttaaggacttctatataaatagaagattttttttagactagctgaaatagaatattgcctttttatttatcttgcacagggaaatgaaatgctttgaaatgcgttcagttttctttcttcatacaaatatattaaggtgacctagagtcaaaaagtctagctctgcagttttattattttcctgccttcttttcccctgcatgtaacacacacgccccctacacttacacaaaggtttctctttcctattttgttcactgctgtgcttctatttgtttagggaacaatatgataagctgggttccctctagtggacaaaatacttttgtcagctgctatgaccgctgaccaaagccagcaaggcgaggttgttactgctggtatcagaggtttcaagaataatgtattcatagcctggaatgttttctttatttttggtagagacagtgccttgctgtgttgcctgggctggtctcaatctcctgggctcaattgatcctcctgccttagcctcccaaaacactgggattataggcgtgagccaccatgcccagtccataggtaggacttcagcttgcctcttttttttttgagagtctcgctctgttgcccagactggagtgcagtggcacgatcttggctcactgcaacctccacctcctgggttcaagcaattctcctgcctcggcctcccgagtagctgggactacaggcatacaggcgggagccaccacacccggctaatttttgtatttttagtagagattgggttttaccatgttggccaagttggtctcgaactcctgacctcaggtgatccacctgcctcagcctcccaaagtgctgggattacaggcatgagccaccgcgcccggccttttttttttttttttttgagacggagttttgctcttgttgccaggctgtagtgcagtggcatgatctcagctcactgcaacctccacctcccgggttcaagtgattctcctgcctcagcttcccaagtagctaggattacaggggtgtgccaccacgcccagctaatttttgtattttgtaaagacaggctttcaacatgttggccaggctggtcttgaactcctgacctcaggtgatacacccgtcttggcttcccaaagtgttgggattacagatgtgagccaccgcacccggcctagcttccctcttttaagaggttatatgcacacatttatatgtgtttacctaaaatgaattaatattttggaactagactaagtacatttgctttgcttaatggttttggcactgaaggaagcatcctctaatgagaatcccattctttgttactgaaagcagcttcagtgaaacagagcaaaataaaattcacagggagaccatcgcactgttaaagttatgtttttagcttctgtaagatttaaaaattgcctttaacttaaaaaccattttaggacatttcagcttgtaagatttttccaaagataaattcaaattttgctatttcagtgttttatcctttccctttcaaaaggttgttagtagcttatccccggaatagccccttaaatatttttccttttaatttttaagtctagtttgtatgtttccttacctttcagtgaggacaccatatctaggcctttgtctcctgggcatttttcctggccaggtgctgttggcacctggtgggtgcaggtcagaggtgctgctaaatatcctctacaggacggtccctgcaccaaagaattactgagccccagtgtcaacagttgagaaactctgctctaaagtagccaacttttttttcctttgaggcagtcttgctgtgtcccccaggctggagggcactggtgcaatctcagctcactgcaacttccaccttccgggttcaagcgattctcgtgcttcagcctcccaagcagctgggactacgggcgcatgccactatgcctggctaatttttgtatttttagtagagatggggtttcaccatgttggccaggctggtctcaaactcctggccttaagtgatccgcccacgtcggcctcccaaagtgctaggattataggcgtgagccactgcgcccggcctatagtagccaactttcgacctgaccattcttccagaacagcagccatccagagacttgccggtgcttgatgaagagtcaaataacacgtctgactctgtgagcagcagaggccacccggaatcaacaagagatgctgcccgtcttcacctgtccattgtcatattctacctagggaaggagatttcctcttcactatatcaagctgaagctgttttagttagtacgagaacaagcttgatgtgatgccagctcatgcatcttgcatttacatcccctcctaagccgttctgcccatggatgactgttcctatttccaaagctgtaatctttttttctgtttttttttttttaaacctgcccaattgtgcagaacatagctataatttttataacttatcctaggccttaagtctgtctatgatagcctagtctagtgctgaagttttttatgtaacctaaatacttcttgctacaaattagtctcagtttttacctactagaatgtttatgtaattatcctttgtatatttgaggtattttgctgggtagctttctcactgtgattgtctgtaatattaagctttttatattattttaaaaatagagataaggtctcgctgtattgcctaagctggtctcaaactcttggccttaagtgatcctcctgccttggcctcccaaagtctagggattacaggcacgagccaccacacccagccaaatacttaaaaaaaaaaaaagtagtcatttttacaactctcatgtgaattccctttgaggtggaaaatggaggctagagccagatacagttctgactaatactgcatttatgatgcttttaacaagcatttttattgttgttcttcacaactcgtggacccttattactggtcttttcctgctatgttcctagtcatttcccatattcatgtgccttacccatcccccacccctgccatctctaagcgtaattcttgctatttgtacctgttgcatttgttttattcttattggtttctgatttgttttgctgctcattttgtattatatgcttatttactgtacatgcctttgaatccttcatccaaactgatgacggtgtttagaatcaacattgattaattgattgagacagggtctcactctattgtctgggctggaatgcagtggcacaatcacagctcactgcaacctggacttccccaagctcaagtgatcctcccacctcagcctcctgagtagctggggctagaggtgggtgccaacgtgcctggttaatttttataattcttgtagagatggggttttgccatgttgcccaggctggccttgaactcctgagctcaagtgatccccctcacctcagccaaagtgctgggattacaggcatgagccaccacgcctggccagaatcaatcactttagatcagtcctcagccatcacctaagagtcccaagtaaactccttataaggctgagaggcaatcgctgatatccctgctttgaacttgaccctcttacaagatttacatactctttaatgatggaatgataaaagtggtggtgtccagcagaactttctgtgataatgaaaatgttctatattctgtaaatgtctataggtgtctataaacatctatacgtgttctatattggccactagccacagttagttgtggagtacttgaaatgtgtcttgtgtgactgaagagctgaattttctattttaattaattgagaatttaaattgcctcatgtggctagtggctgcctattggacagcacagatgtatctcattgctactcaaaatgtggtccccagaccaggagcattgctatcacctgggaacttattagaaatgaggactctcagccgggcatggtggctcacgcctgtaatcctagcactttgggaggccaaggcgggcggattgtctgagctcgggagttcgagaccagcctgggcaacacagtgaaaccctgactctactaaaaaatacaaaaattagctgggcgtggcggcatgcacctgtagtcccagctactcgggaggctgagggaggagaatcacttgaacccaggaggcagagcttgcagtgagctgagatcgctcaactgcactccagcctgggcgacagagggacactccatctcctaaaaaaaaaaaaaaagaggactctcagacccatctagttctactgaattagagctgcagtttagcaagatccacaggtaatttctatgcaactcaagtttgagaagcactgatacctggctgaacattggaatcacgtggggagtttaaaaaaaatactgccacctgggtcccacccatagtgattccggtttaattggaattaggtgtggcttgggtgttgggatttttttaaaacaccccccaagtaattttagttgtgcagcaaggactagtgatggctcaagctttgcatgtatctgaatcacctgagaatttggtaaaaatacaaaggcccaggatcttttccacctcagcaggactgggtctctgtattcttttattagctttctacagattctgatgcacacattttgggtttgaagatccatgatatagaagatagtttcccactttgctggtaattggcacgtaagctagaatgaaatgccttgctgacgttaaagaaaattgatgtattgcagctttcagtcatattctaaaggaatgattttgtgaatacttgtttttcacaaaatgtgccacttggtgtttgtacaatgttttttgcttgtaattttttatttattggtgaacttcttgtctctatgataagtttttctccccctacatttgtgggaaaaaaaaatatttttttgtagagctggggtctcactgtgttgcccaggctggtcttgaactactggcttcaagcaatcctcctgccttggcctcccaaagtactggaattacaggcacaagccactatgcctggctccttttttttgtttgtttgttttttttaaatatgtagaagtatcattaacattttggtcttcagaattgctaagaagtctgtgaatgacagctggtagttcatagtcaacttgccaattccttaaggtgcaagttggaaagccttgggatcagaatgttctgtaatacggaagtgtctgagatcaagagaagcccaacctccagttctctagcacagccccagacagtcagatgcagcatgtcagctgagggaggttggcatggagggatggtatcaaggtgtgtctggtacattcagatcctaactaattcgaggctttagggtcagtagtgttgcgttcggcacgattctatcttaggagctgggaaagggagtggataaccaggtgactctttttctttcttttaaaaaatgtgctgttaagttttgtatcagctaaaactttttgtggtacagaaaccttttggtatgctagtgcagccagcctttgttagggcatgagcttattaactatttgtttctgggaaatgtcataagaattgatgacgatttggaaagaaggaacaaattcaagttctctacagaaattaattgctgttaaaaatgtgtcacatgctgggcatgatggctcacacctgtgacctcagcactttgggagtccgaggtgggaggattgcttgagcccaggagttcaagactagcctgggcaacatggcgaaaccccatctttataaaaaatacaaaaactagccaggcgtggtggctcatgcctgtaattctagctacttgggaggctgaggtgggaggatagcttgagtctggggaggttgaggctgcagtgagccgtgattatgccgctgtcctgcagcctggccgacagagtaagaccctctctcaaaatcaaaaacaaaaaccatagtgccacataattgttttcaacttcagtttcaatccttgtgttttctacagtaaaattgtaggtgcaaaaagaagtatgtgttgttttaacctgtgacgtttcagaactcacagagcaaggcagcagcgtttgcttttgctttctctgcccggataatgggaactctgaaatcgaaagcaattaaatgtgatgttggcaaacagttataaacttgtgtcttcttggagagtaggctatgtagtctttctggcagcagtagcaaggaaataatgaggtgaaagcgcccaggaaagaaggccccatgaacactgcaaagacagtttgcttgttgtaaatggaggtttctcctggcgggaaggctgtgaccctgctgagctgtggagaaacagcttgataaccagggctttcctggggcaccctttctggtgcacttcggaagaccccggactgatgatagggctctcttgatttcacctaaagcaagactgtaacctctgggcagcctgatgccaggcttggaggcaaaccctcagaaaacagctcccctcagtgagggaatgggagcctgtttgaattaacgtggagaattctccaagaacccgcagactgggaggcattctcacggcgagtcagtgcagctcctcttatgtttaccgcaattaaggtgagcatgagagcagcctgcctctcttctgttctcccagccatggaagcaggctccattaaaaatgtgtttttcagccggatgcagtggctcacacctgtaatcccagcacttgcagaggctgcggcgggtggatcacttgaggtcaggtagttcaagaccagcctggccagcatggtgaaaccttgtctgtactgaaaatacaaaaaattggctgggcgtgatggtgcacgcctgtaatcccagctacttggaagggtgaggcaaaagaatctcttgaacctgggagacggatgctgcaatgagctgagatcacaccactgcactgcagcctgggcgaccgagggcaaccccgcctcaaaaaaaaaaacaaaaaaacaaaacttgcttcttactggtggagtagaaatcagtggcccacagaggcttaggtggcaatgggagtgagaagacctctatttacatgttcatgataggcctaggtgatggatcctgactaggatggttagtgtggaaagaagcagttgagcaccatgttttggcaaaattcaaaggctgggaggttcccaaaggcaaggaggaggaggctggtaccacaggtccagggcagcaagttgagtggaaagtctgggaaaggtttgtgtgggaagcacgggagactcttaccccatagctacgaaagtcggtttcttcccagccttgtgttccctgcttcatgaccaacaagcgcttaagtacgaaactcagaggagggcagacagaaatgatgatagctggagagagaattaagccctttggggagaggttatattcaacaagtgggaggagaggttcccctcaacttttgagggagtgggggatcattggaaaggcctggaatctagtgggaatttggtgttttgacatgaatgctctctgactttgtttttgccctttggctgtgtacctagtgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacaggtacagtgaaagccagcagtgacagaaacctagaggagttccccgcctgctgacacgcactgactgttgcctctcctacctctttccctgtttctcagagagaagcttcttcagtatttgtactccctgaagcaacctgacggctcctttctcatgcatgtcggaggtgaggtggatgtgaggtgagtggggttttgcacaggctgccacatcagttgactctagagctcatctgccattagagatgccaagcctaaggaacatcatggggaagctgctgctttgtcccagaatgacacatgggatgacatgtcagtgacacgtcagaatcattcagatgtgatgcagatgtcctcaggtgtcatgatcacttgacttattttatgtaaatgtgaaaatataagaaacaaatgcttttgttttagaaattaaaaatacatttgtttggtacaaaatgatataccacaatataaataactgtatggtgtaatgtattccttcacctctctgagataggaagggaggggaaagtccagcagggcctcagtaaataccttctgagtgaatttgatgaaatcatgagaatgtctaatccctgaggtcctcctgaggcacatgagagtttttctgggaggtgcagagagccttgtgggccgggagagtgcagtgcaataaaatcgcattaactgattggtgccagttagctcgaaattattattttcttccataagtgtctgatgtaccaagcaagttgcttcctcacctggcagattacttatgaggcatacagggaattcattgaataagccatttctctaagacagtggcttattgagattttatgccattttcttattatttagttgagaaatacattttgtgaggtttctatagcaaagctgtcttactgcctatgtgtaaatgggtttgcttctacacaagttgattaatagtctggcttaagcatctggtttaaccattggtttgaaagtataggggaggaaaaaaccacgaacattgtggagcataaaatacattacagataataggtaatcaggctgcaaaggcctttagttcaagatgttcttctatctctaacttgtctaatccaaccaaaaaaattagattaggatctgtgtataccagtgaaaccagtagaacgactgaggtaaatcagtatgtgttgattcttcttaaggaaaatgttaaaagagtttttttccctcgtgttcactacattttcgttcctgttctgttgctattcccccaaaatatgcacagtcttgaaacgcagcttttaaaaacctactaagattattaggcaaaagcaaacaaatcatagcaagatccttttggtattttatcatataccttttgcagctgtgattatttgctatcttattcattccagcactttttttttccctatgctctttatttatatgttctagataaatgctaggaaacttctccagtaaggcagcttggttcccctgccgagcactgtagccatattcttccctgacctttgctctttgggtgatgctctgccattcgtgcccgtgctttctatttacataaaggattaaagatatgaatgatagagaaaagctagcagattgcatccattttccttgctttgcctggtttctagtaccccgattccatcatttttcacttggcatttctttcattgtcctttgcctggaagcatcagccagtcctcaggagtgcttgtttgggtggatttgacttggagaaaagcagcagtgatgggagagtttgacatctggagactagctcgctgcccttctgggatagacagcagtctctggatgatctttctgctctgttacactgctgatagtttcagagatgagcctactcaagggtctgtagttccagtgtattgtaaaaaatcaaatcacagtgaactcatagcaagcactattttttctcagttcttaagaaaggagacctcctttctaggttatataatctagatcattctgtgaggataaggtggaggcagggatctagcatttgcagaagtttggtgagaaagcatgtgttgctcaagaaaggacaagttcagtgttgaagtgtagatggcctggtgggcaggggagcagtggagctggagggacaggctgggaacaggctacagaggccctgaaatctcctatggagtctggagtttagtgatgtgatctgatttgtattttcttagaagtttcccaattgcagtgatggactgtagtgttccaataaaagccctctggtttcagggctggagggagagagagcaggaagactgatccaggttgaagaaggcttggatttgggtgatggcagcaaggatggaaagttagtggacaaattcaaatttgagagctgcgatgactgggtggagggaaagggggagaaatacatgaaaaggttgtattacgtttcctccccatctcagcgtgagacctgggactcctgtcttctgtcatcacttcttagtcctcacacttgtgagaggcaaactgtattataggtcgcctcctacctcacaagtcacaataggattcaagagcaaatgcatctgagcctctttaagaggcctacaattgcaaggaaattagacagatcttcaaaattagctgctggtagatgatcacatttggcattggcacttgtgactcttgtgtgctcccaatgcctgctggtggaactaaacttccactgtgcctttggctgctaaaaatgctggtaggatcataatgcatgcagcttctgcagagacttctttggaatacctcagtaagtctgacttcatgttatatctatactgagtaagatggaaaccagggccgagcggcagtggctcatgtctgtaatctcaacactttgagagactgagatgagagaatcacttgaggccaggagttcaagaccaacctgggtaacacagcaagaccctgtctctacaaaaaatttttaaaaaattagccaggtgtggtggcatgcatctgtagcctcagctgcttaggaggctgaggcaagatcagtttgagcccaggagtttgaggttgcagtgagccatgatagcgccactgcactgcagcctgggcaacaaagtgagatcctatcttaaaaaaaaaaaagaagatggaaactaggcccttcttttatgtttcttaggagcccttaggaatatactttttgtttgttttgttttgagatggagtttctttctgttgcccaggcaggagcgcagtggtgggatcttggctcactgcaacctctgtctctggggttcaaacgattctcctgcctcggtctcccaagtagctgggattacaggcgtgtgccaccatgcccagctaatttttgtatttttagtagagacgaggtctcaccatgttggccaggctagtctcgaactcctgacctcaaataatccacctgccttagcctcccaaagtgctgggattacaggcatgagctaccatgcctggccaggagaaggatttttgagcagaattcaaaccaatgatttttgtcttccctgtgccgggtatttgaaaaaaccatagaggggaaggaaaggcagtctgtgtgtgtataccatgacagagggagaagctgaaataaaatgtgccccgagaagaattagggctgggaggatggaacagcaagaatgatcctaaatcaagtataataattttttgtgtttgtttttttttttgagacagagtctcactctgttgcccaagctggaatgcagtggcatgatcttggctcactgcaacccccgcctcccgggttcaagtggttctcctgcctcagcctcccaagtagttgggactacgggcacacgccaccatgcccagctaatttttgtgtttttagtggagacggggtttcgcaatattggtcaggttggtcttgaactcctggcctcgtgatccacctgcctcagcctcccaaagtgctgggattacaggcatgagcaactgtgcccagcctaataatgcttttttaaaaaatagcccgggcgcggtggcttatgcctgtaatcccagcactttgggaggccaaggcaggtggattgcttgaggtcaggagtttgaaaccagcctagccaacatggcgaaaccccatctccactaaaaatagaaaaataagccaggcatggtggcatgcgcctgtaatcccagctacttgggaggctgatacaggagaattgcttgaacccaggaggcggaggttgcagtgagctgagatcataccactgcactctagcctgggcgacagagtgagaccctgtctcaataaaaaccaaaacaaaagcaaaacaaaaaatatagacgtgcgcctttttcatttaacgtgtgtgtgtgtgtgtgtgtgtgtgtgtgtgtgtgtgtgtactggtgagaggtttgaaatcaaggctcttttctccctctagaggtttaaggactgtattggagtggactcacctgttcctatccttgtttgatctattacaatttggtggcctgttttgcagtttatctgttgcagaaaaagtatagttaatctttaatgtgtcaaggctgtaaacagaaatcctggctctgaaacagtactaacatccaaatgaatgagcatatcagaagtacctgaatgataccatagatttatggcaaccattataggtctttgaaagaagagctgaatccacttttgacatgaattgatatggctgttatttcctctgatgtagattggaccatgtggaggtagggagaatagaatgtcatgttctttcactgaagccatgccgtgagcaactctatccaaatagaatgtcacacctctcagttggagacccaggaggactgaccgtgtgccaagagtgaggacaggaggtgattacagcttactaggcaaggcgagcagtccgcccgcggagttcactgagcctcattagctcttccgtagagcttaatgtgtttcccgtttctgtctttccagaagcgcatactgtgctgcctccgtagcctcgctgaccaacatcatcactccagacctctttgagggcactgctgaatggatagcaaggtgagagaagccagggtttctcctggcctcttggagagcaggcggtcacgacactacttcagaaaaataaagaaaatgcagagggacttggaaggaaatacaaaaatcacaggagatccattagggttatctaatgatttttttaaatacttaaaatgtcttcttttttccaaactttctttaatgttatattatattttagattggcaaagataaaaaactttggtaaacaatattagtgagagcctgaattgatttaaccagtttttagagcaatttgacagtatgtcaaaggtgcccttgcgtaggacccagtaattccactcccacagaaacccttgcacacacgaatgggagagaggagcacaggacttgtttataagagccaaaagctgaaagcagattcagtgctcataagcacgagatgggtaagtgtggtatagttgcatcggaatataatgtagcagtgaaaatgaatgaactagagttacatgtatcaatatggaaaaatctctatgttgagttgaaagaatgaaaagaaaaaaatacaaaaaaaccatacagattagcacatttacttaaaatttgaaacatgcaagagaattctgtattgtttctgagaagaatcatgtggtaataatataaaaacatgtatacgaaagataaacaccaaatttagcatagtgattcccgctgaggggagagcaaaggaaatgagataagtctgcataggagacttcagctgtaatagttaacaacaacaaagacctgaagtgtatatggctaattctaagctaggtcttagatacgtgtatgttctatattttgtttgctgtactttcctggatgctccaaatatttcatagtttaaaaaaagcaggccaggtgcggtggctcacgcctgtaattccagcactttgggaggccagggcaagcggatcatgaggtcaggaaatcgagaccatcctggctaacatggtgacaccccgtctctactaaaaatacaaaaaattagctgggcatggtggcgggcgcctgtagtcccagctactcgggaagctgaggcaggagaatggagtgaacccaggaggcggagcttgcagtgagccgagatcacgccactgcactccagcctgggcgacagggcgagactccatctcaaaaaaagaagcaaaaggtatagtagacacatatatactatgatggaatgatagccaagctgagatactgttttagttaaaaaaattttatttttatcaaagtagtatgtattaccatataaatataatttacagtgataccagatgatatgctgagatcatgtttacttttttgtatgagtttcattttcctggagttaatggatatatcatgaatgtacttatgaattccttcccaaattgtctgtcagagctataaaaaattactctaaacatagtcaaacccttcaggtaacctgtctctgtgcacacgtgcgttttgagttgccccttctggagccctctgccctcctgcttcagtctggacagattgctctcagcttgctacacagcaggcatcccgaagcttcctttcagcatgaaattcacttcatttctctccttcgttgaagtccctgtcctcctttttcttggttttcttattttcatgaagtattgtactccaacagatcccaaaaaagggtacctgggagatacatttttaatatcttgcatgtatctgtgttctaatctcacacttaattatttggttagagatttctaacttggcaatggtataaactgtagtctttctgaattttgtaagcattgcttcattatcttctggcttccaatgtcattgttaataaggctgataatagtaaccagagttcattgaggactgtcatgctcaatggtaaggcagctatagttgagagctggagagtaggcactgcctgtgtttggttctcttttatattttgtgtttctcagctgagattttccatctttttattctttatgagtgcatttttcttcattttgctgtggtaagtatggaattataatgtctgctttaaattgcttgtctgggaatttccacatctgtgtgtcctggagttggcatgtcagctccatgagtcttcctgtgctgagtgatgttgtgttgtgtcctagacattgtgatatgatggtggaggtgtcatacaacagaacggtatggattctgttggtttgccccaaaaggggttgatgttttcagtttagcaggcagtcaacttggtcagactcaagctacaaactgtcactcatgcagcagctcagagctcagttcttgcttagaagttgctttgtttccccagcacgtatgtggaaacttgaactgagtttaaatgcagaatttgggatttttcttctttgactttcctgtttctggattcgtcctcagtttctggcagcctgcatcttcctgccagaaggatggttggcttcccattagagtgttggctgcccgccctgacccctgacccctggcctgctgctgccgccctgggctatggctgccatcctgagggcaaaccagagagaaaaagttgtgggggaagggagggactaactgcatgctgttctctgttccaagtttcaaactccaccaaaatctgcctgccctttttcagtcagctgaaccctcaggaagctgtttttttgtattttgttcagtgtacagctgtcatttgcaggggggttgactggttaggcacagactagatacggaactcagacagcctgggtttgaatcccagttttgccctttctttcctcttctcttccttctttcttcctctatctttcaattctctctttctttttttgagacagagtcttgctctgttgcacgagctggagtgtagtggtgtgatcacagctcgctgcagccaccacctcctgggctcaagcaatcctcccatctcaacctcctaagtagctgggacaacaagcgcgtgccaccataaccagctaatgtttaaaaaaaaaatttgtagagatgggatctgtctgtgttgtccaggtggggcttgaactcctgggctcaggctatccacccaccttgacctaccaaagttcaaggattacaggcatgagccactgcgcccagctttttttttttttctttgaagacacggtcttgcttgttgccctggctggattgcagtgatatgatcacggctcactgcagccttgacctcctgggctcaagcagtcttcccacctcagcctcctgagtagcagagaccacaggtgtgcaccacaacacctagctaatttttaaaatgtcttgtaaagacagagtctcactgtgttgcccaggctggtcttgaactcctggtttcaagcaatcttcctgcctcagccccacaaagtgttggaattacaggtgtgagccacgatggccagcctgccatttctaattagctttgtgcttggacaagttattccactgctctgtgtcatagtttccttatatgtcaagtggtgggatactgaatttaattaatttaatttaatttatttattttttgaaagagggtctcacttcgtcacccaggctggagtgcagtggcgtgatcttggctcactgcagccttgacctcctgggttcaagtgatcctcctgcttcagctttccaagtagccaggactgcaggtgtatgccaccacacctggctaatttttgtgtttttagtagagacggggttttcccatgttgcccaggctggtcttaaacccctgagcttaagcaatccgcctgcctcagcctcccaaagtgctgggattataggcgtgagccaccacacccagcctttaaattttatattaagcagaaatacagagaaatcaaatggattccactgtgctgtactacctggcagtgccattgtgattcttaattctctgtatgtttttttcttctgtctctctttttctatccccatcctgtccttctttagcggcttggaatctttattctttttgtgtgtgatggagtcttgctctgtcacccaggttggagtgcagtggcgtaatctcagctcactgcaacctcaggtgcctgccaccatgcctgactaatttttgtatttttagtagagacagggtctcgtcatactggccaggctggtctcaaactcctgacctcaagtgatctgccctcctgagcctcccaaagtactgggattacagacatgagccacctcgcctggcctggaatgtttattcttgtttggaaacttgatgatgaatcttgatgtggattatttttattcattttgctgggcactcgatttggaagtgcatatactttagtaccaagattctttattacagtatttctttgataatttcttctcttgggttttctgtgtttgctcttttttttttttcctttgaaacggaatcttgctgtttttacccgggctggagtgcaatggcgtgatctcggctcactgcaacctctgcctctcaggttccagcaattctcctgcctcagcctcctgagtagctgggactacagaagcccacgaccacgcccagctaatttttgtatttttagtagagatggggttttaccatgttggccaggctggtctcgaactcctgacctcaagtgatcgcctgcctcggcctcccaaagtgctgagattataggcgtgagccaccacgccgggccctttttttttttttttttttttttttttttttttttttttttgagacgtctctttttgttttatgtgtctcccagattggagtgcagtgacacgatcatggttcactgttgcctcgactttccaggctcaagtgatcatcctcagcctcctgagtagctgtgactacaggcatccaccatccgctaattttttaaatttttgtagagacaaagcctcaccacattgcccaggttggtctcaaactccctgggctgacgtaatcctccctgctgcggcttccccaagtgctgggattacaggtgtgagccaccatgcccagcctcttatttatttatttattatttatttatttatttatttatttatttatttatttatttatttatttatttattgagatggtgccttgctctgttgcccaggctggagtgcggtggtgcagaccagctcactgcaacctctttctcccaggttcaagcgattctcctgcctcagcctcccaagtagctgggattataggcgtgcgccacgacacccagctaatttttacggggtttcgccatgttgatcaggttagtctcaaactcctgacctcaaatgatcctcctgccttggtctcccaaagtgctgggattacaggcatgagcccccgcacctggccagccttttaaaaatatgacatcccattagtacatttgattgtctgacttttaagaatactttgaggctgggcgtggtggctcacgcctgtaatcctaacactttgggaggctgaggcgggcggatcacgaggtcaggagttcgagaccagcttggccaacatagtgaaacccagcctctacaaaatatacaaaacattagccgggtgtggtggtgggtacctgtaatcccagctactcgggaggctgaggcaggagaattgcttgaacccaggaggcagaggttgcagtgagccgagatcgcaccattgcactccagcccaggtgacagtgtgagactccatctcaaaataaataaataaataaaaataatactgccgggtgcagtggctcatacctgtaatcccagcactttgggaggccaaggcaggcagatcacgaggtcaggagttcgaaaccagcctgaccaacatggtgaaaccctgtctttactaaaaatacaaaaattagccgggcgtggtggcatgcacctgtaatcccacgtactcaggaggctgaggcaggagaatcacttgaacccaggaggcggaggttgcagtgagccaagattgtgccactgtactccagcctcggcatcagagcgagactctgtctcaaaaataaataaataaaaataaaaatatttcattgcatggttcgtttccatctcttaatccttcttcttatactttgagagattctcttagtatttatcttctaatcctcttgtttttatttttgtaatcctatttttagttttcctccctgactacttttacttcctgactacttttttatctactctcttgttcttttctggggatattttgtcctctcaatagtcttacttcatataatattttatctaaagatacaactttaaaaagttttcttttgctccctgtcttatttcctccaatttatttttgtttgttttggtctcctctttcatagtagagactgtggtcaaatgtctggtactctacagctgtctgttcatatttaaggatccagcactgaaaagctgctggggagctctgcgagagtgggcaggatcaagccattcattggggaattctcaaagcagtgtctgtagggtttttcccttgggcttatcagttccctcagagaggaatcttctaaattcctgcttggggtatgaaactggcagccttgtgtgaaatacacagaggaatggggctgggggtattgtgttgagattactgactctcacgtaatcacatttggtacagtgctccctcctcctcttagcttgttggatattctggaactcagatccttttgattaaacctctgaaacttcccatcttctgctggatttgagtaggggacttaaaggtctgattcttatataagtttgcaaccaacaaacttggttcagacgcattccactttgtggaggttccctgtatctctaatcctggagccttttattggagcagatcaccttgctttttgttgcccctctcccatccctatcctttgggtaggaaaggtttctctattctactaagtcagttatttcttgtccttcttgtgttagtccattttgtgtcagtataaaggaatacctgaggctgggtaacttagaaagaaaagaggtttatttggctcatggttctgcaggctgtttaagaagccatcaccacctggcctaattataatttttaaaaataacgtttattttttaatagtatacaggttcattataaaaactttttgaacaaatagaaaaacaaaaaggaaaaatattactagtagacctgtactcaaagatcaccagaggccaagtgcggtggcccatgcctgtcatcccaacgctttgggatgctggggtgggaggattccttgaggccagaaatttaagaccagcctgggtaacatggcaatgccccatctctacaaaaaatacaaaaaatggtccgggtatggtggggcacgcccatagtcccagctactcaggaggctgaggtgggaggattgcctgagtccaggaggttgaggctgcagtgagccatgatctgcagtcaacctaggtaacagagttaagaccctgtttcaaaaataaaagatcactagaatcaacaatcactctttaattttattttaacttgatggttatcactatatatatatgtatatatatgtatatatatgtgtgtatatatatatatgtatatatatgtgtatatatgtacatatatgtatatgtatgattttataactttttcccaaagagtaataatttgaattattatgtttcttacacaagtaggctgtttctaagtgtctgggtttttaacattttacagtttttattatacttacattttttggagacctagtctcactctttcacccgggctggagcacaatggtgtgatcatagctcactgcagcctcgaactcctcgcctcaagtgatcttcttgccttagtctcctgagcagctgggattacacatgggtgccaccaggcccagcttttttttttttttttttttgaaaagacatttccaaaagttaattagttggcatcttttcattcatagttgtgatggttcacaccttaatctgagtgaactttttctctgccacctaggatggtcctggtcttgtgtacgtccactcactggccactcattctgcttttctcaatctcttcttaggtgtcagaactgggaaggtggcattggcggggtaccagggatggaagcccatggtggctataccttctgtggcctggccgcgctggtaatcctcaagagggaacgttccttgaacttgaagagcttattagtaagtatcttttgagccatccccctctcaggccccaggtcatggtgatgtgattgtactcagacatgcaggcttcaggagagtttggctatgggaagggctaagagagttagctctgttccaacacagaggaaggagtgagcagctgctctgtcttggctcccccttctgcctttctgtcttcctgcttagagctttttacatagtgtgtagactacatagactgtgtgctgcagacatctggtgtgagcagagtaccttccttatacttcagtttcgtagaattagaggttatcgtgtgttatagaaagaacctcctaagaggaaaagttacaagaagagctttgcagcatttcgaaaccaaacttttattacctgctgcactgtgtaaacatttagtacctacatttaaatgagttgtttaggcagagctggctaattgcattgagaaggcagcccaacatttatgtctggaccccacgctcctggccagtattcagaagaaactcagaaagcagtcagcttcagggagtcactagattgtagttaaatgatcagtgggtgcacaaacacacacacctccacggccaccagggagaaggcattccccgtcatgtcatttggggagcatgtaccccctgaccatgacgtcaaagcaaaccagctgcaactgacatgcacctcctctccctgagttcagatgccagcctcccgttatgcggcccatcgtgagcttcctggagagtttctgttgtaccctgtagacatgtaaccagcagtgtcttgcctccaccttcagaaagcctcccccggtgtagtctttttaaagattcatgaaggcttgaaggctcatgctgaaacagccaactttgtatgctgaacttaagagtttctcagatgttttaaaatctgaacaccaataaggcatgaaacaaaaaagtcccatctcccaggcagagataaggaatgtgattagggagtgcctcagttataaagacagtgttctagatttgaaccctgtccctactacatttgagacatgagtccttgggcaaattgtctaatctcttttagcttgatatttttttcttttataaggtagggataacaatccttatttttttaaggttaaaggagagaacatttataaacagcctggcacatagtaggtacttaataaatgttagtgtccctctaacccacagtaataatctttttggcacaagggaccagttttgtgggagataatttttccgtggacctggggttgggggtgggacggggggtgatggcttcaggatgattcaagtacattacatttattgtgtactttatttctattattacattgtaatatataatgaaataattatacaactcaccataatgtagaatcagtgagagccctgagcttgttttctttcaactagacagtcccatttgggggtgatgggagacagtgacagatcatcaggcattagactctcatgtagagcgtgcaacctagaagcctggcatacacggttcacagtagggtttgcgctcctatgagaatctaatgctgctgctgatctgtcaggaagtggagctcaggcagtaatgggagcagtgaggagcagctgtaaatacagattaagcttcactggctcacccaccactcatgtcctgctgtgcagcctggcatggtctgggggttagggacccctgctctaatccagactactcccttccatttgctttgggagaagtaggacccatatctgaagtatgaattcctatagcccaaggaaacagaacaaatccatgggcttaggcactggaaaaagtaaattagtctgcttaaaaacacttaagccctgcggtaagtagaaatgaggaaccgactcccactgcagcgcctgctttctctctgcctgagtaatgcttagcccacttccattacatgctggaagccctggttcatttaagatcaaccgaggatatattagtacctgaacctgcagtacagtgttttctgtctcttttaagcatttgtgactgtgactctctatgggcaggtgttgccttgaagagggaataatctaaacaacagcttttaggggagggctggcccccacttccatcaagggtcccagtggctcctttcaggacctttacctagtaagactctagaaacaggaagtaccctcccctgtaccctttcagttgagtgaggcagctctgtaagtccgtggctggaacggcctaggtggtctagggagggaaatggaaatgtcatatctgctcagccagttggttctgctcattctgagggaccaaacccatgactatcttgatctttgtagtagagtgtgtttagaaaacttgtagataagcaaggaatggtggtatcgtgtgtgaccgctgagtgacatcaagaccaagacctattttacagcttcaaagtaaaagattttcttatatcagccacagactgggcagagttgtcatttggtaattagaatgaatggcttctgctttcaggcctgctagtgacttgctaagagaccttgggtaaatttccccaggtgccaagtaaaagtcaggagcagtttgagatcatctgatgaaatgtagtaccaggccgggcacggtggctcacgcctgtaatcccagcactttgggaggccgaggcgggtggatcatgaggtcaggagatcgagaccatcctggctaacaaggtgaaaccccgtctctactaaaaatacagaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaagaaatgtagtaccaaattccatttatctgcttttaataaactccccggagcagggaagtaatgagaaatgagctactggtagtcttgccttcaatttccaacttaagccatgtttattaagagactttgaaggtctccttacaaaccagcttggcctctttatcttctcagcactggcactgctttggaacccaggaaaaggtagttgtctgccaggcattgagcagagatcagtgctggatgcctctacagcgttggcttaaatgcttcactctgtgtctatggcagtgtggggagggaaggaaagaaaaccagagcaccaaaactagagtgccaagaagccacaagatgggaaaccctccatcccacagattgactcctggagattctgtcgggctggattttgtctcttttagcctacaactgcctttcccatctgtgtctcctcagcaatgggtgacaagccggcagatgcgatttgaaggaggatttcagggccgctgcaacaagctggtggatggctgctactccttctggcaggcggggctcctgcccctgctccaccgcgcactgcacgcccaaggtgagcctggggagctgttcacttggggctggatgatttccctccactactcacaaagtctggaagcccagcgtgcttttttagaggggttgaaatgagctctgtctatcctggattttgagtgcccagtgtggaacctcatgccgtggggcatgcgaatgcagagtaagatttagtttcattggtttagtgtcattctttgcttcttcaaattggctgcgacagaatgagcttccttgaaattgctacggggagcggggaggaagtgggcgctgcttctgcgttatctggaaggagcagcccactcctgtcctgggctctgtggtgattgccacctcctctgggtgcagggcagagctgaaaaccctcagtgttgcaacagtcactgttgcaacagcaacaggaaaggcaactgcgtaaaggggtagagaaccagaacccatgtgtaggggtgggttgtaggggtgggttgcccctacaccatggagaagagactcgccgtgtctgactggctgcagagttgtcactattagaaatgttttattttacattcattgaataagcctaaatgggagtttgttccacctgcaccattggagtagagaaatccacgttcgtttctgtggggtctcaaatgggaacgcaaaaccgaagtagttagtgagcaaaaagtctgggaacattctctctctatctcttgaaacctcagtctgcctgctaactcctgcaccatctttctggtgtacttgatgtgagagcaggtgtctctgagtagacctgtgggagagaggaagtcatggggccctgctggttgctgatctgtttttggaatgagatccctgggtccaaagagaagctgttcttcggacttagttggataatgtaactgctcaaatgtaaaagatgagattctttttctgcccctccccatacttttttttcctgtttctgagccccccaccccccgtcttcccccctccccgccgcccccgagatggagtcgtgctctgtctcccaggctggagtgcagtggcacgatcttggctcactgcagcctccacctcccaggttcaagcaattctcctgcctcagcctcctgagtagctgggactacaggcgcgtgccaccacacctggctaatttttgtatttttagtagagacagggtttcaccatgttggacaggctgttcttgaactccttacctcaggtgatccgcccacttcggcctcccaaagtgctgggattataggcgtgagccaccgcacccggccctgagcctcattatttagtttcttaatttcctttgagttgttgagttgtgaccatttctgacactgaattaaagtaagcagagcctctgtcccattttcccggcctgggcccactgggctttaggtgtcagtattaaggcatataaggcacttacccttggaacacagcaagtgcactgtcagcaagtgcactgactttggagcctgcacagtctctgccttgaccaccagtagggaagtcaggaattccccaagtcaaacattttttattttagtattatttttttttgagacggagtttcactcttgttgcccaggccggagtgcaatggatcactgcaacctctgccccctgggttcaagtaattctcctgccttagcctcctaaatagctgggattataggcatgcaccaccacgcccagccaattttgtatttttagtagagacagggtttctccatgttggtcaggctggtctcgaactcctgacctcaggtgatctgtccgccttggcctcccaaagtgctgggattacaggcgtgagccaccgtgcctggcccaacatttctaagatagaaaaaaacttggggtcatggtgatctctttatttggaactggtgaggtcaagcccctggtaaaatggtcagtcttttacaaacctgtccctggcatggataagactcagtaattctgcaatcccagggaaatgtggaatgagctataacaggagcaccacctgtcaaagtcttccaggggggctgctggttaattgtttcttgtagcacatgttctagggggcttagtggcattcaaagctttgtctatggaaaagggtgcctatgaatcttggtgcttccagcttttttcattggctgggagaaggcctgtgttgtcttctcagacacagggcatctcttgaacttggaacagacaggagtctgtaaagaagggaagtgtgttgaaaggagggcaaaatactgactttgggagtcaaaaggggatgcagtgtagaaagatagtcacaatatattgtgatcatatcaaagcaatatgtgtggaatcccatttttagtgaagagttgactacaaaaaattcatagaaagtatctaggatgtgaagttacaggtgatgtttgcttctgtttgtattttctaatctttctatagttaataggtatttcttgcataaaaaaagacaacaaaagttattttacagaaacagggaaattctacaaacaaaacaagcaaaaaggtgcgaaaaatatttataacaagtgatgaatggctaatttctttaatttgaaaaaaaatcatacaaaccagtaagaaatggatggacaacccaactgaaaaacaggcaaaggatctgaagaaagaggtcccagtgaaagaactgtccttcttactttttctactacaactgccactactactggtagcggagtcttcccaagccctcactgtatgccaggggctgtactgagcatttcacatatgttttctcatttaattctcaaaacaaccctatgaaataggtaccattgtttacagatgaggaaacaaactacagtgaggttaagtgattgctttataatacctgattggcactcacaagggttagtatgtggttgtgtgaatccagactagctggcatctgaaccctgccctgctcataaccacagtaggtggccattaatccaacgaaaaattgtttagctcacttgtagtaaaagaaatgctaatcaaaagagtggcactatttgtttttattattggattggcagagattaaaaaacttgataccctatgttggggagagtgtgagaaaacaggtaatttgatagtggggatgtaaataggttaagtcattttttggagggcagtttggagacatccatttaaattataagggcacttaccctttgaacacagcaagtgcactgtcaggaatttacctgcagggatattagcaaaggaatgtatattgaagtggagtttcaatagcagcctaagtgcctatcaaaaggttaagggttaaataataaaaatctctccaaacagtagctgcataccatgggctgatatagaaagctctgcaagatacaacatgaagtgtaagggggcggggcctggagcagtgcctgggcacacagcccgagatgtacacagcttttcctggaaccctacacaaaaccccttgaacaatgggtacctttgggagaagagaagcagacagaagacagaaggagggagactttttagattttttttttttttttttttttttttgagacagagtctcactctgttgctgaggctggagtgcagtggtgcaatctcggctcactgtagcctcctcggttcaattgattttcttgcctcagcctcctgtgtagctgggattacaggcgtgtaccaccacacccagccaatgttttctatttttagtagagacaggatatgactatgttggcctggctggtctcaaactcctggcctcaagtgatccaccttccttggccacacaaagtgctgagattacaggcgtgagccaccatacctggccaactttttagattttctatccttctgtattatactgtgcctttaaaaaaaaaaaaaccatgtgcattactaattttattttggtaaatgtacaaatacattttttaaaaggcattgatcatattgctaactaaaaagcaaaaagaatgctctacatagtgcagcacgtgggtctaggccatgccctgacccagcaagtgaccatcagtggctccatgccattgactaccttctatgtgtaaatgacagtatttgagtagaagaaggaattactattagtaccttaaaatgctggacatggtggttcatgaccataatcccagcactttgggaggccaaagcaggaggacctcttgagctcaggagttcaagaccagcctgggcaatatagtgagagcttgtctctacaaaaaattaaaaacagttaaccagacatggtggcacatgcctgtagtcctagctactcaggaggctgaggtagaaggatcacttgagtctgggaggcagaggttgcaggcagagagtgccactgcaactccagcctgagcgacagagcaagactttgtctcaaaaaaacacaaaagcctgtaatcccagcattttgggaggccgaggtgggtggatcatgagctcaggagttcaagaccagcctggccaacatggtgaaaccccatctctactaaagatacaaaaaattagccaggcatggtgccacgttgcctgtaatcccagctactcaggaggctgaggcaggagaatcccttgaaccccggaggcggaggttgcagtgagctgagatcgcgccgttgcactccagcctgggtaacagggcaggactccgtctaaaaaaaaaaaaaaaaggcttaagaaatctcaagtgctgactaaatcagtgagttactttgtttttttgttttgtggagcaataagaaagcagcaggcctgtgagtttccacttggcttggtagttactggtttcttatatgttcttttggacataccctggaattttcttgcctacctgtgaaattgagctacagatggctgcacctatcagttatggtgtggaaagacttttgatttttttagataaaaggaacctttgaaatgcaaaatgagattagaatggcgacctataatttcaggaagaggtagaaaggatttaaaaggtggattccagtgtgcagttatcaccctataatcgtatctgctttcatcttgttgtgattatgtgtgctggtgtccaaattcaggatatctggaagctccttgtagagcttttgaactttgagcttctatgctttaataatataggaagtcactgaaacagtctatagttttttatataataaacatagcgttttcttttcagactctaattttagccacaggttatcatttaccttataataatagtcttttatttgttataggatatgaaatatatgtacattttgtacagatgtgtaatgcagtttcctaaagtttaataaatatgcttttttaaataatagctttgttgagatataattcccataccacacaacttacctattcagttgcgaaccatcatgacaattttagaacattttcatcactcatccccccaaaaatccccatacacattaaatattttcttaaaaaggaaatcgtgaaggaaaaatcaatagtatgattacaatattaagtataaaacatatatatgttttacattaattaaattttaaaaattttaaaaagttttaaactcacataaccaaaacagaggagcaaaaaggagaaaatagatgcagcatatgatgtagacaaggggcaagtataagaaaaagctagattaataaaattggctattggatctcagaagattaggccaaacagacaccatcataaggaaatgcaaatattaaacacaagttatggaaaaatttcaccctaattagtaatcagaggcatgcaaatcaaaataaactatcaggtactatttctttttaccattttaattgctgataacttttaaaaagtaactaaagctggccgggcgtggtggctcacgcctgtaatcctagcactttgggaagccgagttgggcagatcattttaggagttcgagactggcttgatcaacatagtgaaaccctgtctctactaaaaatgcaaaaattagccaggcgtgggggcttgtacctgtaatccaaggtactcaggaggctgagacaggagaatgacttgaacctgggaggcagaggttgcagtgagctgagatcacaccactgcactccagcctgggcgacagagcaagatagcatctcaacaacaacaacaaaaaggtgctaatgctggaggtggtatagcaaaattttaaattttgctggtagctatataaagtctttgtttttatttttagtttatttatatatttatttttgacagctcctgcagagcagggctactccacagggattgtgctgagagtagtctataaattcttaaagcagtttatcagtatctattaaaagccttaacaatgtttattccctttaaccgaataattccaccgtggtcagtctatttgaagaaaataatcttaagcatacataatattgacaaagatttagtccagcattcctcataatggcaaggaactggaaacaaccttggaaataagtaaaagaagatagagtgaagtcccatcatatatgtatgtatcttctacaacaaagttcactgtgcttacaggtgaggaaaagaaaggaagggaattaaaatagtgcaagtgtatcaaagcatgtggcctgcagccagcctgagatgggagattggatgcttctccttaggtcggacttagtttcctgtgtctcttaatgggtgtttcagggctgagtgcgactcagggttgaagacgagaagcttttgtccctggcctctaaatgtcacctggccactgtccctcacctagtgctcaaccttggaaacccttttcctctgtgtctctttttaaagaaatttaataaattcttattgtctgtttgaaatattcaacaatttaggctgggtgcggtggcccatgcctgtaatcccagtactttgggaggccaaaagagggtgggtcacctgaggtcaggagttagagagcagcctgaccaacatagtgaaaccatgtctctactaaaaatacaagaattagccaggcatggtggtgcatgcctgtaatcccagctactcgggaggctgaggcaggacaatcgcttgaacccgggaggcggaggttgcagtgagccgagatcgtgccattgccctccaacctgggcaacagagtgagactctgtctcaaaaaagaaaaaaaaaaaggaaatattcaacagtttaatattttgcttcaatctctttatagactgtatcataaacttttcatttttatttttagaaatcttttcccccgtttttcttttttgctattttctccaaaatgggaaaggttattgataccataaacttttataattttcaccataggaatttttttttttttttgagatggagtctcgctgtgtcgcccaggctggagtgcagtggtgtgatctcagctcactgcaaactccgcctcctgggttcacgccattctcctgcctcagcctcctgagtagctgggactacaggcgcccaccaccatgtccggctaatttttttgtatttttagtagagacagggtttcaccgtgttagccgggatggtctcgatctcctgacctcgtgatcaacccccctcagcctcccaaagtgctgggattacaggcataagccatcgtgcctggcccaccataggaatttatatactgacatatatataagatttttagctcagttctttttatgatacagttaccttatatgtccacttaatgaaatactatatggctattcacagtgatggctatgcagattatgtaatagaatagaaaatttatgcctatagtggtataagtgaaaaacataagctacacagttataataactaggtagaaaaacgcatagaaccaaaaagactggaagaaagaacaattagctttcaggtgccatttaccaattgttgggcatcttttttttaaaaatgatttattgtcaggcatcttttagcccaggtatcaaaatataaaattgaccaaggacttagtgtacatcctatatgtatatatatttttaatcgatttctatgcagatgtttctgcacacctgtccgtgatttgtccctccttcccacttgataactgtgtggcccacagaattctttgaccatagtgattggacttcagagtgaagaagtccagttgcttgtcagtaccttagtagtattaccagaatacccagtttttgctagggtatcatatgatgcaggagggcagttactagtaatgtttcttaggtaaattctttgagctgagagacaagttagagaattccctttggagatcaattaaatttaggcttagaaaagtagaagaaacagactttattacccattaagagttctctgagctaatcagtctggttaacaagttatagagatatgctagagggaatgtctcttgaagtccagggtagagttatggaccaagttgggagcagctaccgaggtcagtctgggaaggtaagctaaacagctaggctggttcactgcctgccagagatgtggttgaggatcaccatccacgttaacagggtgcatttcaagaaagtgaaagtgccactttgaattgctgctctttgacacatgtcaaagttcaggagaagggacatgctgtgcgtaggacatggggaagatagcagttgtaccaagaatgaatggaagaggaaggggagcaggaaaccttgactattcccccaggtgagaaagtggaattaggtcattgatacttggctggatctgccgggcccttactgaccctttgcccttcaacaggtgaccctgcccttagcatgagccactggatgttccatcagcaggccctgcaggagtacatcctgatgtgctgccagtgccctgcgggggggcttctggataaacctggcaagtgagtgttttctctctggggagggaagggagaggggaggagagagcagaggggcgtgcacctcaggcctactcagagccagatctcaagagcagaggtgtcaccttcagcacctgcatagcgctaggttgtatgggaaaaagcacccagttgggagcaccccttgaggccattgatcttggcacctccagctgcccgtcttgtcccccagcctgcatgcaaccccctcccccagacagggaaacagattgctgggtagataactcttcttttttttaaaaaaaaaaaaaaaaaactgatctaaatagaataggatacaggattttaaaacccctcagtgttgtaaacagagactgtaatcatgacaactattatagagtggattaaatgattaagctcaaatctgagatggcttatgtgttagaaaaagggaaataaaataagtcctctcacctttgttacccaccctctgtcttcccccatcccagcacacgtcctgctgctcttggcatccaggggaaggcctggtcccacaatgtatcaggaagaatgtggcccatttctagatatttaggtatttttctagagaagtgtatcaatttatcattagtactgcccctggagagccctttccagaagacagctggagagactgactttaaaattacagtttcctttaatagtttaaggtaaaaaaagaaagaaaagaaaaaaaatacagttcccactgctgggcagggctggaggatggggcttttattttattgtattttacttttttgagacagggtctcactctgtcacccaggctggagtgcagtgtcacaatcatgactcactgcagccttcacctcttgggctcgagtgatcctcctgcttcagcctcccaagtaactggaattacaggcatcggccaccacacctagctaatttttaattttttgtagagacggggtctcccatgttgcccaagttggttttgaactcctggcctcaaaccgttctcttgcctcagcctcctgcttgctgggattatgggtgtgagccactgtgctcagccagtggggctttaaataacactgctgggaaaaccatgcctcctctagccacatggaggatggggggggacgtgtgattgcaccagtggtctctgaattggtgtggctacatttgtagatgtgtgcggagcagaggagcgcctgctcagagctgcctgtccttacaggtcgcgtgatttctaccacacctgctactgcctgagcggcctgtccatagcccagcacttcggcagcggagccatgttgcatgatgtggtcctgggtgtgcccgaaaacgctctggtaagacgggtgcagggcttcacaccccttctccacagggacctcgcggacagaaggctttccaagtaagcagaactggctctgcatttcctgtgtggacaggcggaagcttgtggtccctctgcccttcgagctgtgcagccgttagtgaggatgtgaccacagaggagacgcacctctgggcaagctcagggttccagatgggcggtctgatctgtcaaagagctgttgtgcctttatcccagggctgaggacctagcccactgctggtattagcttcccctagaggaggccacagttacgtgtcactctgaggctgtgagtcccagcaggctcgtgatagcactgcagccatgcggcactggctgtacagcctgccgcgtctctcccagaggctcagcttagatgccatctcttcagagaatgagatccccagaatgctctgcctcagtgccttgttcatattctttgtagtactttactcagttggtggtgtgttgtttaatgtgtgtttgtctgctttcctgaaaaaacaatagccctatgagggcaggatgctcactgctgcagccagctgaggacaacctggaggtgctctgagcctagacgtgagcctggacatgaatccaatggagactgtccccagtgatcaaatcacagggcccatgcagactgtcatgaatttttgtgtgcagttccctactcttactaagccctacttccaccagtgtaaacatggcctgctgctaccatctaggtcactgccttattttctcatctgtgtcattgtaaccttccttttttgtttaaaaaaaatttttttttaatttttaatttttttttgtgagacaaagtctcactctgtcacccaggctggagtacagtggcatgatattggctcactgcaacctccacctcccaggttcaagcaattctcgtgcctcagcctcctgagtagctgggattacaggcatgcaccaccacacccagctaatttttgtatttttagtagagacagggtttccccatgttggccaggctggtctcaaactcctggcctcaagtgatatgcctgcctcagcctcccaaggtgccaggattacatgtgtgagccaccacgcctggccccatctttgtttcttttaattgggaaacatttcaaatggaagaaacacaaatggccaatagatagttgaaaagatgctcaacctcattcttaatcagaaaaaccaccacccagcttttccaggccctaattatttccccctatttgcctcttatgtagccctcttccagttttttttcctccctccttctccagaggtaaccctgtcccaaatttgacatgtatcatgcctgtggatgtttttgtgctattgctacatacatatgtatctataagcaatatatagttttttataagcaatataacagttgcttgcatgttttcaaactttttgtaatggtacctactgtaccagtcattctgcattgctttttccacttgccattgtatttttgaggtttatctgtgttcacatgtgttgctccagtttattcattttaactattatatgatactcccttatataaatgtaccccagtgtgtttctctgttctcctgctagttatcaattttttgctattacagtgttgcagtgaacgttgtggtatctgtctcattgggttcacatgttagaatgtctccaggaggggacctgctgggttgaaggggacacatattgtcatctttgatagatacctctgtaactgctccccagtgtggttgtgtaagatgaatcgatccatagtcagaccttttcctttttgccaatttgatgggtgtgaagtggtatttgtttgattttgtgttttcctgattactggtgaggttgagaatattttcaaatgtttgttggccatttgtgttgtcttctgcgaattgtctgccagttcatattctgtgctcattttcttactgatgggtaacttcagttgttttcccttaagtatttgtagttctctgtatatttttaatactaatcttctatcagttacatgtgtgtagtgaatatcttccagcttgtgacttgtcttttcattttgtgactctgatttgcattgctataagagaatacctgagactaggtaatgtataaagacaagaggtttatttagctcatggttctatagactgagaaattcaagggcatggctctggcttctggcaagggttgtgctgcattataacatgtggaaatcaaaggggaagccaacccatgcaaacagaggagagcctgagagcatcctggctttataacagcctacccttgcaggaactaatccattccctcaaggactaatccagactccccagagcaagagtgagagctcacgcactactgcaagaacagcaccaaggcactcctgagggatccacccctcaaacccaaacacattccacaaaccccacctctcaacatagccatcttggggatcagatttcaacattaatttttgtggggacaaataaaccacatccaaaccatagcattttgtttttggtgtttttttgttaaatagaagattttaggccagatatggtggttcgcacctgtaaacctagcactttgggaggctgaggtgggagaatcgcttgagcccaggtagtcaaggctgcagtgagctctgtttgctccagtctgggagatagagtgagaccctgcccccagcaccccttccccacaaaaatattttaatattttaattttgaagtggtcaaatctatttgtcttttctgtcattcaggggtttgtttttgggggagggtaggtgaggattaacttaaggaatctctaccattttttgagggaagcagacaaaaggaggcacacattaaacaaatacatcacaaattgtgatgcgtgctatgaagggaatgaacaaggcaatgcagcaagtcattaagtgtaacttcttctaaatagtctaaagcttgcttttttaatctagatttttaattctcttggatttggtttctgtgtatggtgaggcttggatataatgttatcttttttccatatggataaccaattgaccagcaccatttactgaagtctacaacctttcctgctgatgtgtatctcatgtgtaccacaccctcaagtttccatacatgaaggggccctgtttctggactctcttattttgttcctttggtctgtttgcctatctgcactcttttaagcaagtctgaaaacaggtaggcaagtcctgtctgccttgttgtttttcttcaaaattgccttggctattctttgccttttgctttttcctgtgaattgtaggatcagcctgtcaagttctaatgggatttttattggaattgcactacattttagattaataggagagaaccaacttttttttttttcttcctgtcttcccaggagtacaaagagaactgacttcttttcaatatttaggcttccatttatgaacataatttttcttttctttaatgtctttcagtgttttttttataattttttccataaaggactagcattttttttttttcggttagagttatgtctaatttacagttttcatgtctcttgtgactggaatcttttcttattttcagttttgtaactgtttgttactagtgtatagaaatgctaataatatttataaatcttgtgtccagccaccttgttgaactctttaatagttttaagtttgtctaagttagtttccattttatttttcttgccttgtattgttgggtaagatccccacatagtgctgactaaaggtagtagagggcattcgtctcttgctcctgattataatgggaaggctttttataacctgatcattaagcatgatgtttactgtaaggttgtgatagttacattatatcaagttagtgatattcacttttattcctgatttgctaggttgtttttgttagtttcagtcataaggtagtgttaaattttattgaatgctttctccgcatctgatttttcttctttaatatgatatgtttcattaatattctgatgttaagccttatattcccaggataagcccttcttggtcatagtagaggcagtgtgtctgtgtctgtgtgttttgttcagtatactgctggattcagtttgccagtatgtttgcctagtacttttatttaggatttttttgcatgtacattcataagaaagattgatctaaaattttattgtattgtccttttccagtgtttcaggataatatcatagcctcataaaattaaatgggtagcttcctgcacctcttaccttttttctttttcttttctttttcagagacatgatctcactctgtcactcatgctggagtacagtgctgtgatcatagctcactgcagcctggaactcctgggctcaagctatcctcctgccttagcctcccaagtagcagggactacaggtgcacaccaccagaacctgctaatttttaaattttttgtagagacagggttttgctatgttgcctagtctggtcttgaactcttggcctcaagctatcctacctcagccacccaaagtgctgggattataggtgtgagccattgtacctggcccccgcactagcccctttttttttttcagtccttaaaaggtttgtatagatcagagattatctgtttctttgtaggtttgatactacttgcctgagaaaccatctaggtctagtatcttttaaggtatgtgggggtggcagaataagcaattgttgttactaatttcttcatgtaggcctttaaaaattccttaagtcaattttggcagttttcctggtttttaaaaattattgttttatctgaatttttgtatgtttcagcatgaggttgctcctagtattctctcaaaatttttaaaatctctcctgcagttgtgtccccttcttcattatcccacagtgggagaatcctgaatattggcctaggattatgccgtgtcaaatctaaagtttcttttgggtttctgtgatgtactagaataacatctatttaatttaaatttcatatttaaattttgtttatatatttaaatatgatctgacagccttactacatattagggttgtggtccttttttcttttttttttttttttgagacagagtctcgctgttgcccaggttagagtgcagtggcacaatcttggctcactgcaacctccgcctcccgggttcaagcaattctcctgcttcagcctcccaactagctgggattacagacactcaccatcatgctcggctaatttttgtatttttgtagagacggggtttcaccatcttggccaggctggtcttgaactcctgacctcgggtgatccatccacctcggcctcccaaaatgctgggattacaggcatgagccaccgcgtccggccccctttttcttgattataaatgtaaatacatgtttattgttttaataattgggatacataaaatataaaaaagaaaatgaaaaacaatcatatcactattaatattttggtatgggtacaatttttgctatttatatacatcacaggtacaaatacactttttaaaaagtttgagaccaggtgtggtggctcacacctgtaaccccagcactttgggaggccgaggcgggtggatcacctgaggtcaggagttcgagaccagccggaccaacatggtgaaaccctgtctctactaaaaatacaaaaataatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagagactccgtctcaaaaaaaaaaaaaaaaaatacaaaaattacccaggcgtggtggctcacacctgtaatcccagctactcaggaggctgaggcaggagaattgcttgaacacaggaggcagaggttgcagtgagctaagatcgtgtcaatgcactccagcctgggcaacagagcaagactctctcaaaaaaaaaaaaaaaaaaaaacagtttgagatagtattgtacatactgttttctcacataatatgttgtaagtatttgcctgtatcgttaaatatttaaatgcgtgtttataatggctgtatattaacctgtgtcccatgtactagatagttttagcaaatacaccatttttgaacctttgggctttgtgtgtatctctgattccttatactaaattcttagaagtgcctttcatggagcaaaggatgtgttatgttttcaaggaccaccggggtgattaactggcaccttttcttctctttgcagcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttctatgatgtctcttatttgtgatctgtaccaagaaaatgcccaatggtaggagctactaaaggttgctcagggatcgtcagtctcctgtgtgcaggattccagactgttcacatcggtggtgacagaggaatgaccgagttccatcctcacatgccgtctcctccagtagaggaagccgtgggcctaacagagagtgggaagagatgttttccaagctccctggggtaattcggtatgctatgtcccagccctccacacactgcacttcatggtctgtctccgacagacagcaaggactgggcctagtagccccagagcaggctgacttagcaagggtgggtggatgtctggccagaggcaggggctgtcacagggacaggctggaactctgtggccacttggctttcccttcctctggcgagagaccctctcccatgggaggccaagaacatggatgtcctgtggcctgaccctcttggaggggagagaagatggtgtccttagagggcacccaaatccatgtaaataagccaaatgcacatccaggaatgtaattcctgccccctgtgctatttttgccctgttaacaaaggtttgcactgcaaggcaacatattgaaatgcatcctttccatcactataacaaaaggcaaaatcctctcagcactcggagcctcaaggtattgtgagattaattgcagtaataattaatgtggttaatagaagggattgcttcagtctgaactggctttttaccaagaaggagggatctgagttgggccccaaagggtaggtaaagttagtctgggtagagaagagaaagggttatttcaggagagtttacactggcatatccatgagacatccttttccagagggtttcctgacagccctcaaggtgagtcctagaga

SEQ ID NO: 16791 - DNA, 26257 bp, Human
ttaacctgctgaaactcttgaacctttatatccacttttccccccactttgtttatctccccccctcccccatgggagaagcagcaaaagaactgaaaagcctctccattcctgaatgaagcttttctgctctcctctgggaggctttttgggtattggtgccgggacagtctaggctcccccagggaccttggacccctggggtgttggggagcgactgggggtctgggtggctggcacatagcagtcagggggtcctgaagggcttgccccttcccgctctcgttctctgcagacagccggtgagtggggagagactggggggtcatgtgcagtatatttatgtaagacacccagacagagggcacgggtatttatataacccggcgtgggtatttatgtaatataggatgcgggtatatttatgttcctttcctaacctgcgggtttcctggctgccatgtgtggtctctgaattggtgttggcagaaagtggactgaggtgttgggggggggttgcgtgcacacccccccttaccccccaacagggctcactgtgtgtgcctgcttttctttcttccgttggagtgtacacactcgggaagctggacgtgtgtgtacgtgggatgtgtggcgtgtgggtttcctgcaaacgtggactgtgttcccctggcagcgtggcacctcagctgagacaggccaagcatatgggcagcggcccttgattgagagcccagagtttggccagctctggtggaggtccctgcctcgtggttattggtggagggctggtgagctccttgggagccaggtgccggggttccctgtctctcctgggatctgcccactgtccctggaatccatctccctcccaggctggcctggttgttgggggcagcacttggcacgggcaaggggctgatcttctgtgccagcacagctgctctgcagtcttcctgttttgccctgtttgtgagtgtgggagaccaccaggtgggacagccggagccctgtcctcggcgaggctgtaccatctgcagggtggtgtggggcaggtggcatggcctctgtgagcctgagtaccctgtctgtgaaaggagttccctcttgctagtccttgatgctggtcctcttgtaaacacccctccccctgtttactgcagtccctggtccctgtccccacggcagcactgcctccaggccttcagtttcctcctctgctgaccaggaacagggtgtccggacttttgccccaggccagagcagaggggtccctcctctgccccaggccagagcagagggctcccccctggccctgaggaaggagagaagctgctcacatcagaactcctcctcccacccatccggggcaggcggctaaaaccctggctcagtcccctttgttgttctatgagggccctcttaggagaccctcctagtcttaaaggacgccagctccaaacagtttatccaagcggctatgggcctccgtgtgaggtcttggtgtcatgacgtagagatggggaggtggctggaaggtggatggtcgagggcattcttttctgccttccccccagtaggggatgcgactttctcctgcaaggcgtgctgggcactggcgaggtctggcctctgggcaggggcagtacttgggaagaccaggccaggctgtgggagcctggggggtaggaggtgtaagagggctgatgcccgttgtgatcccttgagaagcttcttttgaggggcccctgaatgagcatcccccaaagacatgcttgcttggctgcttcctctctggccacactgaaacctgtcctcagcctgccttagctgttccccaggtgtgtggagtgcaggctgtgggccacctgacacctgcagaatgtggtcttcgagaatgcaggttttcgagttcctggtggctctgcctggccttggtggactggacccctttcccggctccccacgtcgctgaccctcatgttcctgcttcctctgcagcaagagtgagccatggagctacgtgtggggaacaagtaccgcctgggacggaagatcgggagcgggtccttcggagatatctacctgggtaagtgttcctagctccagctggagcccctggggccagcccatgggaccaagaggaggaaagaccccaggatttggggatctgaagtcagaatgtggctccaggggcatgatttgccccagggccatcccagatggggaaggaagcagcaggttgccgggaggcaggccagggggctcctctcgcaggccaggctgggcactggagggtatttttagctccagtttctgcaggagtcatgcggttcttttgtgcctcagtgtcccgggtcagctgggtcaccagctgggtgtgggaaaacccaggcggggttcacatcctctcccctgcttcctgggagaaggatattggtagatagaagggacttgggttgctgctggacccctagccaggcccccctctctatgtcctggcctcctggaacccagcccaggcaggctttgggatgacgcaggctcccctgtaacctcgggggtggggtggggggatgcggtctcctcattagggagttctctctctctctttttctctccggatgtgcttcctgttgaaagtatgagtatgctgtgatgttgcattttaaacaaatcactgacctctcagtcctccccttggcctgggagaaatgaggcttgcgcctttcagtgccacttctgaggggcacggtcatgagtcttggcccttcctttgtgcttattggtccaaagggaaggtatttagtgttggtgcttgtggattagcgggtggaggcttgaagttgctggagtgaggtggccagcccttctacgagttatcctcattcctgtccctgcaccctcagaagcaggctagacacacctctgtgccttggttaccctccttggaaaatgaaaatcagctctgtccagtgcagagaacaccaagtctgtgtgtcgtgtccatcagctcagaacttcggggtttctgttaccccatggttagggttccttggagtatgaaatgtgctaaggaagcctcaatggagacggggacggagactgggagttccctgaccacttccttgcagggtactttctgcagcccctagagatagtaccagattatttgtttggcacatcaggaaactgaggcacagatggtcaagttggcctcccaagaccgctctagaaaactggcagaagcagcctgtatgcccacagccctccacatgagtgagagcgtggaagacagaacatgccgagggagacgttagacgtctagctctgcgttctagacgtggctttgtgtggctgtgggaaggtcatgcagctcctctgtgcctcagtgtccccatctgtagtttgtgataatgctgcctgactgaccaagaactgttccaaggcagagatgaaatgacagatgggaaagtattttgtaaactctaaagtgccagccagatgtgcagttcattgctgagtgcttagtagatgagcctcccctatggacaccctggagctcagagggagggagagtgtgtggtgcagctggtttaaaggtttttctctgcgaccccaagctactcccggggaggcaggcatttggtaatatctgctagtgcccagcgcagtgggtgttcactgaaggctagtcaagcaaaccaatgagaaaatggggattgtgacatgcacagacatgcacagtagcctcacagcagaatagaaaaatgccgggatggccaggtgcggtggctcacacctgtaacgccagcactttgggaagccaagacagacagattgctggagtccaggagttcgaaaccaacttgggcaacatggtgagaccccatctctacaagaaaaatacaaaaagtagctgggcatggcggcacgcgcctgtaatctcagctactcaggaggctgaggtgggagaatcacctgagccatggaggttgaggctacagtgagctgagatcacactccagcgtgggtgtcagagtgagaccatgtctcaaaaaaaaggaggccaggagatatggctcacacctgtaatcccagcactttgggaggccgaggcgggcagatcacttgaggtcaggagttcgagaccagcctggccaacatggtgaaacgctgtctctactaaagatacaaaaattagctgggtgtggtggcacatgcctgtatcccaggtactctggaggctgaggcggaagaatggcttgaatctgggaggtggaggttgcagtgagctgagatcgtgtcattgcactccagcctgggcgacaaagcaagactccatcaaaaaaaaaaaaaaaagaaggaaagaaaagggctgagatgtgggggccagtccaggttcagatccccagcgtgttcctcatttgctgtgtgacctggagtaagtcaccatatcattctgagcctcagtcttctcatctgaaatgagtgtacccagctccttactgtttgtgaaattggagtgggtgtaaaggaccctcgtattattgaagctgttgggctgagcactgaagtctggagccactggctggaggtcaaagggcatggagacagctcttggcacagacttgttcctagacagcgcccatcccaggtcccgtcgctctttttgcagacaggagacagagaggcccatggctggagcggggacagcccaagatcactcagaaaatccagaatcttgtgtggtgggacctccctggggacaggacttcctgtttatctgcatagtcatctcattcattttaaaaactaagtacagatttactcctctttgtactggctctagagtaaattcgacctaggtttgggtgctggttcttccttttgtgagctgtatgcgcttgagcaggtgatgaccttgtccatccttggcttccccatctgcaaaatggggtcgtgcaaagtaatgaggtcgtggcgtgtaaaatacccacgtgtgctgggcccagcagtagtgctgtgcgctgcgcccccaccattggtcttagtttctagttcggagttgatttcgaagggtctgggtcctctgggtctgagtctggggaggcgagtcagactcctgactctcccatcttcactggtgcaagggcctcaggggaccctgccctgactcaccatcctgccagcaccctcctgggcccctgtcttgttggtttggggacagtggtgattgtagggcgtccccggccagccttgctggctccatttattcaacactctggccacattcttatccccagtgctctgccagggcctgactccagatggcctctgccggtggggctggatgcgtcctccaagccctgctttccaggatcacccgagggccagcacactatggatgtggcttctgccccttctccctctgcatcataaggggtcagccaagagagtggggcctgctttgttaaggcactgctgttgcccatgcagggtccagaggtggccaaatctgggcccatttgctagacttgcatcctggggaactctctagacctcttagagtctctggtcctcagctctgaaaggggtggcgaacagtgttgttcgctgacaggtggttccaggggtgagagttagtgtgggaaatactccaggcctctgatgggtgggaactgaggttgccgccgctgctgctgccgggacggtgggcttcatcccctgtcctccagtccacccatgtccccgattgtgtccatgtgtctgtgtaggtgtcaagtaggcccccgtgtgaggctggccacgcccgtggccacctggaacttgccaagttcccagcccctctagggccagccaagtccaagcccttttctgtgtccaagtttgttttgggaactggcattccctccactgtgtctgactcatggggcatcttctgttcctgaaatcgggcagttctagcttctaggccttcgcatgtggggcacccctgcatctatgctcagccggctcccagacacagcctctgccaggaagcctcacctggagtttgagtggagaaaaaacacagggactttggggactaagtttcaaattctggctgtgccccatccagttctgtcagaccttaggccagttacctaacgtttctgaacctcagcttagcggttgtaagaattaagggagctcagagaaaagcctggcggcttcctgatagaatttagaggccaccaaggaactcattggtggcaggacctgctgcagggggaggcagctctggcaggtttccagcacttgcgggggtcagaggctttgcctagcagcttgggtccctgtccctgggaagtttgtagcatatgatcatttgacctttggtgtctgtttttccacatgtcaaacagaaatgcaaacagtaggccaggcacagtggctcacgcctgtaatcccagcacttgggagaccaaggcgggcagatcatttgaggtcaggagtttgagaccagcccggccaacatggtgaaaccccatctctactaataatacaaaaattagccaggcgtggtggtgtctgcttgtaatcccagttgctcgggaggctgaggcatgagaatcgcttgaacccgggaggcagaagttgcagtgagccgagatcatgccactgcactccagcccaggcgacaaagtgaagctgtctcaaaaaaaaaagaaaaaagaaatacaaacagtagtactcgaagagtggagtaagggctcgaggggaagagggccctgtctaccactacctccccagcacctctcctccctgcacacatctgccgaatcaccaagtgctgcaggccctgcctccaaagtgtcaatcagtttctgcaccctgcccaggcagggccaccgtcagctcttgcctggtctctgtagtggccttcccaggccttccactacccctctagcctcctccagccctttcgtatccaccaggtagcctcaacagggtgatttttgtcccccaggagacatatgtcaagatctggagaccttttggttgttacaattcagggggaaaggggtgccctggcatctagtgggtagaagtcatgggtgctgttagactgtgcagtgcccagggcagccccacaaccaggaattctccagctccagtgtcagtagtgccacggttgagagatcctgtgatcacacacctgaacatggcccttggtgcctcaggctgaaggccaggatcttagccggccattcaagacccttcagatctcttccctgcccacctcttccactgtctttttctgccaccccatggttcccgctgcacctgctgctgttgggcctctgcttgtgccgtgacctctcttgtctgtccagtacagtcctgtttgggagccaggagcccttgcagcctgccctcccggaggctctcctttcctcatagcatggcttattccctcttcccctcctcccactgggtggacaccggctcatctctagcctaggggctgcacttcccaccaagccgaacatcatggagcattgactgtgtgccaggcactcttgtaagcatgtttgtctgtcagaacatcccaatgagccagatagtgtcatcggtttacacatgaggtacctggggctcagaggggtgaagtgccttgtccgacgacccctggccaggggatgtccgagtcaggatttgggctctagtaggttggctctgaaactcacacttcaaccgctgcactctcctgcctctctgctcatggggaaatggagcatggccaggggactctaaggatcctcactgtcccctggaaacctgtgtggctcatcccagtgacgagcattgatgtgtcaaaagctctttacagtttgcaaagtactttcattcctgttgctggctagattgagttattcattctgtttttctttttcttttattaaaaatccaaatactcaaaaatcaaaacacaaaaatgtgttaagtgaaagaagccagtcacaaaaaatcacgttgtatgattctgtttgattctatttctgtgaaatgtccagaaaagacaaatccatagagacagaatgtagattagttggggggcaggggatggagcgaggagataggaccttaccccactaaaggctacaggtgttttcagggtgatgaaaatacagccctcctgggccaggcacagtggctcatgcctgtaattcctgcacattgggaggctgaggcaggtgaatcacttgagcccaggagttggagaccagcctagagatggcaaaccctgtctacaaaaaatacaaaaattagccaggtgtggtggcttgcgcctgtagtccagctactcgagaggctgaagtgggaggctcacttgcgccccagaggttgaggctgcagtgagctgtgttagtgccactacagtccagcctgggtggcagattgagaccctgtctcaaaaagaaaaagaaaatacagccctccaccttcggtacctgtggggaataggttccaggatcccccccagataccagaatcctctgattctcaagttcctgatataaaaagctgtagtatttgtatataacctacgcgcatcctctgtatacttttttttgttttgagacggagtctcgctgtgtcgccaggctggagtgcagttgtgtgatctcggctcactgcaacctccgcctcccaggttcaagagattctcctacctcagcctcctgagagctgggattacaggcgctcccacgggagcaccttggctaatttttgtatttttagtagagatggggtttcatcatggtggtcaggctggtctggaactccttgcctggtgatccgcctgcctcagcctcccaaaatgctggcacctggccttctccatatactttaaatcatctctagatcacttataatacctaatacaatgtaaatgctatgtaaatagttattgtactgtatttttaatttttatattatttacctatttatttttgagacatggtcttgctctgtcacccaggctggagtgtggtggtgtgatcatagctcaccgcaaccttgacttactaggttcaagcagtcctcctgcctcagcctcccaggtagctgggaccacaggcacgtgctaccacgcctggctaatatttgtattttttgtagagatagggtctcactatgttgcttaggctggtctcgaaccgctggactcaagtaatcctcctcagcctcccaaagtggtagtactacagttgtgcatcactgcacccaacctatttcttattgttgtgttgttattttttattttctccccccacgtatttttgatccatggttgaatcggcagatgcggaacccacagcagatgctgatacgaaggtatcagctgataagaagatgctgtgttctaatttttaattttttttttttttttgagatggagtcttgctctgtcgccaggctggagtgcagtggcacaatctcggctcactgcaacctctgcctcctgggttcaagcaattctcctgcctcagcctgccgagtagctgggattacaggcgtgcgccactacgcccagctaatttttgtacttttaatggagatggggtttcaccatgttggccaggatggtcttgatctcttgaccttgtgatccgcctgcctcggcctctcaaagtgctgggattacaggcgtgagccaccgcgcccggcctgtgttctaaaattgattgtggtaatggctgcgcaagcttgtgaatatactaaaaacggtgagtcgcacactttgagtgactcaattggagagttatctgaattacatctcaataaaggtgttgaaagaaattgcaacttataacacagtatccagtgaagcgtcccccaccccttcctccctgacccacttagccctgtacagtcatgtttctgttcagtgtttctttatgtagctagagccaaacacagatacttagttccccacctttttaaagaaaactgaaatgagagtgtggaatatacactgttctgtgctttgctttttcacttcctgtatcttggagatctttccacttgtgtgcagagagagcttcctggttctttttccattgtattctgttttatggatgggctattctttatttaatcagccccctcaggagggacatttgggttgtttccaagcttctgctgttccaaacagcctgcagccgacagccttgtccccgccttgttttgcaccgtgctaggatgtcaggtaaactcccagaagcggggttgctggtcagggctgagtagcgtcaaatccccctccagtggcgactcagcagttgacgcctccaccacctgggaggagtgctcagcgcccccacagtcttgccgacagacaggtgtgttatctcgtaagacttttgacaatcctaggtgaaacatggtctttcacgatcatattaatttgcatttctcttacaaggaggttgggcatctttccctatgagtaaggcttttctattaatgatttctttctctgtgaagtgtgtgtttcaaatcctttggcctattttctgctgagtctttttctgactgatttgtaggagctcattacatattagctctttgcctgtgataagaattgcaagtgagtatgtctcttaggactttatttccggtgtttttgccatgcagaagggattcttttttcttttttttttggagaggaaggagcttttttttttttttttaaatggctttaggattttgaatcagggataaaaataaaagctttacctaaccccaaggctataaggcaattctcccttcttctaacatttcattgttatttcttattaaacgttgagtggatgcaaagaatacgtatagaatacctgcatggcctaaggtgtccctccctgggaaccaccgtctgacatttaatctttttcctttctttcgtgtttaaatctgtattgtccagtcttgttgcctgttttgatatggaaacaagtagaactgtgcttgcactcttctttttttttttttttttttttttttgagctggagtttcactccgtcacccaggctagagtgcaatggcacaatctcggctcactgcaacctccgcctcctgggttcaagtgattctcctgcctcagcctcccaagtagctgggattacagatgcctgccactgcgcccggctaatttttgtatttttggtacagacagggtttcaccaccttggctgggctggtctcggactcctgaccttgtgatccacccgcctcagcctcccaaagtattgggattacgggcgtgagccactgtgcctggcctcgggtagaatgttttcaaggtgcactcgtgtcgtagcgtgtatcggtactttattcctctttattgctgaataatattccgccgcatggaggcactgcattccattcatccttgcatctgtgacagatgtttgttgtttccaccctctggctgctgtgaggagtgcacccctgggaccagggtcattgtgtgaagcaggcatcctttcctcttcactgccgcctgggattccctggtgactgcgccactgttcctgttcttctgctgctgagcacttgggctgtttgctcctgtgtccatccttgtcctgtccccctggtgcacacgtgtttctgaaggatgtacactcaggagtggggttgcttgggcgagcgtttgtttatgttcagcttcacccaagaggtgcacaggggctgtgccaactcacacccacacctttatttcttatatacaaacttttcctctacttgagatttctcctggttgtggtgtgagccatggtgtcttttctcaggtggccagccggttgttcagggacattattaatgaacagtctcatcttttcctctgatgtgaggtcctgcctttctcctgtcttgaactcctcctgaggctgtgtccctgggggttgttctggcctgtttgtgtcctgttgcgacactgtcctactcctcctgctgggctcgctgctggccccaggaaggagacaccctgtcgcccagcctagccccagcccttcatctcatccacccatacagccagggaaactgaggcaaggtacactttgggcttggtctttcttgtgacttcttgagttgggcagtgggcccaggcagagagcggggccttggtgtgtgtgagggtattttcttagagccccttgagaagccaggagtggactgggggagacggggaggtgcaggcaggacctctgacctatgctggaggccagcagagccggggttgatctcaaggccgccatttacaggtcaggtgaccttgagctgggtctctagctgggtctctgttttctcatctctacaagggggttgagaatcgaatgagacactggattagaatgtgcagggctgcctctgaaggcatcagcattgactgaggggttgctgcggctgtcccatcctcatcctgtaggccagggtggtcctggcttgttctggtgtgttcggcagcccagccccattgggcctcttctgcacgtgccaccatctcaacccgacagacctcactgcctgaatttgctctaggactcagccccctcccttaggtggtctgtgagccttttgcatacctgacccttgccccactcacatcgggccttcttgtcgccccaacctgtggccctgggtagcccttgtgtgtcacctctgtccctcacagcgctgaccttctttcccctcaggaaccctttgccggggctcctttgcccccttcccagcctcccccaagagctcctcaagggcagatggccccgggcccggcacacgccagatctcagaaatgcttagtggggcgcctgggactgcctggcctttgagggtgaccctggtcccttgcctccctgccccgggcaggtgccaacatcgcctctggtgaggaagtcgccatcaagctggagtgtgtgaagacaaagcacccccagctgcacatcgagagcaagttctacaagatgatgcagggtggcggtgagcgcagggtgggcggcggcgggcgccgggtgggtggcggtgggcagccatgagcacagggtgggccgggcgtggctggctgcctctgacccctgacagaggccctctgcttgacccccagtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatggtgagtccccgtcccctccatccccagccagatgcctgtgggcccaggataccagccctgcctcctgcccccagaggatgccagaggatgggcctgggccaggggaccttgtccactggctatagaattgtaggtgtttatttattttttgaggcggagtctcactctgtcgcccaggctggagcgcagtggtgcgatctcagctcgttgcaacatccgcctcccaggttcacgcgattctcctgcctcagcctcatgagtagctgggattacaggcacctgccaccacgctgggctaatttttgtatttttagtagagacagagttttaccaagtgatccgcccatcttagcctctcaaagtgctgggattacaggcgtgagccaccgtgcccagccaagttgtttatttaaaatgtgatttcaggcccaactccagacctgccgagtcagggcctgggactctgcctggggtagttttatttatttatttcaaaaatatcatttaattgtaagaaatagagatgggggtctcactgtgttgaccaggctggtctcaaactcctggccttgagcagtcttcccatcttggcctcccaagatgggaattacacgggatcacaggcatgatccaccacgtctggcctgccctgggtaatgtaaagcctgcggtcggtcacacagacctggtcctgttccagaccagtgaccgtaggtgaacgccgaacctctctgagcctcagtggcctcatgtgagagtctctcctttgttggttgttgaggggattaggtgagataccattcagcgccttgccaaaacaggcccctctaacaggctgttgttaagtactaagcccttcatcagcatagggaggaaagcttcttaaaaatacaaaactgtagaattttgaacttggaatggaatgtggagatctcgtacaggggttttaatcttggtctgcaaaagccctgcgatgtaggctgaaggtgtgtgagcagagggtcgccagagcccctcatggtgtgaaactcaagaaaggtgcaggagatgttgagctgtgctgaacctggggccagagccagaggccacggcatgtggatggatattagtttgagttttaaaaactcgactgaaaaggtggctcaagtctgtaatcccagcactttgggaggccgaggcaggcggatctcctgagatcgggagtttgagaccagtctgaccatcatggtgaaacgccatctctgctaaaaatacaaaaaattagccaggtgtggtggcgcgtgcctatagtcccagctattcgggaggctgaggcaggaaaatcacttgaaccctgaaggcagaagttgcagtgagccgagattttgccactgcactccagcctgggcaacagaccgagactccatctcaaaaaaaaaaatatcaaaggaaagagggccatgtgcctgtctgagtttggcatccttcggaagccctgtcttttgtgttctgcctctgtcacctcttcctggtctaggcttcccccatgttccctgcctgcccctcgcccacatctgttgcctctctggctccctaagtcctgtgagtgtggggccgggcaggcaagccttccatggggaaccagttgcctttctagcagactcttcatttctggatcttcccattagctttcctgcaatactctctttctctgtctcacagccaacttggtgaactccccctttagagttcatcctgatgtcacattttccaggaggccttctctggcctgccccttagttatccttcatggtcgaaggcaggcctttctccctctgcctttccacctctgtggccccagcccctgcctggcccagagtgctaggcaagggcccctctgttgaacaaatggcccccctcctccccagatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattggtgagggagccaggcctggagcagtgtgcacccggggccactggctggggcccagctctctggagccctctcaccccctaccctgatggaggcccccaggctcttttctagtgagaaagtccccaccccgtctgcccccaagctcgtgcttattccgtgtccttgcacagtcgggtcttccccttcgtaagccaagctgtgtgtgccgggcgccttccctggccctgcttcctcctccgccctgttggtgcaggctggaagatacaggctcagaggtttaacatgggttgcttaaggtcatgcagcttagctaatgccaaagctggacttgaccccggccctgtctgatgctgaagcttgtgacctctccacggggtgggccaggcaagggggcagtaggtgccctctcatagtcattgaatgattaagtgcctgaactggaaaaactaggcccaaattaagttgagaaggccctgcctcaggcttcttctctgtaggaggaggataatagcagtgcctgtttaaaatgcgtgcagtgagcaacatccgacgtgggggcaggagggtcctggtgcattgtgaggagcatgacccagaggatgagttaggggcctgagtggacccctgtccctcacctagtctttgactctctgtgcagagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctgtgagtagcccagtgggaggggacatgcctgggggcccctgaggcactgtctaagggaaaggtgaggccatacaaagcccacgctggggctaggcgcggtggttcacgcctgcagtcctggcactttgggaggccaaggcaggtggatcatgaggtcaggaggtcgagaccagcctgagtaacatggtgaaaccctgtctctactaaaaatacaaaaattagccccacctgtaatcccagctactcaggaggctgaggcaggagaattgcttgaacctgggaagcggaggttgcagtgagccgagattgcaccattgcactccagtctgggtgacagagcgagacatcatctcaaaaacaacaacaacaaagcccacactgggctgccccacagcccttggcacctgagcagtaatccctggctctttgccactccttggcacagccagaaggcccggtttccctgtcctggctgttacacctgttgcttcccggcctacattcctgcctcatctcccaagggccctctccccagtgtttttgaggaggaattggaagttttcctcttcttgcttaggttgtgttagaaggtcccgtcaggctcttgcagtcctttgaatttatggcaacgattgatctgtgggccccagggtgcttggcgagggcagcggaagagctgtgggcatggatggctcctggatccggctacctggcagaggctcctggccactgttcgcaggtcttcccttgctctgaaagcagcagaggctctgctcacgggcaggctaggctttcatcacggtaggatagggaaggccatggctctgttgcctccttttcttgcctctcacagattggaagtatctagggacagtgggtggctaggacagtgctggctgcagggggtctgggagcgtgggcctcacagtggccttctctatcctctgcaacaccctccagccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcgtgagtcacctggaggccaaggcgggcttgggggactggatggggaaggccctgactcagagggccagagtgagctggtggcgggaggggctcccgacagacgggaggtacgagctggacagtgtggttgacctcactggggtcccagagccctccagcctcatccgtgctgacagcttgtgccaccatgggcagcagggcccaggcagggcgctgtctcccgtcggaacaaggaggatctggcttcacctggggtccctcctgggtgcccgcagcagggcatgggtggtgctggcggcgccccctgctgccctgattgctgcctacaccgtcctgctgctcctgttctgcacatcccaggtggctacctgcaccatggcccctcgggccagcctggacccagtcatggtgcttgctttcttcttggtcatgggcccctgggtctggctaggcagttgttctgtttccctcttttaagagtcccaggggtggggttgggtggggagcagcattggccggccgtacccagagctctggaatctgtgaaattgtatgtcttgtttcacatctcttctggaaaagggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaagaggctgagcctcagctgtgctttttgtccctttcaggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcactttgggaggccatagagggcggatgacttgaggtcaggagtttaagaccagcctggccaacatggtgaaacccatttctactaaaaacacaaaaattagctgggcatggtggtgtgttcctgtaatcccagctgcttgggaggctgaggcaggagaatcgcttgaacccaggaggcagagattggagtgagctgagatcatgccactgccctccagtggccaccacatccggcaaggcagatgggaccatttccttcatccagaacgttctgtggacatcactgctctaggttcctcccttatggagtctcacaagactgtctagccagcaagatctcttttccaaccaggccaggagcacctctccacccactgctgctggtctgaccgccttcctggaagtccctcttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctccctgctgtgtgtttcttgcgtcctatgggttggatgggaccatggagagtcgcccacttcttgcctcggggctggcaatggcctgagcctgctgggctcacaaagggcaggggctccagccctctgcttggctgctggctgcagggctccacaccttggagtgagtcactcagcctctgtatcccaagcatggaaatgagattgacctgcctcacagggttgatgtgactctgcccgcagaaggttcggcacggaggtgccacagctcgtgttcctccccaggctttgctgtggctctggctgagtcactgttggccagcctgcaaccgagtgggagcccagggtgaggaccggaggtcaggagttagagccccggtggtcccaggcctgcctgagaggcttctgggtgggaggatgggaagatgcatcttctagagtgttctaaggcaagactctgaacagtgacctcttggggtgcagagagcagagtgggactaggtggcagaggcctgggttcagaccctagctctgccctgagctgtgcaaccccgggcaggtcacaaggcctctctgggccttggtgcctcactaagattcagggatcattctggtcctagccactacttcctggagttgcttaaagacagggcccacccccacctcttggccagtctcctgggagagacatgggttgcaggaaccacaccctgtgcccatgagcaggcccccaactcagcccagagctctctcctccacagatgcggcccccttcctgccagccccctgcccttccctgtggacggccccaggatgaactaggtaacgcagtcgggcgctgcccccacatatgctcttctctggccccttctcacttcctcctgcaccaggggcggcagtggctggacagcagggcacctgggggcttagggtaccccttctgctccagctttgcctgctgggcctcttcttcctccgtggggaacgtggccccattttcttctccagctccccttgagcttctgtcccaaggcaggcggtgtctgtgggttccctgggcctcctggctgtggcctccactgcacctgccagaagccattgccaggtcccggcagggggaaggacagctccctgatgagaagagcccctggctaggtaccgggagagctggtctgagtcctagcccagccttccactagttttgtgactctgggcctgttcttttccccctctggacacccctagccagtctgctagaggcctctaaacagctttcctgctcggtttagcaaccttgagtagttaagggctcttggtacacagaggggggccagggcaggcccagccccaggtcaggagggccaagaggtgctcttgatcatcctgggcgcattagttgtcctttctctggctccatcccaggagagcagggcagactgacctccctctgcccccagactcctgctttctccttcctctggtggttgtgtggcttcgtgtctctgtgctgtgtgatcgtgggtcttggcttcccgcgcttgtcagggaggctggagcagaaggtttctgagatatccacctggcctccctccccttctgtgccctgcagggctgctgggcccagagcaccctggcctctggggctgactggtgtcttttcttgcatccctgcagggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggtgagcagggactcaggcagtgggctgggttcagggtgggtggggggctctgtttgtgcctactctgagggtggcttcccactctccctccaggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacaggtgagctgcccccctgccagtccctctgggcctcagaactgagttagagaccccccagtgggaggtcaggccgtggctctgttcttccctttccatcgacgctgcttgccttggagtgaaccccttctgttgagccaggacttggcctcatttaatcctctgaggtctgatgagccctcttgagcaaagtcattcaccaaggctcagggcagtaacattccctggcaagtggcacagctgggctccagtcctcgctgccaggggcccagccagggtgggcagcaggggctcagagatgaggtgttgctgctccctgacatcagggagcccccaggagcccctgtgagcattggcaagagcatggggtgtaggggcagtgaggtcccatcctctttggggctatgtttggatggggacacttgggaagggggaatctgtagttgcccagggcaggtggcctggcagaggtgggtgggagccctgccctcgtcctcctgcctgtgggcgaggagggagtcctgcgagagaaccctcattggccatctacttaggtagcaggtttgcctccctgggcaacattcttagctacagacagggacatcttagagtcactggaatcacacaggccttccctcagcttgaggggctgcctggaggtgggggtgggggtacacctcctcagtggggagagacttgccaaatctctatcgccagcggctaagggacttgacttgaagcttgtacctccctctctctccctccccctctctccctccccaccctcaaaagacaagtgtgccatttgaccatctcgggaagtgaggagagcccccattggaccagtgtttgcttaggtgagtccatgactgctgcagatgcagccagcccagccgacctagaagctcccagggccccagaaagagaccaatgtgttgtggaggggtgggtggcagtggcagtggcagatggtaccaggcgccccagaactctaaggggcctcaagtagtttaaaacctcggaggctgcctgacttggggccaagggtttctatgctcaggcctgacccctcatggattagtttctgctggaaaaactttttctgccctcggccaggtctctatctccttctgccttaacatattttggaaggttggttcccagcagagacggggccatgggctcacactctgacctctcccacggcattagccctgtctcagcctctgggctgttacgcaagttaattcctgcacaagactcacaacagggctgtggaggaagcaaaggagccctttttatgcctctgtagtaggactgagagaggccctctggccagcgtgagcctgctggttcttcccggactgtaccaggccttgaggcggggtatggaaacgccccactctggggcctggcttggggaaggggaggcggcaggggttctttgggcttctcgagggtataatctgagctctctggggaacgtgtgtccatttgtaggcagtagtccgacacgtcgggggactcaactttacactgggacaatctgtgtgtggtctgttttgtagaaattcatccacacaagagagtggaggcatgaacagggctggccttcctcggatctcaggcccaggaaccaagctgtccatggcgggctgggcagatatttgggggtggggtggggagatgctcaccaggagggcagagaagggagagaatccgtttctgtcacatgaagatggatctcctagcgtgctgggccttgagccaggctctggggcccagagggagatagaccaagggacgagaagacaggagtttggggggccaagtgcagtggctcgcacctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacgctgagacaggagaattgcttgaatctgggaggtggaggttgcagtgagccgagatcgtgccactgcactccagcctgggggacagagcgagactccatctcaaaaaaaaaaaaaagtagccagagacagctgtgtacctcacctgtcttttcccttctcccttctagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgatgcaggcagccctttgtccacctctgtgcccttagggcctctccctgcagacccggaagtgggtcttgctgggagcagcaggagtcagtgaggaacaagccctcgccctgaaggcaggtgtggctggggccactttcagaacacttgggctgtggttgggatgtccgggggctttgaaaacacgagtgcacacaggtgccacgccacaggtgccacgcgggggtcttgtaaagagggctggggtggggctgagagcttccccctgcacactccaggtgtgctgatggcctggggcccctctttgagaagcaaggccctaaaagctcttcacacatgattttatccacacaagtatcctgagttaggtcctgttaatagccctgccttcggacaagaaactggtcctgctgtaaaatatcttgcccacagtcacagctctggtggcagaggcaagacgagccgaggtcatctcgctgtgggggttgtgggggtgctctgaccctctccactgctgaccctggggctccatgaaggagagtgctggagcgagctctgatagtgactctggatgaggtccttcagtcaagccttgataaaagggcagcgctcagcctcgcctgccttggtctcaccagcttggaaaagaatctgtccatctgcatttacccaacacagtttacttcctttcgtcaaccgaagagccattattgccacagtctcaacccagaggcaagacggaagctgtctggctgataggtctgcctgggaagcg

SEQ ID NO: 16792 - DNA, 55114 bp, Human
aagcatacttaacaatctttcatggcttctgagttttgtagcatacttaaaaagatgtttcttattacaaagtaattttaaatatcccatattttcttctagtacttttattattttattgttcagatttaattttttgatctgtctggaatttattttggtataatgtgtaaagtgtggttccaattttatttttcttccagatggttacctagttgttctaacactattcactgaattcatcatttctccactgatgtgaaatgccaccttcatgatattcagagtttttgtatgatacgaaagacaatttttttggttccgattttagtggaaagtcttcatgtgcactttttaactgtcctagagtttgttgttgttttaaatatcttaaaagttgtctctaaccatcgatatgatacccagataagatttttctcctcccttcatgaatttgtcattacccagctcattttagtttttttaagtgtactgcacacaaccttcaaatattatgaacatttctctctcccagctgtcactacaccaaactacatatgttatatttccctaaatcatcttgctgtgctctttgcagctcttctgtagactgttgatgtcttcacctaacgagttgctcaaaagttcccataattatttaggtgaggcctcagagcgaaagcctttcaccactatccagttcctcccccaaatgggcattcatctccatataacaaggacgactgtgtttgggggaaaataacagatttggaagcacaatggcagttatttgttggctcttaaaacaatccacctgttgggggggtgcgtcctacacaaaatgccaactgctattgtgggaatgttttgctatttattccaccaaaatgattcagacagaaaaaacaaaaaggatcgccctgtactaggtcttgaacccaaagaactgtttgcacagagattcatccaagatacatcacagcctccacctcggcagctgctctctcaaatgtttcctgactctccccaagtcagtctccgcgtgaggggaggaggaggatgctgccagcgatggcgctgctggcacgaaggctggcctgcgacttctatttaaaagctgaaccaaaatatacttggcgtctgtggtctatttaaaacttcaagttaagacagagaaaaaattactctccatcctgaatgggcctcgggtgtctcaatcacagacaagagtggcaaatggtgagagtcagaaagtgggaaattaggaacgctgagggagcacggccaaactctgaagccagcatgaaaacctggaggtgaaaagagaagccatgggcagcgggggcggggggaaacgggcccggattcgaccttctaagccaaggctccatctgcaaccctcgcgaccaagacctatcgccaaagtcagccacctctgctcatcgcccctcccccgactcaaggctacctcctcagaaccccgcctcagggtcttctcccggactttagcgaggtgctcagctcgagggacgccccagctcaacggtctcccttcaaggccccgctcctcagcgcgctccttccacagcgcccctccctccctccctccgtcatcccagctcgccacccgctggggctcctcttcgttttccgcccctcagccctcgccccgccccctcgccctgagccccctccaggccacgccctctggtccccccacctgtgagcccgctcgttccccgcccttcggtcttcgccccgcccccattgctccccgcccctcgtcgccctctgtaggcctgctccctccccgcccttccaccctcaccctgcgccccgccccggccccttggtcctcgccccgccctcctcgtttggcgccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgaggggggtaagtggcaaaaacgaacagcgtgcgaagactctgaggggacgctcgttttgagaaggcgcgcttccctttctcgctccttttttggggtccctgggctagtgactttgagcgttccgctccgacctttggggaggaattttagtgatcttgagggatttccaacctcattttcaatcgaatcggacctgagtctaggagagcccgcctcatcctcctgaccagggaatccggtgtcaggaaaatgtccggcggccgcagggggtctgcccaggcctcctgctgagggaggcgtcgagggcgacccgaccgcgctgctgcccccaccagaggggacagctgggtcgtcttaaaccgggggattggggagccctactttcaatccaacggttcagtctatcaacggctccttgagagatgggggacaatcttttcatttcatcacggggagaagaaatgaatgctgtttttctcttcgatggggacagtaaatgtggaattggggtactcatagctagccatctgaaggacagtgtccccgaagatcccatccgaacggtctcggttgccttccatcctttgccgtttgaggtgctgggtggtaggaccctgctcctgccttagtattaatggttcgttccctttgttctagggtccaacccctgactttggtatcaaatgaggaaatggaatcgaccaagaaaaatgatgatttggaccgcattttattgtaataaataaacacaatcacgccttgtggattcctgagatttctttttgagtctacaatgttaaaaactttaactgcttatcagccttaatataatattatgatccaccaatttttttttttttttttgagactgagtctcgcactgtcgcccaggctggagtgcagtggcatgatctcggctcagtgcaacctccgcctcccaggttcaagcgattctcctgcctcagcctcccaagtaggtgggattacgggcgcccaccaccacgcccggctaatttttttgtatttttagtagagacggggattggccaggctggtctcgaactcctgacctcgtgatctgcctgtctcggcctcccaaagtgctgggattacaggcatgagcctccacacccggaccaccatatttttaaatcttaaaaaaatcatgaaactagtaaatactgtgaaagaaagtatagctaatgttctatgaaacaaaaaggtggatgttacaggagtacccattcataatcagcaggcaggaaggcattcatcatagatgagaaaaatagaatccatttattgaggacaaagttggaggtgtcagggaggacacaaggaagaatgatataatgtcaaggttcctagagtattgttgttaaacataaacaagaaaggttaaaagcaatatgcaattctaaataacattcaaggcagtaataaagtcatgattagctgtgcaatggaaaccagatgataagtgatcactgttggggaaagagaagaaactaaataagcaccccccaatttgcccctcaggcatctgtgtgcatgtggggacacacacacacatgcacacacacacacacacacacaagaaataatgtcacatgtctcgcagaaagaagataggctggcctcatctttccaagctaaatgcttctcttactgtccttctagtccttgttgactttgaaatgaaatcagaggcccctggacaaaggactacttcttacataatatttcttattttcccagaagtgattatttttctgttgcccacttttcaatatgaaggaggatcaagttgtggcggaagaaccaggattccaagatgaagaggtatgactaaaatgttgaaagatatatagacattcgatcattccgcaaaaatcaagttccttccctgttagctactatttttagaagctgaaagtagaaataacacatagttatatattgcaaatatgtaacaacttgtttggcaaggatgctaagattagctacttagcaactggtatgaaagtattttaatgacttaacagctggtatggccatactggtacctacacacacgggtaccgaatagcagcctggtcctagaggaaggagtttaggatctggaggggaagagggttgagaaaacatatttaaaatagttcaaatgttgttccagtcctttgggtaaaggttttaaaattttagggaggacatgacaaaggtaactggcttcccagccctttcaatgttggtgcttcttctgtgtttgaaaaacggtattgatccttcctcaatctctagagaagcggaatttgaggcattttggagtgactcatagtattgaattacctctttaaaagatgtgaaatagctggatatgaagaatcaaaacttcattttttctgtttcatctcctttaggaatctttgtttcaagatattgacctgttacagaaacatggaattgtaagtagtttttcaatgctgtgttaaattgtctgattcaggatttctcagcatcaaccttatggacatttgggcctggataattctttgttgcaaggggacgtcctgtgcattgtagggtgtttgcaacatccttggcctctactcactcactgcatgtcagtagcacccctgcagctgtgacaatcaaaatgtctccagacattgtcaagtgtatccagaggacaaaattaagttctatatgtcaggcgactggaataaatgatgttggcagaaatccagcctttgaataatgacctgggtggatttcaacagcaatcagttgatagtaaaactgtgctgacattatctgttgtagccctaacatttaatctctttcagtggttttagaaaatagaagcaagagaaaatcctggtcctttggtgatgtagttatttgcattctccaggggcagaggaaaaaaaaaatctttacaaatttaaaagaacatgttggtaatgaagttctgtagaaggaaggagctgaactgagggggtgaatgtgtgataaatttgttagcttttccaccaacaggcttttcttttgaattccttgttacattgccatggtctcactaacattcttgggaaatcagggcacagtcagaacatttggcagcctgctgagtatgttctactcagatatttccagaacatttggctacatggtgggtgggttccacctggcagcttgtataaaattggcatcatggtggaaggagatggacacagaaacacatgacatagtatgggagccttgcaggctggcatcttatcagtctgctgtgcccattctttaatttacagaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgtaagcaaaatccattctttgctgttttagcttggcagggccttgtgaatctttataggctttctcatgaaaactagaaattattgtgggaactgagttcctgtagatcacagtatattatactccccatgttaactttttatcacttcagtttcaaagcaacagcaattgatttctgaaagatgaaggtagggattaagagacctggaacactaatgaaggtaattatttttgccaaaactttttgtctctctttatattactttttctggctgtctctgcctttccttctcctttccttttttttttttttttctgagacagagtcttgctctgtcgccaggccagagtgcagtggcgtgatctcagctcactgcaacctccacctccggggttcaagcgagtctcctgcctcagcctcctgagtagctgggactacaggcacacagcaccacgcccagctaattttgtatttttagtagagacgaggtttcaccatgttggccaagatggtctcaatttcctgacctcgtgatctgcctgccctggcctcccaaagtgctgggattacaggcatgagccaccatgctcggccttcatttttattttttacctttctcctcctcagttttgtcttgtctcctcaaatatcatacctatggctgttgtgaagcactgagtaccaaagaagttgctctctcctggtataggagattgatatatagccaattgatatagccaattgataagagagcactggattagaaaaagaccaacagtggttgggtctacatatgtgcagttgagatagatatgaccaagcatgtgctcactgaagcagctgagctaagctaacccatactgatgcagggcaggtgagcccccaaattgaggcttaacctgggagggttcttggctttgcccaaaggtgagccagtggtgttggacagcaacttttgttgaagcagcccagtacagtgcagcagaggtactgctccttgcagagcagggctacctcataggcagtatgcccagaagtagcagctcagaggcagttttgccattatagttatacccacttttaattacgtgcaaattaaggggcagtttatgcataaatttctagaaaaagtggtaatttctgggtcattgggtcattgcaatggaaaggggcagtaacttccaggtgttgccatagcaatggtaaactgacatggcacattggtgggccatgtcttatggaaagttgcttctgccctggaccctgttttagctagttctcaatttggtctggtgtctgagccccacctctggagtcaaatcccctctcctaccttactactttctagcagggcccactgactgtgaggggcctttgcaactgccaggctgccagacaaaagcctatatacctttgacccaagcttttatgtagagcttttgggaatcactagaggtaccagctcttgaaataggaaagcaaagaaaggtagtcactaagtcttcctcttcatttaatagcaggcctctccatttctctattggtatgtgagggtctcattcccagtgagtctgagaagctctcttcaccaacggccatttggtttccttcttcagaggcagccaaggcaggagagtgatgcaagtggcagtgtgatcctgaacttggaggggactcaaccgaactgaatcactctgaacccagctcagttgctctagcttctgagtacactcaggcagtgtacccacaagtcaattccacaactgccagggtgttgaagaaagccctggagcagtactcagggtttgggaaactgctctatgacattagagttgttttctttggaaattaaatcttattaccaaagaaaagaacctctctctttctcaagcacccactactgcaccaagaatcttctcctttcttagcttaaactgtttattcttttttatttgtattttttaagagacgggtatcaggccaggtgcagtggcttacgcctgtaatcccagcactttgggaggctgaggcgggcggatcatgaggtcaggagttcaagaccaacatagtggccaacatagtgaaaccctgtctctactaaaaatacaaaaattagccaggcatggtggcaggtgcctgtagtcccagctacttgggaggctgagacaggagaatcacttgaaactgagaggcagaggttgcagtgaggcaagatcacgccactacgctccagcctgggtgacacagcgagactctgtctcaaaagaaaaaaaaagagagagagagaagggtatctcactatgttgcccagtctgggcttgaactcctgggttcaagtgatcctcctgcctctgcttctgaagtacatgggactacaggaatatgccactgtgcccagttttatttattcatttatttttgagacaaggtctcactctatcaccctggctggagtacagtggctcaatcacagttcactgtggccttgacctcccaggctcaagcgatcctcccacctcagcctcctcagtagctaggactacaggcatatgctaccatgtccagctaatttttaaaaatttttgtggaggccgggcctggtggctcacgcctgtaatcccagcactttgggaggccgaggcaggcggatcatgaggtcaggagatcgagaccatcctggctaacacagtgaaaccctgtctctactaaaaatacaaaaatattagccgggtgtggtggcaggcgcctgtagtcccagctactcgggaggctgagtcaggagaatggcgtgaacccaggaggtggagcttgcagtgagctgagatcgcgccactgcactccagcctgggcgacagagcgagactccatctcaaaaaaaaaaaaaaatttgtggagatgggggaggggtggtcttactatattggccaggctggtcttgaactgctggcatcaagcagtcctcccgcctcagcctctcaaagtgctgggattacaggtgtgagctactgcacccagttgtttattcttagagatagagaaagtgattgagagagagagagagacagagagagaggagagaaagaaaggaagttaatttcataatacggtggttctaaacactgatgtgtatcagaatcacctggtgtggctaataaagaaaacagaagcccagacttggctcactcaagtaggataggacctgggcttggctgtccccattctccaagttctccaaagtttaagaaccacagtcatagtataaaacaacaaagagggacacccattagactacattggggcccattttcactagtcctccactgcatcagctgtacctttttaatcagtcaataagtagtatatctaccatgtgaaaaatgttgtctcaagaataatgaaaactggaatttctgtgccccttgaaacttctacagctggaaaaaaaatgatgctgttgaatgaaaaaaagtgaattgttagtaaaataccctctgctttatgccataattatatctcatttggctgggcacggtggctcacgcctgtaatcccagcactttgggaggccaaggcaggtggatcacctgaggtcaggagtttgagaccatcctggccaacattgtgaaatcccatctctactaaaaatacaaaaaattagccgggcatggtggcaagtgcctgtaatcccagctacttgggaggctgaggcaggagaatcacttgaatccaggaatatgtgtatatatatgtgtatatgtatatatgtgtgtatatatgtatatgtatatgtgtatatatgtatatgtatacacatatatgtatatatgtgtatataacgtgtgtatatatgtgtacatgtatatgtgtgtatacatatgtgtgtgtgtgtatatatatataatttaattttcacagctactccttgaagaaacactgttgcatgtttgacccaaaagaggaagctgatgtatagcaagattaagtagtttactccatatcatagaactaataactattagagacatgatttgaacctagaaagggcagctctaaagcctgtgttcctaaccataatcttgtactgccttcaaggacaagtgaactgtagcttataccaaatgatgatcttaataactgagtatatcattttgggcaacatttgaaaatacaaccatgatctttaaactctttttgaacatttccttttatctttctgtaggaaccaggattcttgactgcatttgagtatagtgaaaagaggaaaatggttttccatatcaccaccgggagccaggaatttgagtatgtatcttacttttttataatcactaagcataatctttggaataccatgtttcttttcctctttctggttacttctactataagtagtagaagtagcttcttcatttgaagtttgggtttgtttgtttttttttctaaatgataactgaaacaaattctagactgcttggaggagcaagattaaatgtcttacaagaaattcagacccaaaatctagtttctgaatcagccaatattaatctcaaaccacttttaaaaatcagtttaacttttcatttactttccttctccatatgaaggatgtttcattgcacattttgggtttactcaaaaagcaattgttagattaaatatttcagaaatattgcagttatttttgctcttctgcaggagaagttttaacatccctttttatttactcttttatgatccccaagacatatcatcatcttctcaatgcaagtttactaaaatgtgggttttttctccctaccttactagaaagaattagtgtttcatgtgttacagcagtgcccaagagcatttagaacaaaagcagtatttcctctaagtatttctcaaaatgctggcctcacaagatacattaagaaaaaaaggatttcatagtcaaatatacctccacttgaacgtctaattgatagctcagacttcacaggtccaaaaatcaaacttctgacctttgccccaaatctgcttctcccaaagtctccctcatcttagatctatctctttcctgatcctctgacctaaaacctgggtgttatccttgacatcttttttctctcacacaccctaactctaacccattaataaatcctgtctgttctaatttcaaaatatatttagtcagaacaaacctcccagtttcctcaacaaataaattacaaggaggaaaaaagagatggagtcagggagaagacctatagattaaagagatttaaaagacatatcacctggccgggtgcagtgggtgacacctgtaatcccagcaccttgggaggccaaggctggaggtggggaggggatctcttgagatcatcctaacggcaaactgagaccttgtctctacaaaaaaaaaaaaaaattaattagctgggtgtgatggtgcacacctgtagttctagctactcagcagtctgagtgagatagaaggattgctagagcccaggaggttgaggttgaggctctagtgagccgcgatcatgccactgcactctagcctgggtgacgcagagagaaaccttgtctgaaaaaaaaaaattaaggaattactaaatttaagtgtgatagtgggaatatggttgttaaagatgagagtcttcatcttcatcttttagggatacatactgaaatatttataatgaaatgatatgttgcttagtatatgcttaaaataatatgggaagggaggtaaatggttagtggtctatatgaaaaaagatttaccctgagttcatagttgacgattgttgaagctgagtgatagacacgatggttcattattttttttctacatttgtttatgcttgatattttctataataaaagattaatatataatatatgttatttttatgtgtatatgtgtgtgtgtacatagagagtgagaatataattcaactatttcttaccacctctactgttacctcactggactaaactaccacctattaatatctcccctggattattataataacctctaattaacctccctccttgagaccttgcccctactgttttgtttttttttttaattcactaaagagccagaatggtcactttaaaacataggttaggctgcaatgcagtggctcataacaccctgatgattccccctctcactcagaaaagaagccaaagtcctctcccatctctaatatttcacttttctagttttctatgtaccagccatagtgacctctttgctattcccagaatatgtcagatacactcctgcatcagggcctttgcactttgtgctgcctctgcctatcatattctttcctcttagatctacatggcttgctgtcatctctttcaggtcttggcaaaaatgtccatgtctcaatgagaacttctctgatcactttatttgacaatataacctcctaactttcatactctgtcttccttgtcccctttcctggccttatttttatccataccatttaataacatctgatgtactacatattttacttatttgtgtttattttttattttatttatttattttttttttcagacggagtcttgctctgtcacccaggctggagtgcagtggcatgatctcagctcactgcaacctctgctgcccaggttcaagcgattcacctgcctcagcctcccgagtagctgggattacaggtgcccgccaccacgcccggctaatttttgtacttttagtagagacagggtttcagcatcttggccaggctggtcttgaactcctgatcccatgatccaccgcttcagcctcccaaagtgctgggattacaggtgtgagctaccggcgcctggcctatttgtgtttattatctaatctctcactagattgtaaacttcgtgagagaaaaaaattctgtctcttttgttctctagtttatcccaagtgcacaaaacaatccctggcataaactaggtgtgcaataaatatttgttgaatgactaaatgaatgaataaacaaatagtgaataagtttgagaagtaccatatactatatattcttcttgaagagtcacagcgcacactagcctgtgaaatcctgcagtgacacaaaacacctgttttggcagggcacggtggcccacacctgtaatcacagcacttcgggaggccaagatgggtggatcaccttaggtcaggagttctagaccagcctggccaacatggtgaaaccctgtctctactaaaaattaccaaaaaaatggctgggcacggtggctcacacctttaatcccagcgttttgggaggccgaggcgggtggatcacttgagatcaggagttcgagaccagcctaaccaacatggagaaaccccgtctctactaaaaatacaaaaaattagccgggcatggtggcatgtgcctgtggtcacagctactcgggaggctgaggcaggagaatcgcttgaacctgggagatggaggttgtggtgagccgagatcgtgccactgcactccagcctgggcaatagagtgagactcagtctcaaaagaaaaaaagaaaaagaaaatacctgtttaacccagcattgtcccagacttttaaaatcacatacccttttttcaagtaaagttaaggaagaggcttggagaaatcctacccctaggcaaattggtcaaaatgaggttgatcaacaaaacacttgattcaaatgacaatctgattttctttagttactctaccacatggtggtctaagaaccactgggctaaagaaataattactgttattgtgagttttctggtgcccttgatgtttgctcttgagaacagaaaagatcattcaggagctaggtttttttttgttgtttgtttgcttttgagacagagtcttgctgtgtcgcccaggctggagtgcagtggcatgatctcggctcactgcaacctccgcctcctgggttcaagcaattctcctgcctcagcctcctgagtagctgggactacaggtgtgtgccaccacaccgggctaatttttgtatttttagtagagacagagtttcaccatgttggccaggctggcctcgaactcctgacctcagatgatccacttgcctcggcctcccaaagtactgggattacagatgtgagccactgcgcccagccaggagctaggtttttaaaaattaatatttaattaattaaaatattatacatttttccttaagctttaagtccctttataaatctagcacattttaagggtgcttttataacaagattaaattctcttaaacattttaattatgtttatacatttagtgtattgtattttctttaagaactttatttgttggccaggtgcactggctcacacctgtaatcccaacactttgggaggctgaggcgggtggatcacaaggtctctactaaagacaggatcaccctgtctctactaaaaatacaaaaattagccgggcatggtggcgggtgcctgtaatcccagctactcaggaggctgatgcagagaattgcttgaatccaggaggcagaggttgcagtgagccaagatcacgccactgcattccagcctgggcgacagagtgagactccgtctcaaaaaaaaaaaaaaaaaaaaaaaagaactttgtctaattatctaattattaacagcaaaatcttcccaattacctaaatatcttttgtaactcaaataaatttagaagtatagtgagttgtaggcaccattaaatgttcaaatactatttataaaattagttatcaacttgaaaattgaaggaatgtaccatttaatcagtcagaggccaatccattacaaaaaggtcaaattatcttaaacgttaaaaggtctcaaatagcaaatatgcacaggttattaccaaatttatttatttatattctattttattttttgagacacggtctcactctgtcacccaggctaaaatgcagtggctccatcacggctcactgcagcctgagtagatgggactgcaggcacaggccagcatacctggctaattttggtattttctgtagagactgggtttcgccatgttatccaggctggtcttgaactcccaggctcgagcgatccacctccctcggcctcccaaagtgctaagattacagacatgagccaccatgcccatattgccaaatttaatatgaaaatagtaatctatgggtttgatttgtgtctctatttttaaatctccctatatttaaaaacactatttctacacttaattctaaattttcctgagtctcaaaaaggaaacaattgtgctatcccaaataatttggggtatcctcacaggtaaattttggggttaccttttcagctgattgagattacatatcaaccaggaattttgtctgggattttccagaggtatagctttccagggtaatttttctcaggaagaagagggacaaataaagctttctttaatagttgctagcccaaccaccatggcacacgtttacctatgtaacaaacctgcatatctggcacatgtacccctgaatttaaaataaaagttgaagaaaaaaatagttgctgggcctataagatttccaagtgtattccctccaaatgggttgatcgcttagcccatgtcctttagatttaagttgtgcaggtacactatctagatttttcttttccttattgaagtctgcagccctcactaaatttgtggataacttccaacattgtttcaatttacatttaaattgctctcttaaactatgtaaatgtaaatgtattggattatctatatatcttaaatttttgtctgacctgtgatcacatcccaaaaaatcatgttaatagactacatacaaggtttttaaagtgcccctaccaggtcttagcacaattaacacaattaatatgtgttgcatttaatgaatgaatgagatcatgacttaaatttaggccttttcttattcagagctttaaatgcactacaacattgggctaccaattaaatgtatgctgtcaaaatctgacagttactcttctaactgctagcattacctacaacatctttgacatttactattctgacatgtcctccataaaatttggtttatgtgagataacctgaccataatgacaatcactggattttcctaatacctgtttttcatatgtttttcagtatattaaaaactgaagccgggcatgatggctcatgtctataatcccagcactttggaaggccaaggtgggcagatctcttgagcctcaggagtttgagaccagcctgggcaacatagcaagaccccagccatacaaaaaataaaaaattagccctgtgtcaggtgacagaacaagattctgtctcaaaaaagaaaaagaaaaaacattgaaaattcaattgactatagaaacatagttccagcacaatattaaatacccaattaataactaagatgggctgggcatggtggcttatgcctgtaatcccagcactttgggaagccaaggcaggcggatcacctgaggtcaggagttcgagaccaacctggccaatatggtgaaaccccatttctactaaaaatacaaaaattagcctggcgtggtggcaggcacctgtaatcccagctactcgtgaggctgaggcaggagaatctcttgaacctggtaggcggaggctgcagtgagccaagatcacgccactgcattccagcctgggcgacagagcaagactccatctcgaaaaaaaaaaaataataataataataattaagacgatctgtaactccaattcaattctaaagactagtaagacataaggccttgctaacccatttactatttttttaagttttttcttaaaataatttattattattattttttaagcctacagcatgcagtattcccaggttccatttactattgaagtaagaacgatagggcttatcatttgttttgctgatccacttgcccatacacaatagaacctgtgatctagcaagtggcatgctatttgttcagccaagaattgctgttcatgttctgtagatagataggtagatgatagaatagatagatagatacatagataggaaggatactaatgatatgaatactttctcctctcttaatatttctatttctattcctgttactaatgctttctttctatttccagtaagttactaggaggtggaattgaaagtatggcaattacagaagcttttggaggtaggtagaaccttaatattttgttaaatgaaatattatacacacacacatacacatctatgtgtatacatacacatataattaaataaacaaccaataataaattgtaagtattttggaacttacaaaatctcaattatcataacatgagatcattctgtactgcaacgaaaatatatatgaacattaacagatgggtcttatcaacacttttcatcttttatttgtgattcctatagaagataatagatttttttttttttttttgagacggagtctcgctgtgtcacccaggtccaggctggagtgcagtggcgcaatctcggcttcctgcaagctctgcctcccgggttcacgccattctcctgcctcagcctcccgagtagctgggactacaggcgcctgccaccactcccagctaatttttttgtatttttagtggagacggggtttcaccatgttagccaggatggtcttgatctcctgacctcggccttccaaagtgctgggattacaggcgtgagccactgcgcccagctgataatagattttttttcacttatttgttcaaaaggtaattgaataatgaggctgattttatttctaggcaattaatgttccatgaacatagagactagattccctcttccctgattatatcctctatttttttttttaaataatagataaagggtctcgctatgttgcccaagatggtctcgaactcctggactcaagcaatcctcccactttgacctcccaaagtattgggattacaggcatgagccactgcacccgtcctatcctctatttttaaaaagcaattcatgcatagctacactgtgtatcacatctgggaattccagtatttgctgtccttggagaactaaatctgttttttttttttttttttctgttgacttgggcactaaatctggttttcattatttctgttgactcagtcttagtggcttaccttcttctgtatttattggtgtttctgagcttattgtttgattttaatctatgaaagttcaatggacctggattggtaggtaggaaagttttcctccagaacgaatttgcttttgctggtagctaggggatggcaccagtttaagactacttcagctcccctttaaggacctcagttcagtaggggaaccccaggctttctttcctgtggtggggtctttattttattttcatttatttatttatttatttagagatggagtcttgctctgtctcccaggctgcagtgcagtggtgccatctcggctcactgcaacctctgcctcctaggttcaagcaattctgcctcagcttcctgtgtagctgggattacaggcaactgccaccacgcctggctgattttttttttttttttttttttttttggagatggagtctcgctctgttgcccaggctggagtgcagtggcctgatcttggctcactgcaacttctgcctcccaggttcaagcaattctgcctcagcctcccaagtagctgggactataggtgcacgccaccacacccagctaattttttattttttagtagagatggcatttcaccatgttgcccaggctggtctcgaactcctgagctcatgcagcctgcccgcctcggcctcccaaagtgctaggattacaggcatgagccaccatgcccagctaattgttgtatttttggtagagatggggtttcaccatgtttgccaggctggtctcgaactcctgacctcaagtgatccattcatctcatcctcccaaagtgctgggattacaggtgtgagtcaccgcactttaccccaggtggtagggtcttaaactttctttttttttttttttttttgagacggagtctcgctctgtcacccaggctggagtgcagtggcgcgatctcggctcactgcaagctccgcctcccgagttcacaccattctgctgcctcagcctccccgagtagctgggactacaggcgcccaccaccacacccagctaattttttgtatttttagtagagatggggttacacagtgttagccaggatggtctcaatcccctgaccttgtgatccacccgcctcagcctcccaaagtgctgggattacaggcataagccaccgcgcccggccttaaactttcatttatatgactgttactaaggaaaacttgatttaaattaatttatattaaacaaataaggccgggcgtggtggctcacacctgtaatcccagcactttgggaggctgaggtgggcggatcacctgagttcaggagtttgagaccagcctggccaatatggtgaaaccccatctctacttaaaatacaaaaactagccgggcgtggtggcaggcacctgtaatcccagctactcaggaggctgagtcaggagaatcgcttgaacccgggaggtgaaggttgcagtgagctgagatcgtgccactgcactccagcctgagtgagagcaagactctgtctcaaaaaaaaaataaaaaataacatccgagatactttataagtaagatttgccagttggaaaagaaaaagaaaacagtaatattctaaagccatgttttattctttatgaaaatatctggaaattatgcatttttaaaatcatttttttctgtatttcacagaatttcgtactggaaaaacccagctttctcataccctctgtggtaaggatatataacaacaataacaataataatcatggctattacttatcaaacatctactatgtgcctgatactctaaataatctcatatctgaacatacttgcaaggaaactaaaacacaggcagattaagtaaactgcccgtggttatacagctggtctttgaatgtgtgatccttgaggtgatgtatgtgctgcactatgaacacctgagtagaaatagagagaagttgaatgggtgtatgaatgtgttggtgaggagtccactgtctcagtttttcccattccatcttttctatatcttttttagaagagtgacacaaaatctattgagtcctagaatctttcactttccatggcataaaattggccctaagagagacttaaaaacaaaattgttttaaacaaaataacgaaagatatctccttttccacaaatacactactgtgcatttctttgagctatggagaaggaacttggcaaagtggttaagaaaggagttctggccgggcccggtggctcacgcctgtaatcccagcactttgggaggccgaggcgggcggatcacaaggtcaggagatccagaccatcctggctaacacggtgaaacccggtctctactaaaaatacaaaaaaattagccgggcatggtggcgggcgcctgtagtcccagctgctggggaggctgaggcaggagaatggcgtgaacccgggaggcggagcttgcagtgagccgatatcgcgccactgcactccagcctgggcaacagagcaagactcgtctcaaaaaaaaaaaaaaaaaaaaaaagaaaggagttctggaatcaaaatgccggacttcaatcctggttctatcgttagtagctgtgtgaccttgggcaagttgctctacttctctaatttcccccaccaataaaattgaaataatgacagtgccaaatgttaggattgttttgaaaagtaaatgaaataatgtatgtacctggtataaagtagctccttagtgttaactactactacataaaaagtaattgcagtctagcgtggtggctcacacctgtaatcccagcactttgggaggccaaggcaggaggatctcctgaagtcaggagtttgagaccagcctggtaaacatggtgaaaccctgtctctactaaaaaatacaaaagttagctgggcctggttgaacatgcctgtaatcccagctactggggaggctgaggtcagagaatcacttgaacccgggaggcagaggttgccgtgggccgagatcgtgccactgtactccagcctgggcgacaaagtgagacctgtctcgaaaaaaaaagtaaatgcatttttaaaatttgacatacattaatttaaaggtaacatattagttatatagcataaattatatttgtgactttttttttttgagacggagtctcgctgtgtcacccaggttagagtgcagtggcgcgatctcagctcactgcaacctccgcctcccaggttcaagcgattctcctgcctcagtctcctgagtagctgggattacaggcactcacgaccatgcccggctaatttttgttttttgtattttcagtagagatggggtttcaccatgttgatgaggctggtctcaaactcctgacctcatgatccgcccactcggcctatttgtgactatttctttcttttttttcttttttctttctttctttctttctttctttttttttttttttttttgagatggagtcttgatctatcacccaggctggactgcagtggcacgatctcagctcactgcaacctccgcctcccaggttcaagcaattctcctgcctcagcctccagagtagctgggattacaggcatgcaccaccacacccagctaatttttgtatttttagtagagacagggttttaccatgttggtcatgctggtcttgaacccttgacctcaaatgatccacccaccttggcctcccaaagtgctgggattacaggcatgagccaccatgcccggccatatttgtgactatttcttgtagaaagaaagttagtaggttgggcgcggtggctcaagcctgtaatcccagcactttgggaggccgaggtgggcagatcacgaggtcaggagatcaagaccatcctggccaacatggtgaaaccccatctctactaaaagtataaaaattagctgggtgtggcagtgcctgcctgtagtcccagctacttgggaggctgaggcagaagaattgcttgaacccgggaggcggagattgcagtgagctgagattgcgccactgcactccaacctgacgacagagctagactcgtctcaaaaaaaaaaaaaaaagaaaagaaaagaaaaagaaagaaaattagtaatatttaaattttatttccattctttgggagaactaactttcacgaatatcttccattgtgaaagatagtgaaattatttgttgaataacaactatgctggcagaatacttataatttcacactggttaagtaatatgaaaatataacatgttgtttagaaacgaaaggatcatgactctttgcaaaatgtactaaagagttgcaacagcagattccatgtgtatttatatagtcatgtgtacaaagtttattcactcctattaatataaatttttaattgcttcctagtgacagctcaacttccaggagctggtggctacccaggaggaaagattatcttcattgatacagaaaatactttgtaacctttttatttaaagttgctaacataatagtgtgatataggaatgttaccactgaagagtttgtctgagatatacaatctttgtagtcattccataaaccagtagtaatgagacaaaccaaagggaaaacaattactgtttaagttctccaatcactttgtatttaatgaggtttcacttcttcatatgggtttatgagacaaaacaaatacatgagaggaaattatatcatcatttttaatcctcttacttctctaaagatgttgcttaatagttagaaaaaagatttttttttttttgagacggaatctccctgttgcccaggctggagtccagtggggcaatctcggctcactgcaacctccatctcttgggttcaatcaattctcctgcctcagcctaccgagtagctgggattacaggtgtgtgccaccacacctggctaatttttttgtatttttagtagagacagggttttgacatgttgaccaggctgttctggaactcctgacctcaggtgatccacctgcctcagcctcccacagtgctaggattacaggggtgagcgactgcgcctggctgaaagattattgactcactgaaagtcatggtcccaaatgaagggaacggtatgaagagggtgaaagttaataaggaaaacaggcagaacctgtttgggtaacacaacgaattgcagtttaattaaagtgtaaggtattccaggatatgggctagaaagatgattgggatcttagacatgaaaggctttgaaacaagatagtgggtgtaaactggatactttagcaatattctaggcaagtaatgagaacttgatctaggttggaactggtaagaataaaaagaaaaggaaaagaagtattaggaaaattgataggacttgatggctatatttggtagacaaaggaaagacaggtttgagaaaccgctcaggttttttgtctagatactaggagaatagttatgtgatgctaacaatagaactggaaagatcatgcttcagagaaaaagagaaaaggtgatgtttcattttaatgtactaattttacttttttttttttgagacagtgtctttctccatcacccaggctggaatgcagtggtgcagtctcaactcactgcaacctcagcttcccaagtagctaagtttacaaatgtacaccaccacacctggctaatttttgtatttttaatacagatggggtttcgccatgttggccaggctggttttgaactcctgacctcaagtgatccacccacctcagcctcccaaagtgttggaattataggcgtgagccatcacgcctggcctaatttttttcttcttttgagacaggttcttgctctgttgcccaggctggagtgcagtggcccaattacactcactgcagactcgaactcccagggtcaagtgatcctcccacttcagccttctgagtagctggaactacaggcacataccaccacgcctggctaattttttttatcttttgtagagaccaggtttcaccacgttgcccaggctgatctccaactcctgggctcaagcgatctgcctgccttggcctcccaaaggactgggattacaggcatgagccattgcacccagccatcattttaatgtattgaatatgatgtacatgaggatatccagatggcactgggaaatattgaattcagcttgagaaaggggtaggcccagaaatatggacgaattaaccaagggggaaagagaacttatagagagagaagagaggagaattgagaacataactttgaggtatgtttatatttaggaagaggactaaaatgagaaacccagagacagaggaagtagaaggaaatctggttgtaaaagtcaagcaaaaggaaagtttcaagacgatgagttgtcagcaatgttacacacacacggattttgaggatacagcctgagaaagatcattataagttcaaaattaggagttcaagcgaacatttgccatagggtgaggtgatagaagctttatgtaaacaaacaacaagggagggaggcagtatgaaattgaccaatgaaaggaagaaggctaggcaccgtggctcacgcctgtaatcccagcactttgggaggctgaggcgggtggattacctgaggtcaggagttcgagaccagcctgaccaacatggagaaaccctgtctctactaaaaatacaaaattagccgggcgtggcggcacatgcctgtatttccagctactcaggaggcttaggcaggagaatcgcttgaactgggaggcggaggttgcggtgagccgagatcgtgccattgcactccagcctgggcaacaagagggaaactccgtctcaaaaaaaaaaacaaaaacaaataggaagaaaaaatatactagtttgaggaggtattcagaggaaattctttttaataacaaagaagacctatgcacatttgtaaggctgttcacagtgaagccccagcctgcctctccaagctcagtactcaccattgccactattagaggcaaagagatgaatctgttttagtccatcccattgcctgtaaacatactttgttatcaaaatttgcacatatgtctagtctcactccagtgatcccagcactttgggaggccaaggcaggaagatcacttgaggccaggagttcaagaccagcctgggcaacatagtgtctctacgaaataaattttaaattagccaggtgtggttgctataaatcccagctacttggaaggctgaggcaggaggcttatttgaggccaggagttcatgattagcctgggcaacatagcaagactctgtctctaccaaaagaaaaaaaatctaaaaacattgtacatcagcagttatttagatttaactataaagatttttgttttctttgttcattatggtttcttgcatcccagatgttattttttcctgtatttttgttttgctgtaatacttatttctttcagaaatgtaatccaggtggtaaactttgaaccttagtatgtctgaaagtgcctttattttgctctcactcttggctgttaatttgtctggtcacagagaactttgcatggtatatttctatcttcttgggtatttgctccttccatccccatctcacagtctttctgaatcatacaaatcatttaaggctctcatttcaaggcctgctttttctaatcttccctaattactcaatttagaaaatcttgtccttcttgacctattatagaatttactatctaaaatactcacttagaaaacaaaacagagaactgtttgcagaagtcccttttcagaaatgccaggcataagaagtctctgaaagagccttttaacttggggaaggagggtgaaatgtcgtacagggctttaacaagggtgctcagctggagttcagctggtttcagaaacaattgattaaggatgattcttatctcagagagggaagaattgttcttgcagagtagcagccactgtttgggcaatttggagtttttttttttcgagatggagtttcactcttgttgcccaggctggagtgcaatggtgcgatctcggctcactacaacctccatctcccaggttcaagcgattctcctgcctcagcctcccgagtagctgcgattacaggtgcatgccaccacacccggctaattttgtatttttagtagagacagggtttctccatgttggtcgggctggtctcgaactcccgacctcaggtgatccacccaccttggcctcccaaagtgctgggattacaggcgtgagccacgatgcccggcctgcaatttggattttactaagaacaataggaatacttaggagctaagtcatatgcaagagagagtggagaagaacagctgggtgggggtgcagggcactgtggcaagggccacattggagtgttctcattctttccgtgtctcatacttatactgctgtctcttgatagttttctttttatatgtttatattttgcctccttaattatgttttaaatttacctagggcataggttgtcttaggactccttatatcctccataatgctttgccttggtaattgattaatatggtaattaattccatatggtaattggttaataaatatttataattgatctgaacttcccttcagcataagcccaagttttttcattttaaattgttttggctggccgctgtggctcacacctgtaatcctagcactttgggaggccgacgcgggcggatcacgaggtcaggaaatcgagaccaacctggctaacacggtgaaaccctgtctctactaaaaatacaaaaaattagccaggcgcagtggtgggcacctgtagtcccagctactcgggaggctgaggcaggagatggtgtgaacccgcgaggcggagcttgcagtgagccgagatagcgccactgcagtccggcctgggcgacagagcgagactccatctcaaaaaaaaaaaattgttttgttttgtttttgggacagggtctcgctctgtcgcctaggctggagtgcaatgacgtgatcatggatcactgctgcctcaacatccaggactcaagtgatcctcccacctcagcttctcaagtaactgggactacaggtgcgtgccaccatgcccagctaatttttgtatttttttggtagagatagggtctcaccatgttgcccaggctggtctccaactcctgagctctagtgatcctcccacctgggcctcccaaagtgctgggattacagatataagccaccatgcctggttttgttattccctgtcttttgtataaaagccatattaactggggtgagatgatatttcattgtagttttgatttgcatttctctgatgatcagtgacattgagcaccttttcatatagctatttgccatttgtatgtcttctgtgaacccagagaatctgagacaggtctgagttagtttagagagtttattttgctgccgggcgcagtggctcatgcctgtaatcccagcactttgggaggccaaggtgggcagatcacaaggtcaggagattgagaccatcctggccaacatggtgaaaccccgtctctactaaaatacaaaaaaaaaaaaattagccgggcatggtggcacgtgcctgtagtcccagctactcaggaggctgaggcaggggaattgcttgattccaggaggtggaggttgcagtgagctgagatcgcgccactgcactccagcctggggacagagcaagactctgtctcaaaaaaaaaaaaaagaaagtttattttgccaagattggggatacgcccgtgacacagcctcaggaagtcctgacgacgtgtgcccaaggtggttggggcacagcttggttctacacattttgggagacatgagacatctatcagtatatgtaagaagaacattggtccagtctggaaaggcgggacaacctgaagcaaagacaggaagactaagcaaagcaaggagtgggcttccaggtcacagataggtgagacacaaatggttgcattcttttgagtttctgattatcctttccaaaggaggcaatcagatatgcatctatctcagtgagcagaggagtgactttgaatagaatgaaaggcaggtttgccataagcagtttccagtttgagttttccttagtgattttggaggcccaagatattttcctttcacacttcttttgagaaatgtcttttcagatattttgcccatttttaaataagattattagatttttttcctatagagtagtttgaactttttatatattctggttattaatcccttgtcagatggatagtttgcaaatattttctcagcaaggcaattttacttctataaaagggtgtgactcactgatggagcaatggcgagagcacatctgaacaagggaggggaagggggttttattcctgactcaagtagcccctactgctgtgtcattcccctattggctagggttggactgcacagtctaagctaattccgactggctattttaaagagagcagggttatgagtcggagtggtggagtgagtagtttggcaggaaggatggttaggaacaggtgactaaaggtgactcaggtcagagcaggtgaccaggggtgacttaggacagagcaattgaccaggggagactcagcatggagtagatgaccaggggaacagatgtaaactactgattagaactgatggaaaaggttgtttactgaaactaggggcaagaaagcaagaagaaggaggaagttaacctttaaaatggagaacaaagaacaggggagctgaacatactgatacattggttccttggagaggatctcaaaactcattgtacttaacaatttacaggcagctgggcactatggctcacacctgtaatcccagcactttgggaggccgaggtgggtggatcacgaggtcaggagatcaagaccatcctggctaacatggtgaaaccccatctctactaaaaatacaaaaaattagccgggcatggtggcgggcacctgtagtcgcagctactcaggtggctgaggcaggagaatggcgtgaacctgggaggtggagcttgcagtgagccgagatcatgccattgcactccagcctgggtgacagagcgagactccgtctcaaaaaaaaaaaaaaaaacaatttacaggctaaaacctttgaagaggaatttattatatcctacagttgactgtgcttgtgtggtattactcaagaaatctttacccagtccagtgttctacagagtttccccaatgcttccttttagtagtttcatagtttgaggtcttagatttaagtctttaatccatttttatttgatttttgtatatggtgagagataggggtctaatttcattcttctgcttatggatatcccattttcccagcaccatttactgaagagaccgtcctttctccaatgtatgttattggcacctttgtcgaaaatgagttcactgtaggtgtgtggatttgtttctgagttttatattctgttccattggtctatgcatctgtttttatgcccataccgtgctgttttggatactatagctctatagtataatttgaagtcaggttatgtggttcctttagtttcgttctttttgctcaagatagctttggctattctgggtcttttgtggttccatataaattttagggttgtttttctatttctctgaagaatgtcattggtattttgataggaattgcattgattctgtagattgctgtgtttagtatggacattttaacagtactgattcttccaactcatgaacatgcaatatctttctgttttttgtgtgtcctcttcaatgtatttcatcaatgttttatagttttcattgtagagatccttcacttctttggttaagttaatttctaggtctttaattttatttgtagctattgtaaatgggattaatttttgaatttctttttcagattgttccctgtcggtatttagaaatgctgctgatttttgtatgttgattttgtatcctgcaactttactgaatttgtttatcagttctaatagctttttggtggagtctgggtttttccaaacataagatcttattatcagcaaacaaggataatttgacttcctccttttcaatctggatgacctttatttatttctcttgtctgattgctctagctaggactttgagaattatgttgaataacagtggtgaaagtgggcatacttgttccagatcttagaggaaagactttcagtttttccccatctagtatgatactagctgtgggtctgttgtgtatggtttttatgttgggttatgttccttctatacccaattttttgagggttttttttttatcataaatgaacgttgaattttatcaaatgcttttttcagcatcaattgaaatgatcatatgttttttgtccgttctgttgatatatcacattgatttgtatatgttgaaccatccttgcatccctgagacgaatcctacttggtcatgatgaatgatctgtttaatgtattgttgaatttggtttgctagtattttgttgaggatttaagcccaagttttacacccgcggtcacattgttcccagaccaaactgaggatcaggctgcttattcttatggcccaataatgagatgcaaatgaactgggaaaggagggagtttttgtttccgtaaccggttacagggagaagacctggaaaataacaccagaccaactcaaaattacaaagtcttccagaacttatataccttctcagctatatgtttattgtaagtgtgcattcatctaacgacataagtcactttgagaggccgaggtgggtggaacacttgaagtcaggagttcaagaccatcctggccaacatggcgaaaccttgtctctactaaaaatacaaaaattagctgggcatggtggcacacgcctgtagtcccagctactcaggatgctcaggcaagagaatcacttgaaccagggaggcagaggttgcagtgagccgagattgtgccactggactccagcctgagcaacagagtgagactccatctcaaaaaaataaaataaaaatttttaaaaatatataagtgattaacttcttttgatctataactaagatctgagtcctaaagacattcctctggagcctcagtaaatttacttaatctaaatgggtccaggtgctggggtgattacccttatcttatctcctgctaaatcatggaggtttggggagttccttcagacccccaataacttgtttgtggagacctagggagtttcttcaggcccccagtaaaactcgtttaatcctaaacaggtactgttaagaatttcttcattatcttgtcatgcttcaaggcccaggaaaggcctgggcaaaactcttggtggccttttgttacattccagcctttgtataagggcactttcagcttttaatatttaacttaaccactcagtcagtgctgaaacagttgttatggaggcctgcattagtaagacctggcctgccacaacatagtatctgggatttgtagaaaccgacatgatgaaaatgtttttattgcctcttccaattccctgtctaacttgtccaccaaaaacatctactgggtatactcaataacaatggaagatttttgtggctgtcaccaaagctctaacaacaagaacatatctagtgcattaggatataaatggctgggaatttaaattaattgcaaacatcacaaataagattataaatggtccttgatttacagttacttatactgggatcagtgttatgtaaacactataaacaaagtgaaataaggttacaaacatgcatttaattttacctcattttacttcagacatattgttgggatcaccaaagacctaaaaaaaatgtttattactcctttatagtttataggtataagtgattattagcttcttccagaatacttttgcaggtgcacttagtttgcttccctatgaatttgctaatttcagaaagctaacaactcctggctaggcatggtggctcatgcctgtaatcctatcactttgggaggccgaggcaggcatatcacttgaggtcagtagtttgaaaccagcctggccaacatggtgaaaccccgtctccactaaaaatacaaaaattagctaggtatgatggctcgcgcctgtaatcacagctactcaggagactgaaggaggagaaaacaaaaaaaaagctaacaactcctttagaagaaagtagattttaaactgtatatactttccaggtaagatttgaaaagaaaaagaaaacctatgccaacaaaaaacctttggtcgatatttctcttctgggcccttgaagttacctttttgaccctttggttcatgtagtcaaatttatcatttaacaacatgtgattaataatataataaactatttcatattgaggaatgaggggtatgaagagagtgaattaattcactttgcagttattgaattataattcagtgatattatctattacaggtctatttttatagatctgagaacaaaaggactcacaaagcttagttcctagtttttctcttgtaactgatttgctgcataagctcaagtcatttgcctaatctctgtttgccagtgtcttacgttgtaaaatgtaaaacaggccataaaaactagcttccaaggttattgtaaagttttgataatttaatagttaaagtcattactgcctcacatttctatgaccattatcactacctatggtaagttgaggcacttatgaataaacaaatcttgtatagactttaaatggttgctagcatcctctagaataccttcacaggtacattgtttggcttctctgttaatttacggaagatattatgttttgtagtggttgtctaaacttttttagaattgacttattggatccttaatcttggcatactccagccgtccagatcgccttagggacattgctgatcgctttaatgtagaccatgatgcagtactggacaacgtactttatgcacgtgcatatactagtaagagccccatgcagttggatgcttgggtcaatgtaaggttggcagcactgatttactacttgagggatacaacattttgatactttttttctattttatttttctctaaattaatttactcagtctataaattttatcatctggtaagtccttagataataaagtgccctcaaattatttattattctttgtctttgaaattaagagtaacattctttttggataatgtagcatttggtatacatgctaaggcagaatatgcaataatttttttttttttttgagatggagtctcgctctgtcactcaggctggagtgcagtggtatgatctcggctcactgcaacctccaactcctggcttcaagtgattctcctacctcagcctcccaagtcgctgggattacaggcacacgccaccacacccagctaatttttgtattttttagtagagtcagggtttcaccatgttggcaaggctggtcttgaactcctgaccccaagtgatccacctgcctcggcctcccaaagtgttgggattataggcatgagccaccatgccctgctgcaataatatttaataaagtcatcaataattaagaaaatccttcaaggaatttattttgcctggctcccaagaatatgaatgatcttagcctctgcttctttcaacttttataacattttctcactgcatttcccatcaggtgaacatcagatggagctacttgattatgtagcagcaaagttccatgaagaagctggcatcttcaagctattggtacaagcttttaaatattgctttcacagagctatttagcataatatttttcttctattgatctctattcaaataacgtcttccttcaatttccaaatgcatgtttatttttacattaatcctgtgtagattatcgattcaataatggcactttttcgagtggatttcagtggccgtggggagttggccgaacggcagcaaaaattggcccagatgttgtcacgactccaaaaaatctcagaaggtatatctttaaaataaaatggcatctgtgactatgtttgtcaagtatactttgcagagaagcttggaatataatgtcaggaggcagcgatttttttttaaataaaattacctttatgagaatacaactctttgttttttttttgttttttgagatggtatctcgctctgttgcccaggctggagtgcagtggtgcgatctcggctcactgcaacctccgcctcccaggttcaagcaattcttcctccttagcctcctgagtagctggaattacaggcacctgccatcacaccaggccaattttttgtatatttagtagagacggggtttcaccatgttggccaggctggtctcgagctcctgacctcgtgatctgtccgcctcagcctcccaaagtgctgggattacaggcatgagccgctgagcccggctttacaactctttttaaaccaaaaatatttattctaaccttaataataataataacaaataatttctgttgtcaatgaaaaataggaatatgatgttatttataaaataaattcatgatgcaatatgtctaaactctgaaatctaaacaatgaacttttaaatatctatattgcctttctcatagttttaaaattttatctcttgatgcagaatataacgtggctgtttttgtgaccaatcaaatgactgccgatccaggagcaactatgacgtaagccccaatattctactttttatttcacagaggttaatataaagagggttagagcgtagaatagaaaataatttcaaggccgggcacggtggctcacgcctgtaattccagcactttagcaggctgaggcaggcggatcacgaggtcaggagatggagaccagcctgactaacatagtgaaaccccgtctctactaaaaatacagagattagccgggtgtggtggcgcacacctgtaatctcagctactccggaggctgaggcagaagaatcacttgaacctgggaggtggaggttgtagtaagccgagatcgcgccattgtactcctgtctgggaaacagagcaagattctatctcaaaaagaaaaaagaaaaaagaaaagaatttaaaaatcattagtctttatgtgggcacaaatatatcacaaatcactttattactgggcgcagtggctcatgcctgtaatcccaacactttgggaggcctagatggttggatcacctgaggtcaggagttcaagaccagcctggccaacatgatgaagcctcgtctctactaaaaatacaaaaaattagctgggcgtggtggcgtgcacctgtaatcccagctattcgggaggctgaggtgggagaatcacttgaacctgggaggcggaggttgcagtgagccaagatcatgccattgcactccagcttgtgcaacaagagcaaaactgcatctcaaaaaaaaaatcactttattgcacagtgtatatgacttcataattgtaaatatcacttggtaaccagaatctatttttctctagttctttatagaataaagcaatactttaaccattttcagcagtactttgggcttctctttggtctagggctaaaggggtatgggaggacaataagaaatagatcctagggaaataaaaacttatattgcagcttatcagtataataaacaccattcataaaaacaaaaaagtcatctttctacaggatatacatgagatatatttatcagaggcactatgggagaagtctcctgtttgaagaaaaagaatttcagttcacactaggcatattcagaatttgttgaagtgtttgtgcacataactattgatgactctgaaagacggcagtgaatagaaacacacagagagctaaagtaggataataaaaatagataaatcaaacaaaggtttgttgccaccgtaacaaattttgagcattatgtgtctgaataagcaatcaaaataatcctaaatacacaccactgcactccagcctgggagacagagcaagactgtctcaaacaaagcaaaacaaatctaaattcatgataatgcttttttaaagtgtgtgtgtgttttttttttttaagagacaaggtttcactctgtcacccaagctgcaatgcagtggcaccatctctgctcactgcaacctctgcctctcaggctcaggtgatgctccagcctcagcctcccgagcagctgggaggcacacatcgccacgcctggctaatttttttatttttagaagagacagggttttgccatgttggccaggctggtctcgaactcctggcctcaagcgatcctcccacctcagcatcccaaagtgctaggattacatgtgtgagcccccttgcctagccaaaaagcttttaaaaaaatcttttaaaggctgggtgcagtgggcagtggctcactgtaatctcagcactttgggaggccgaggtgggaggatcacctgaggtcaggagttcaagaccagcctggacaacatggcaaaaccctgtctttactaaaaataaaaaaactagccaggcatggtggtgtgcacctgtagtcctagcttcttgggaggctaagacaggaggatcacttgaacctgggaggcagaggttgaagtgagccaagatcgtgccactgcactccagcctgggtgacagaacaagactccgtctcaaaaacaaaaaaaaaaaagatttttttaaaggtttttatttagaaaatatttttaccagagagaagttaaaaaactagtgcaatgaattcatgccactgcatttcagcctgggagacagagcaagacatactcatttatctaggttcatcagttgttaaatttgccacattttttctctctcctgtatgtgtgtgtgtgtgtgtgtgtgtgtgtggaggtgtacatacacctttgtttctccacacatacacacattctcatatgtatatgtatgtggtatgtgtatacggttttttgtttgtttttctttttctttttttttttttgagacggagtctcgctctgtcacccaggctagagtgcagtggcacgatcccagctcactgcagtctccgcctcccaggttcaggcgattctcctgcctcagcctcctgagtagctggaattacaggcacctaccaccacacccggctaattttttgtatttttagtagagacggggtttcaccgtgttagccaggatggtttctatctcttgacctcacgatccacctgccccggcctcccaaagtgctgggattacaggcataagccactgtgcccagcctcttttttttttagatggagtttcactcttgtttcccaggctggagtgcaatggtgcgatctcagctcactgcaacctccacctcctgggttcaagcaattctcctgcctcagcctcccgagtagctaggattacaggcacctgccaaccacccctggctaattttttttgtatttttagtagagacagggtttcaccacgttggccaggctggtctcgaactcccgacctcaggtgttccacccaccttggcctcccaaagtcctgggattacaggcatgacccaccgcactcagtcgtgtttgtttgttttttgagacagagtcttgctctgtcactcaggctggagtgcagcagcaccatctcagctcactgcaacctctgcctcctgggttcaagcaattctcctgcctcagcctcccgagtagctgggattacaggcgcctgccaccatggccggctaatttttgtatttttagtagagacggggtttcttcatgttggccaggctggtctcgaactcctgacctcaggtgattcgcccacctcagcctcccaaagtgctgggattacaggtgtgagccactacgcccagcctgtatatgtattttttggtgaaccatttgagaagtttcttctgaaccactgaaaattattcacagacatcatgacacttcacctcttaatacttcagcatatctcttctaagaataatgatgttcttctacatagccacaatataattatcacattcagaaattctaacattggcataataatgttatctaatatacagttgtattcaagtgtctccagttgccccaataatgtcctttatagttgttgggggtttttttgttttgcattcaattcaggatcaattgaagaacatgcactgcgtgtaattgtcatgtctctttagtctcctttaatcagaacagctcttcaacctttgttagacttttatgacaccgacatttttgtagaacacagaccaactgttttgcaatgtccctcaatttgaagttgaattttttcttcattacttaaaatgttaagcattttgacaggaaaactacataagcaatattatggccttctcagtatatcatatcaggaggcacatgatggcagtttgtcccattattagtgatgttaattctgatcatatgattaagatgatattcacatgatgtctccattgtaaaagaaaattacaaaaattctcttttatatttaattagtaatttgtggtgtgataatttgagactgtgtaaatatcttgctctgcaataagctttcatgcatttatattagcatccattgaagattcttgcctaaattaattagagtaaattaattattactctgatggttgcaatacaaagtgctattactttaaaacagaagcaatgcatcatatggtagcagattaaatgtatcattgacagatatattaaaagatatttgatatgctggagtaaattctgtaaattacattgaaatgaatgtgtctctctttaagcattttccaaatttacccttaacaattttgcttcatctttcgcagtttgatatctatctctcacttttcaagactctttttttttttttttttttttgtgatggagtctcgctctgtcactcaggctgaagtgcaatggcgcgatctcggctcactgcaagctccgcctcccaggttgatgccattctgtcacctcggcctccctagtagcttgggactataggcgcccgccaccacacccggctaattttgtttttgtgttttagtagagacggggtttcaccgtgttagccaggatggtctcgatctcctgacctcgtgatccatctgcctcagcctcccaaagtgctgggattacaggcatgagccaccgcgtctggcctcaagacccttttataagtattttctacttagttacaagagattcctgtgaaaaatattaactactcaaatgttattaagcaagttaaaaagattgagcaggggaaatcatttattcactcaatgaatatttattgaaaatctactatgtaacaatattctgagaattcactagtgaacaaaaaagacaaaaatcctggcctcggccaagcacggtggctcacgcctgtaatcccagcactttgggaggccgaggcaggaggatcgcttgagcccaggagcctaagtcacatagacagacctcgtctctaaaaaaaattaaaaattagccaagcatggtggcacatgcctgtagtcctaactacttgggaggctgaggcaggaggattgcttgagcctgggaggtcaaggctgcagtgagccatgtttgcaccactgcactccagcctgggcaagagagtgagaacctgtctcaaaaaaaaaaaagtcttgtgaacgggtgtggtggctcactcctgtaatccagcactttgggagaccaaggtcagtggatcacgaggtcaggagatcgagaccaggctggccaacatggtgaaaccctgtctctactaaaaatataaaaattagccgggcgtaaatgcgcgtgcctgtaatcccagctacttgggaggctgaggcagaagaatcgtttgaacccgggaggggaggttgcagtgagccgagatcacacccctgcactccagcctgggtgacagagtgagactctgtctcaaaaaagaaaaaaaaaaaaaaagaaagacaataaatgatgtccattcaactcaaaattttagtcttggtaagtcacacattgtctatagtatagtcgctgagtggttaaggcaatcatctctgttttatgggatgactttcatacacaggacatgaagtgcttcacaaagagaataattttaaactgaagagaaatggaagatttttaaggctcgttttaaaaagagaaaatgactcattggctcagagggaggaagtgggttgcattcaaataaaacagtacaagttaaagagcaatgttctttcttcaggtgtcgggagggaacattgaagaggccaaaactgtcactctagagttagaaggcaaaggaaatcagcggaaattaggtcagataggggttctttttcttatatttgtagaaagtttcaaaaagagtaaaacaattttgaattaattccgataagacaatgaaagaaatagagagatgacagataattgaagagggagttggaatggggaggagactgaaaatgaggaagctaagtaaagtgctagacaaagtaacaaaggctagtatttttactgggtaagtcaactctgaaacatcatctcctccacctagctgaattgttaggaaacaaggttcactataattggtatgttaataaagtatattaaattataacaatacaaattaaatgcttgtctttatataaagcacaaaagttgccacagctaaatgggaaaaaaaaggacaattttaaactaaaggattttaaatactattaggaaacctcccataaagaaaatatctttgtttctcagtgttgagaaactccaagctgcagttcccctggggcctgtcagggaactatcactataattggtatgagtccgcaagtacactgacaataattggggcttatatcccatgcattatacttgattgcacatcttattaaaaaggaacgaaattatagaagcgaggagctgccatacgatatagcaagaggagtagctcctagatgaggcttacagatacagactttagaactggaatgatccagttgatgaagacttggagataaaaagtcaaagtatcagtccataaagtcccacactggggcaaataacaagatgaacaacaaataagaccatgatgttgccacctacttcatttgtgtatttgttttgggaaaacaaaaagtcaccgtagaacatttgcagtcttgtaaatatacagtcagtttattctctaaggatgtcaccttctttttgtttgtttgttgtcacccaggctggagtgcaatggcatgatcttggctcactgcaacctccgcctcccaggttcaagagattctcctgcctcagcctcctgagtaactgggattacaggagcatgccaccacacctggctaatttttgtatttttagtagagacagggtttcaccatgttggccaggctggtcttgaactcctgacctcgggcgatccgcccacctcagcctcccaaagtgctgggattacaggtgtgagccaccacacccgtcctaaggatgtcaccttctgatccaacatcattagcataaattaagaggcaatatgattagagaaaaaacattaaaccagggtcactagcatagtgaccttgtacaagtgatttaaactatttgaactgcattttcctccctctcaaaattaatttatgtttattgattacttaccatgtgccaggtgcttttatgcatcatcttatctaattctcatgtgaccccaatgtaactcacagcctccttggacctccctgttgcttttgtgaagccaatctcagtaagttgttgaatccctccccatctcacctccccccgcaaaaaagaacccagaattccatctttaaaatgttgaaaaaagtgtatatttttctgcatattttgggagaagacagaggggagaattacttaacaaaacttcttaaacatacccttttttttttaaccacctcttctctttcctcaaaattcttctttggcggtactcccctttcccccatcttcccaaaatctcaaagcctcccctgccaggcatggctcacaactgtaatcccagcactttgggaggctgaggcaggtggatcacctgaggtcaggagttcgagaccagcctggccaacatggcaaaactgcatctttattaaaaatacaaaaattagccaggtgtggtggggggttcctgtaatcccagctacttgggaggctgaggcagggagaattgcttgaacccaggaggctgaggttgcagtgagctgagatcatgtgactgcactccagcctgggcgacagagcaagactccatctccaaaaaagcctcctcattcttgggcaagttcaatctttctctcctcaatggaccacttctcgaaaatgccatctgtaatctcactccttagtaagtaaaaagcatcaggagtacttattgtccctcaagcttgcccttgcccatgcccctcaagatccacactctaagcagtatttaaggtaggcatgatgattattcctaatttataaaggtggaaacagaggctcagaatacttagcgtttgcccaattccagaatttaaaaatgtgtgagccaggatttgaacccaggtatctttgacatcaaagttaatgctacttgaacctcactgtaccatcttccccatcctataccataactctatatatgtttcatgaccccagcatcctaatttgacattgccaggtcaggctgttttgggtcttactctcaacaatataatatgccatatcctgttcaaccagagggggagaagtgaaatattctcatcccctctttactactaatatccacccccatctcctcctccttgccatactccctagttccctgacaaaaggaaaaaagaagaagagaagaaaatataaaagaagaagaaataagatgataggctcaaggaggtttgtgggtggttttctgaagctgtttttacttggtcagaaatagaagaaaattggccgggtgcggtggctcacgcctgtaatcccagtgctttgggaggccgaggcaggtggatcatgaggtcaggagttcaagacaagcctggccaagatggtgaaaccccgtctctactaaaaatacaaaaattagcagggcatggtggcacacgcctgtagtcccagctacttgggaggctgaggcacgagaatcgcttgaacctgggaggcggaggttgtggtgagccgagatggtgccactgcactccagcctgggcgataagagcgaaactccgtcaaaaaaaaaagaaagaaagaaagaaatagaagaaaattaaagccctctaaaagaatgtggaatgctattataccttcttgtacttcacctcaagacttggttataactgctgtaatagtcaggaagttcaaagaaactttaagaaaagtttcctggtctacttttcactgacagagtgactgttttagctgaattgtttagttaaataatagttatcctatgtattattttagtttagtttagtttttgagacagggtctctgttgcccaggctggagtgcagtggcatgatcttagctcactgcagccttggcctcccaggctcaagtgatcctcccacctcagcctccaaggcagcacagaaccaggcacatgccaccacaccgggttaattttttgcattttttgtacagatagggtttcaccctgttgtcagcctagtctcaaacttgtgggcctccaagggatcaaacaagcaatctgcccaccttggcctcccaatgtgctgggattacaagcgtgagccactgtgcccagccaataattatcctttatcgaggatctcttatgtgccaagattgccgtaaggatagaacaaatgtatgtaagtgaacaggtacagttcctggcacataggagccttgtatgtataatattcaagattcaggccaggcgcagtggctcacacctgtaatcccaacactttgggaggccaaggcgggcagattatttaaggtcaggagtttgagaccatcctggctaacatgatgaaactctgtatctcctaaaagtacaaaagaattagctgagtgtgatggcgcacacctgtaatcccagctactcgggaggctgaggcaggagaattgcttgagcctgggtggtggaggttgcaatgagccgagatcatgccaccgcactctagcctgggtgacagagtgagattctgtctcaaaaaaaaaaaaaaaattcaatatatattgaatccttacaatgccctaagaggtaaagtctttttattcccattttatagtgaaagaaactgaggttcataaaggtaccccaaggtaatataggtaataaatgtttaagtcaggattaggaaagcaggtaaataattgcagtcactggagttatgccttacctgaattattgcattttattttacaactattaagtacagttattatcccccattaaaaatgaagaagtaaggctgggcatggtggctcacacctgtaatcccagcactttgggaggctgaggcaggtggatcatctgaggtcaggagtttgagaccagcctgactaacatggcaaaaccccatctctactaaatatacaaaaattatccggtatggtgatgggtgcctataatcccagctacttgggaggctgaggcagggagaattgcttgaacccaggaagcagaggttgcagtgagccaagatcgtgccattgcactccatcctgggtgacagagcaagactccgtctcaaaaaaaaaaaaaaaaaaaaggagaaaaaggaggtccagtgcagtggctcacacctgtaatcccaacactttgggaggccgaggtgggcggatcacttgaggtcgggagttcaagaccagcctggccaacatggtgaatctctgtctctactgaaaatataaaaattagctgggcttggtggcgggcgcctgtagtcccagctactccagaggctgaggcaggagaattgcttgaactggggaggcggaggctgtagtgaactgagatcctggcactgaactctagcctggatggcagagaaagatgccgtctaaaaaaaaaaataaaagaagaaggagagatttagaatggttaaacaattttcttcaagtcatatggctaaaaagccagacagaatttgaactcaggtctaactccatagctcatacaacacacagtatatcaggactgcttctgcctggggaatggctggtatgctgtcacctgagaggttttgcagggatgtatccatttctccagtgaattgaccatagtccagagccctcagccttgcaggcagagatttgatttggtcagcttactaagaaccaatctgtttcctgggggcagacacacattaatcaagctcatgagactgaatgaagaaccagacggccagtttattgataacgaaaatgtagctacatttgagattcatgtgaccagcacattctctccctgtaagtagacctcaataggaatccaaattttaatctgaaattatttactagatatggaatccaagcaaagggaaaaaaaattgatgacttagaagaatgtctgccacatagcaaggactcagtaaatcttagttattattattattattaatacccatgtacaccagagaaggggttatgaatttcccagacttacacaaaaatttttgtatgtgtgtatatgtgccctttttttggtggggaggggatgtttttattaaattatcaaagtgttagtgacctacaagaaaggttaagagccataaatttggccaggcgtggtggcccacgcctgtaatcccagcactttgggaggctgaggtgggcagatcatgaggtcaggagttcgagaccagcctgattaacatagtgaaaccccgtctctactaaaaatacaaaaattagccgggcgtggtggcatgtacctgtaatctactactagctactcaggaagctaagctaggagaatcgcttgaacccgggaggtggagattgcaatgagccgcgatcacggcattgcactccagcctgggcaacagagcaagactccgtctcaaaaaaaaaaaatccataaatttgacacaaaatcctgaacaccttagtggaacaaacaaaatttgtttgttttcctttcttttaaacctatggattatatcaaacaaacaaaatttgaattggcttgatagtctcctggagttaaggctgctatgtcacagcctattttgatataacttcttagtttattaatcatttgttagacttttttatccccataatatctttctttttctttttttttcttttattttatgtattttattttatttttgagacaaggtcttgctctgtcacccaggctggagtgactggagtgtagtggcacaatgaacactcaccgcagcctcaacttcctggacttgagagatcttcctgcgtcagcctcctgagtagccaggactccaggcatgcaccgccatgcccagataattgttgtatttttgtagagatggggttttaccatgttgtccagactggtcttgaactcctgggctcaagggatctacctgccgcagcctcccaaagggctgggattacaggtgtgagccactctgcccagcctcattcctatatgttttctttgcccttttgcaaatgctataatttatttccccatttgggtgattcaaaatcatctccttttggaaataatgttcttaacattcaggctcttcacctacagtaatgacaagcaattgtctctattcttttttgcacattgggtaccacactagtaacagcaaacaatagtttgctaagaaaaaaaaatcatggctatacatctagaagctctagcttcccagtcttgtttaggttatctataatggcatgggaggcatggtgcttcaactgggggaatctatcttcttttatatttgcctctgtcagaacactcttcaaaagttccctgaattacagttttgaagatatgacacaaatctgtgtccaagaaggacctagaccagggagtcccaaattgtcatctctgtattcattctgcaatatttatggagtaccctgtatattataggcacttttccaggcgctggagtttcaaagatgaacagatatttagagtatagttggggaataagacccatacatttaaaattaccatgtagtgtgcttaattaattaattaatttatttatttattttgagacgtagtctggctcttgttgcccaggctggagtgcaatggtgcgatctcagctcaccacaacctctgcctcccaggttcaagcgattctcctgcctccgcctcctgagtagctgggattacgggcatgtgccaccacacccggctaattttgtatttttagtagagacggggtttctccatgttggtcaggctgatcttgaacccctgacctcaggtgatccgcccgcctcggcctcccaaagtgctactgcgcccacctgtagtgtgctttaataaaagaatacagactgttggaaagcacagagggggccagttttctactgtttcagggaaccaggcaagggttcctagaagggaggacacttgaaggctgtgtaggagctgaatgagcagacacggtggggaaaggagctttcatttcagagggagtaatgtgtgcaaagtcatcaaggataagaagactttctgaaatcagaaaaaaggaagttttagagggaaggagaaaacatgagtacaactgtagttaagtatataggtggtggacagaaagaagaagttgaggaagtgtcctcctgagagcccttattttcttttttatttattagttttattttattttattttgttttattttatttttttgagacggaatctcgctctgtcgcctgggctggagggccaccggtggcgcgatcagctcactgcaacctctgcctcctgggttcaagtgattcttctgcctcagcttcctgagtagctgggactgcaggtgcacgccaccacacccagctaatttttgtatttttagtagagacaaggtttcaccatattggccaggctggtctcaaactcctgaccttgcaatctgcctgcctcagcctcccaaagtgctgggattacaggcatgagccactgtgcccggccaagcccttattttctttataaagtagcaggcaatgtcatccaaggtgaggggataagaatggaaaagggggcttaaggagactactgaaggtgaggcagtaaagccaaccatgctcacacaggagaatgagcagcattgagagactagctgggagaagcagtagcattgtgttcagacttctctctgcccatttagctaaccttgactatccgttcttagctccttttgatagaaatttccaactggtctcaattttattttttcttaacttctgtgaaaacaccaatctttttgcagtccaatattccccttggaattgttgtagcataaatatcttaagctgaaaaaactatttttttttttctgagacagagtcccactctgtcacccaggctagagtacagtggcgcaatctcagctcactgcagcctccgccttccgagttcaagcgattctcctgcctcagcctcccacgtagctgaaaaaacaattttgaacacccactgtgtgcctggttgtgcagaactaaacacaatatagtctgcccttaaggagcttagtgatagagaataagagaggaattgagaaggaatacaataagtaaataaataatagtactaaaggcagaacatgaaaagtacattacagaagcataaatacagtgtttgcaggctcggagttcatagctcagttgagaatatcctcagggtctcaagcagcccatctatatagaacataagattattttaaaaccatgaagaaccacctgtaaggtagggtgacctgaaaagttaagtggcatcgatctgtaagcattatagagacaactcacttatctagctattttatccaactgagaaggctttattgctttactaccatgtcaggtgcctggcaaagcaacccagctttctgacttcttaactgccgccgttagtctcaactgtctggctactactttcttgatagtggttcactccaaaactaactctttgtccttgttcctatgttggacctgctgcatttgcatttaaaacatttttttaaaaatgtttttaagagggcctcactatggtgcccaggctagcctctgaattcctgggctcaagtggtcctcctgcttcagcctctcaagtagctgggactacagatatgtgccatagtgtccagtttctactgaatcttaatcctattcagcaccaaccaggggtcttctggtcctaacctctgagccatttaatcaagtagcagtttatctcagcaaactcctttaccaaagagcttcttatcccgaccaacctacagtctaaatatatttaacctcatgccaatcagctacatccttgctataccaagcctgaagcttagagtaaaaccagaatcatgaacactttaatggagcaagcacaacttgaattgacttgtaactatattctttcagaactgaagctattattctatatcatagtttattttgatcaagtataacctttagtttgtgctgttcccttattgatgatttctaagcccacattttctttttttctttctgtttttgtttgtttgttttttgagaaggagtcttattctgttgcccaggctggaatgcagtggctgatctcagctaactgcagcctccacctcttgggttcaaacaattctcttgcctcagcctccagagtagctgggattacaagcatcaggcacacgccaccacacctggctaatttttgtatttttagtagagatgggtttttgccatgttggccaggctagtctcgaacttctgacctcagtgatccacccacctcgacctcccaaagtgctgggattacaggcacgagccaccgagcccagccagtaatctcattttttaaagtcaggctgggcacagtggctcgtgcttgtaaccccagcactttgggaggcccaggcgggcagatcatgaggtcaggagttcgagaccagcctggccaacacagtgaaacctcatctctactaaaaatacaaaaaattagctgggcgtggtggtgggcacctgtaatcccagctacctgggaggctgagacaggagaatcgcttgaacccaggaggcagaggttgcagtgagtgagatcacaccactgcactccagcctgggcgacacagctagactccatctcaaaaaaaaaaagtcaaacaaaatataaactatttatcataggaatctcaaaagcctagactagatggggtatatagcagctccaaaactcacctcactccttagtttatgaacaagcctctgcttgtttagaatatacacttattccaactcctgacatccaccacagaaagattgccttgtaattgcagatattgccatatatagtccatatgatgaaacctgaaagagtattttattaattcagctttcaggcagatcccaaaaaacccattgggggacacattctggctcatgcttcaacaacaagaataagcttgcgaaagggaagaggagagctcagaattgccaagatttatgacaggtaaatttttttttattttgtgtgtgtgtgtgtgtgtgtgtgtgtgtgtgtgtgtgtgtgtgtgtgtagagacggggttttgccatgttgcccgagctggtctcaaactcctaggctcaagcaatcctcccaccttgggctcccaaagtgctgggactataggtgtgagccaccacaaggctgtaattattactgccagatgctgtgtgtttgaatttctttctaaaaaattattcaatttattgggaagtccctactgttactaggtactagggattgagggattctattgacacatagacttggtccctgacctttcaaagcatacacctagataatgaaatcatcaattccaattaaattgtgttaaatacaaggtaagtatcaagtatgggaacatatcctcctttctttttgccaggttaactctatttgtttttcaggtttcagtttaaacatcactttctcagggaacctttccctaacccttacagtctaggctactcagtatattataccctatattctttctcagcactttacgtgtttaattaagaattacagattttggcccggcacagtggctcacacctgtaatcctagcacttttgggaggccgaggtgggcggatcacctgaggccagaagtttgagactagccgagatcgcgccactgcactccagcccgggcgacagagtgagactccgtctcaaaaaaaaaaaacaaaaacaaaaaacaaaaaagaattggataacctgggaggatgtgctagacaacctatgtttccatggaaggtactcagtaatcttttaatttatttcaaagtattttacagtttgctcctacattagtctagtcataagaaaggtgcatacccctatagaatcagataaacctctaaggggctgctatacaatgcctgacactatactaaaagaacatccagttggccaggcgcagtggctcacgcctgtaatcccagtactttgggaggccgaggcaggcggatcacctgaggtcaggagttcaagaccagcctggccaacatggtgaaaccccgtctctactaaaaatacaaaaattagccgggcgtggtggcaggcacctgtaatcccagctactcaggaggctgaggcaggagaatggcttgaacccaggaggcagaggttgcagtgagacgagatctcaccattgcctgggggacaagagcaagacttcgccaaaaaaaaaaaattaaaataaataaatgaaagaacatccagttatcctttcacctgtttccaagtttggagtaatttttcttgacattcagaactttatatatagaagttgctcaataaatgtttgtgagggttaataatacttgtgggtaagttctgtaggccacatttggttgtaccaactctgagatgtctctggagattcagactgatgggcacataatgcctgtgacatgaatatagtatttatagaaatagagctttttataaacttctgttcccttgtattctgttagtcctgagatgcctgaaaatgaagccaccttcgcaataactgctggaggaattggggatgccaaggagtaggtggtgaattgatgcaaattgcttcttagtgcttattaggagctgaagaaatggaaaagcagtctccaatttcacatcttgaaatagaggttttttcccacatgttactaaagaaaagtcagcaaagagatttaaatcttatatttatcttaaaagtccctgatttatgataactatacattgtatgtaaattcagggatatgtatatgtatgtttgtgtgtgtgtgtgtttgtgtgtgtatacctgacatatatagtagatatatatacctattgaaattctctcactctgtgtatgtatatatacctatggaaaactagttgttgggaaaggagtacgtgattccctccctttcacttttcaaagtgagccactaaacagaaagtctaagagttcagaaatgtcccattctcctaaggactttcccttcaccatttttctagggtatagtgccactgacttacatagctagatgtttttccacaagaggatttaagggaggaatgtttataggacacacacacaaaagctctttctatttataatatcaaactgcatattcacctttatagcaacagaaaacagacattaaattaagccaaattttaaatcatttgactttgacaagcagaaattacttttaaaaaatgtatttatggctgggcgtggtggctcacacctgtaatcccagcactttgggaggccgaggcaggtggatcacttgaggtcaggagttcaagaccagcctggccaacatggagaaaccccatctctactaaaaatacaaaaattagccaagtgcagtggcatgtgcttgtaatcccagctactctggaggctgaggcaggagaattgcttgaacccaggaggcagagattgcggtgagccaagatggcaccactgcactccagcctaggtgacagagtgagactccgtctcaaaaaaaaaaaaaaaacttttttaaaatgttaaaattaatttaaatgtaaaatttctgaatactaatcttagaaatgtgtaaaagatattattttgattgttaaacaaataaaatcctgttttcaaaatgcatgtatggtgaaaatatgtaaaaattaatatactaatgacaatatacaatgaagagctttatagacttcaatctttatagactttaatgttacatcaacttacatgaaaattccagggctgggcgtggtggctcacacctataatcccagctctttgggaggccaaggcgagtgaattgcttgagcccaggagtttgaagaccagcctgggcaatatggcaaaaccccgtctctacaaaaatacaaaaaaattagccaggcgtgctggtgtgtgcctgaggtcccagctactcaggaagctgaagtgggaggattgctggagcccaggaggtggaggttgcattgagccaagatagagccactgcactccagcctgggtcacagagtgagactctgtctcaaaaaaaaaaagaaggaaagagaagaaaattcaagtattcgaagtaccatttgttacaaaaggtatttgattattcatgaaattattcactcactaattattattaatgctaagcgctaaagaataaacaaggaaaatgtggttcctacacataaagcatgtgtacactagttaagagaaaagactaatatttaggaaaacaagagagcaaatgattatataattaattcataagcagtgtaatcttggattgacccttaaagaaaaagtaaaattctgctgggtgcggtagctcacgccagtaatcccagcactttgagaggccgaggtgggtggatcacttgaggtcaggaattcgagaccagcctggccaacacagtgaaaccccatctctactaaaaatatgaaattaactgggcgcgatgacgcacgtctgtaatcccagctactcaggaggctgaggcaggaaaatctcatgaacccaggaggcggaggttgcagtgagctgagatcatgccactgcactccagcctgggtgacagagcgagactccgtctcaaaaaaaaaaaaaaaagtaaaattccaaaaatgggaggggaaaggttaagctgagagactgcaaaggtataggagctgggatatggaaagaaaacagagactaactcggcaagtagaaattgttcacaatgcaggatactgggaaataggagctttttttcttccttttaccttttgaaaaccacagaagctgcttccctgaataagcagaaataaagtcatctaggagcagattttctgcattctgcaaaatcacttaaatggcttattttcgtatgcaaatataaaggcacacttttgtcctagggaaaggaaggctttgttacttgattcattgtgtatattttaaattttctgtgtattatgctgttttaacttttttgttttgttttgttttgttttttgttttgttttttgttttgagacacagtttcactcttgttgcccaggctggagtgcaatggcgcaatctcagctcactgaaacctcctcctcctgggttcaagcgattctcctgcctcagcctcccgagtaactaggattacaggcgcccaccacaatgctcgctaattttttgtattttcagtagagatggggtttcaccatgttagccaggctggtctcgaactcctgacctcaggtgatccacctgcctcagcctcccaaaatgctaggattacaggcgtgagccaccacgcccggcctgttttaacatcttgaaaaatcattctagctggggagagactgcccctatcagggatagccaattcttagagatagcaaaggcactagccaagagcatgcctttgatgcgcaaactaactaatctacagccatcctagctctatctggcccttacactccagaagagactattcctttcccttaatcatcccaggccctgctaccaggcaactaggggccacccatctaatttagagcctattgaaatttcagcctgggcaacatggtgaaacctggtctcaaaaaacaaacaaaagttagccaggtgtggtggcatgtctgtagtcccagctactcag

SEQ ID NO: 16793 - DNA, 28862 bp, Human
acacctctggtcaccaaaatgtgtggatttatccccaccagcaacccatcagtgctgcaggggacgccagctggatgtcctctagttcaattcaattcgtctcacactgtctacctggagatactgtcagatcccactgattaagggctcagtcccacaaaactgtgcccctcctttagaagccagttatgagttcaggcctccagtacttcgttgttttttttttttgtttttttgtttttttgtttttttgtgagtgggagtctcgctctgttgcccaagcttgagtgcagtggtgtgatcttggctcactgcaacctccgccccccccccccccccccgggttcaagggcttctcctgcctcagcctccagagtagctgggattacaggcacatgccaccacgcccagctaatttttggtagagacagcgtttcaccatgttggccaggctggtctcaaactactaacctcaggtgatccacccgtctcagcctcccaaagtgctgggattacaagtgtgagccattgctcccggcccatataggatggaggtgagcaatttggcaaggaagaaattaaaaagcacataagaacagtatcaagaccattggaatcagatgacttcctgtccaagattcccagctgtgtttgtgcaaataagacttgatagtagtggaaaacagggacaagaagagactgtctctttcttctcaggtagatccccaaaactgaaagccattttcaatcctgccacttgctcactaaagatttagggtttaggtccaaaccctaagtcttggattccttatcttctcaaacatgctcttgtttgcttgatgcctggttcgagtggccaaggccgacattcatagacgttggttaatccctaatttcgccaaacaatgacggcctaggcttttccggcttttgaaacaggaattcaagacactaaaacgtgtgttgatggcattttgggttggggcttttcacaactgatgacactggaaaaataatccataggaaactaccttatgagaccctagatttcggtttagcagttcaccacaaaagtggtgaggtgttttttggcttttaattttagctgcttgcctctgtttttagttcgtgtgattgcctccgcaaaggcagtgaatggagaattctccctaaggtcagcatttaattattgcctcactctggctgctatagtattacaactcttggaacttacagcatcgatcctactattaaagttgcctggagcatgccagcacgttggacatcggcgttccagcaactgcctcagtcactgaatcgagtgggaggctcattttgcagtttactatctccatgagcaggtccaggcgcgggacctgttctatgactcgattgggtcctgcccttgtccgtcatcggaaggcttacagcgcctactgttttgcagtaagatttgcaggcttagtaccgcctctggaaacaaggagagtgaaggggcgttgacgagtaacgttgtttgtatttctctcctcattggatggctgctgtgtcagtcagacacttctctgcttccgttggcgggaaggcttcaggcgggtagcggggactcggtactgccccctcccaagctgggagcagggcgcgtgacgtctcagacatttgttgttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaaggtaggcccgggcggcggcggcgggcgctgaggggagcgggcggctggccgagcagtctcccgggcgacggcggggccagcggccgccctgtccgcggggagcgcggaacgggaagaaggggccgagcccgcccacctgctagtctccgggacgtgcgggggttcgcggcgcgaggggccgtccccatggtccccgcacccaccttggctcccccgcgtcgccaacccagcctcccgccctcccgtctcccgccgagatcgtaacccctcggctctgccacgtggaacgggggcgcccgatgccagctgcgctccgcgcgttccctgtccccgctcagtgcccctccccgttcttcgggtccccacttgaggggattcggagaccgagagtctcctctccctggaccgcgcgggacagcagaggggcgagggggcccgggcagggggccgagacgctcatgaagacaggtagtcggaggccagggcagggtggccgccgcgtctcttcccagactcgggaaaggaaacagaaagtagtcgctcagctggggaggagcatgtccgagaatgtctacttttcgaggccacccgaaacaaaatggaaagatggtcaggctccttagtctcgctatcctgtgagtggaagctcatcttgtatgagtggagcagtgaaggacgtttaaaaccgtgttttttgagctgtcgagaaggtaggcaggaattaaggcctcgccaacggcttgacattgtgaagaatagaaaagtaaatacaagatgtgactggtgttttgaaggtgcttaacgttccttagggaaagaatgccaacttgggagtcagacagggctgggttccctttcctgccctaccatcgaaaggctctgtgacgttgggaaagtttcttaacctttcagttctccaaccacctcatcttaagaaagtacagatgggttgtaaaaattagaaatatttaagaagacacctaatagtgcctgatgcatactagagactcagtaaatgtttgaagtgaacgagatagttcctaatttcctgtgcagattaaatagcagtgggtgaaagatagaacaccaataccaccacttacatttgtaggatagttacgatagacattttatccagctttgaaaatgtttgtgactttttatagtttatggcggcaaatttgcatgaaacttggtcctaaactggggaggaactttccctgcaacctaagcaagttattttcaactgctctttgccattgtagtctcaggtgagcacttggaagccagctagcctgtcaaagttggtcctgtcttgtgcctgtaaggccataatgaggatggccaaacttagagagagggatggccaggacgatgtaaaagacccaggaaacatccaggttacaattacaagctctgatgagtcaactcaggaagttacaagattatggacctgactcaagagcaaacaaactggatgtcaacacatggtcaaggtgctgaagaaacatgataggaaattgcagggcagagttgcaaagacggtagtaccttcatttcttgaccagctcatttaatattcctagaagtgttatttcatcacatagctggggaagtcctccttacaattaaaaaaaatcatatgtatattaatatcgatgatatcaaaaagaaaaagtgatggtgtggagggagagaagggttgggttgaatagattgattccggaggaacagattagaagcgaaaggttcatgtccttacgatagaaaatgtggagacctaaggctccgagagcttccaaagggagaaacacttagtgaatagtggtggctagtttcatccaacaaggtttttctgggaatgattgggtgaagaaaaccttgtagtttcacatttattgagctgtggactagatgctttacatgttattatatttgctctttacagtggccttaggatgcaggtagtattagctccgttttatagattgaaaaactgaaactcagagtggttaaattctttgtccaaggtcacacaggagtggttagagaatggggtctgattgccaaatggcttacccaagtaaatggttgacacttcaatgttattggcagacatttgcaaaatgacggtgctaatactcctcgtagtggtaatggtgatggtgttttgttgatgaagatgagtcttgcaggcagttttcattcccaaatattcaatatagctaagacaagatagaacagaattcttttgttatcctggaagccactggcctgtgggtggagggcatggaggtatatgaggtatatgtcttgtgggcttccagatgccaactgcaggtagaagactttggcatgtagatggaaagcactgcgctttctatccacagtgccatattctcagtcacttgggtcctgcccttcctgttaagcagcaggaggcaggctgcttgtgccctctttaccatgggttatggctcagacatacacattgtagtatattatttggctcatataaggcctgaggctcaaaggctacttcaggagaagcagagagggcatgaaggggctgtgcagcctttttagatgagggtgctatggggttcagtcaggatctttggttaggctatattgatcagctttggctgtggtgctcttctagcaagtgtggtcctaaggctgttggtttcttttctagctggttctagtgagccctacatcagagcagtatgacagcctacttcggcagatgtgggagaggatggacgagggatgcggagagaccatatatgtcattgggcagggatcaggtgagcatagttttcctttcactttatttttaaaaattattgggccgggtgcggtggccctgccgcctgtaatcccagcactttgggaggccaagacgggtggatcacctgaggtcaggagttcgagaccagcctggccaacatggtgaaaccccatctctactaaaaatacaaaaaattagccgggcgctaattagtggtggcaggcgcctgtaatcccagctacttgggaggctgaggcagaagaattgcttgaacctgggaggcggaggttgcagtgagccaagatcgtgccattgtgctccagcctaggcgacaagagtgaaactctgtctcaaaaaaaaaaagaaattatttagagcacattttccccgctttttgaacttttctgcttatgtgtctcagttacagtgattctttagtgtctgcagaactgtttggagtacataaaagtacaaagtgaatgttaattctgaccttagtggccataatatgcttgactttccaagcagttttacagatgcttcctttttacctccagtactctctatttgcataagaggaaatgaagcacaaagcaaaggaacttcttgtctaaggtaatagggcaagccatagttaggtctagaattaagcttattcctgggcagctggaggtcttcccttccaggccctgtttacagatcccattgcgacttattttctgcttagcagaggacctccgtgattcttcttggtgtcagcagagaaaagatgcccagaattcctctcttgtcaggctccttgccccagaccctactgactatttagtctggatagctgggataacagaggtcgtcctctctccccactggatcctgtcagacacataggcttgtaaccattctgaaagggactggttattgttctccaagctgcttattccttgtaacagaacctactattttagaggaaggcagccctcacaacaatcccagagtatattatggtttcttcccctggtcactcctagttagcaacttcaatacaagacctgcttaccttcatcttcattatgggattatctttgctgaaatgacagctggggttgttaacgattatgaattcagcccataccagcacttgtctctgtcatctttgcaggaagcccaggtgggcctggatgcatcattaaagaaacacttttctttgctgaatgtaggctttgtaaagccaggtaataattcttttgtagtttgagttgaagattgaagaaatctcaaaatcattcttaaactattttatacatatctattaagtatcttctaaggcctgccactgttgcaaagctcttttggaaacttaaaatctgatccctgccccaaggaggaaagatggcatatacacaaataacctccatgggaaacagtatttggaaatgttgtaagagtgacataaagaagaaggatttgctctccagatgcagctgtgccttcctttgaaatatctttcgtatctgttctttccttcccatccttgctgctacctctctagttgcgggtcttaccacctaaaggaaggcatggtcagagagataggcaaactaagaggttgcgtatcaagaaagggagagagttgattagcattatcaagtgctacagaggcagcaatgaatgccaggttcaaaaaaaaaacattccatttgttgactaggagatcattggtagccttttgaagctttgatgtcaggtacacatctggcctgctctaataagatgaaccactcaaagatcacttaataattgtagaatttcaggaaccacatataggtcaattttgacaagtgttgagtctgtttttgaagacccagattcttaagactcctctttcccctcatccttttatgtggactcagtgaattttaccatgccttgacaactcacaccccacccatggcaattaacccacccatggcaaacccacccatggcaaagcgtaagatgtcagacatttattaacacatctgtacacccaagcatcatcctcgaatccaccagttggatgctattagattcatagtgactcctcctgctggaattctttacaaatagaaagagatcataactagttaaacaagttgaacaataatcagaagactaacccagatacacggccccaaggagtcagtttcatcagtggtttccttgctgcttcacctctgtttatcacatcctttctctgtaaaatgggaataatgataccttcctcatcctacctcagagaaattttgtatagataaataagacatttaaaattgtaacaaatgtagaggaatgtgctctttaagaatacattcttaatgttgatattttaaaagggggcagtctggcctaatctataggatctggaacctggcaggcctggatttgcctactgactcttttccttgtcttaaaatggggataataatggaatctctcccatggtgtagtagtgaagattaaatgagaattcaaggaaatcatcgtgaatagtgagcattacataaatgttagctaatattagtagttgcagtaataatttttttaagggtcccaggttgtagttgatttatcatgagatttctttgaaaaagaagactcatgcctataatcccagcactttgggaggccaaggtgggccaatcacttgaggccaggagttcgagaccagcctggctaacatagtgaaaccccatctctactaaaaatgcaaaaaattagttgggcgtggtggtgcactgctgtaatcccaactactcaggaggctgaggcatgagaatcacctgaaccccggaggtggaggttgcagtgagctgagatggcgagagtgagactctatctctaaagaaaaacaattaaaaaaaaaagttcaggggacataggaggagtattaagtattttaaaattattattattatttttgagacagagtttctgtctgtcatccaggctggagtgcagtggtatgatctcggctcactgcaacctctgcctcctgggttcaagcagttcttctgcctcagcctcccgcgtagctgggactacaggtacctgccaccacgcctggctaatttttgtatttttattagagacggggtttcaccatgttgtctaggctggtcttgaactcctgacctcaggtgatccccctgagcctcaaagtgctgggattacagatgtgagccaccgtgcccggccaaggagtactaagtctttgtggaagagtcaggaaaggctgtgaagaggagctgccctttaattgattctaaaggatgagtaggaattttccaggtaaatggagggaatagtgaatgggcagaggaaaccattctcacagaggcatggaggcattggagacaggaatatatagtggaccaaaagtaatccagtaggatgagtggagagtatgaggtcctgagtggtaggaggagaggctgggcagaggaaggcagggctcagattctgagggtccttaaatgccatgccaaagaggttagacttttattctgagagtctagggagtctttgcagcctgtagaagaggagaatacatataagaaaagtgaatgagccggcaggatggaaatctgattagcgtctggcatggctgagtatgtggcctttagtaattggacctctgcagcttttctcctccacctttgtctcggcttccacagagtgaggaatgtgatgcatgctggagacgggtaatgtgactgaccgagagccctgatggacaaggtgacgttggtgatagcccttggtgtggaacaggacctgaaagaacaggagcaggggaggttgaatagaatttagccagccttcttaggaacactcccagcaaacccttctctaaccctgaaggctttcacagctcactttgccgtgcatttagaaactcctcagcccaaccgctccctctttgttcatttgttttacattttacaaacatttgaggaaaggcactggttgtggggcatcaggaaattgttgcggtatgttccttgttttcaagatgcttatgtattgtgcggggaggggaggatgtgtatccaaaacactgttgcacaaggcagtacattgcaaatgtaagggagacacagacatttgtgggcagaatgagtaggattttgctaggaggaggtgcgctgttgggctttcaggataggaaatccatgagcaaaggtgtagagctaggaccctgcagagaaccccagcacaaggaaggggagtgctgtgtgtgtgatggggccacttgcaccatgacagagcttacaagaagaaagtgaggagggagtacggcacaaatggggaggctgttaagcagttgggcctggggagccattcataagctttgacttgaagtgacggcgtcagagttgtgctttatttaggaccttaaggggttggttggagggaatagagactgaatttgtaaagacaaaagttaagagtctgttgtggtggttcaggtagaataacagcctgaatcaggctggtggctgcggattggcaaaaagggcagacatcagggaaggaggcaaggtaaaatgctagaatcatcaggactggactgaggagactggtggctagagagatggtattgtcattgtcagaaataaagaaggaactggtcaggcagtaagaggaaaaggctctggttttggaatctgaagacctgaactcatggcctcccccaagctctgagatctccctaggttctttttaccccactgttaaaagggaacagtaatgcctacctcataagattacagtgagaaataaaatgctttattaacattgttagtgtctgtgctgttgtttaaaagagggttgggttgggtgttgagtttggatatcagacttctaggagttatccaggcaattggaaattcagtctggagttctgggcataggatggtgttagaaatgagtgtttttatagttttcaaaatgacagccaaagccatagaacaagatggccaaggggaaagtttggaggaaacagaacagggccactgacagactactggaaaaaactggcattcaggagacaagagcgggggacggggtggggaggcacatcaggagaggtcaggtgatgcgtgagcagggtgggagggaagtgcttcaagagggaaaggctgagtggccagcagtatcgaatgctgtaggagtcaagaagagggcattagagagtttagaaggccactggtgggccaggcatgatggctgacgcctgtaatcccagcactttggtgggaggccaaggcgggcagatcacttgaggtcaggagttcgagaccagcctggccagcatggtgaaaccccgtctctactgaaaatacaaaacttagccaggcatgatggcgggcgcctgtaatcccagctacctgggaggctgaggcaggagaatcgcttgaacctgggaggcagaggttgctgtgagcaaggattgtgccactgcactccagcctgggtgacagagtgagactccatctcaaaaaaaaaaaaaaaaaaaaaggccactggtggcatgtgacaactgcggtttcttctgtagtgggcagattcccattgagtagatggtgggatagtacagtcaacacgcgttgatgactctcgagatgtttgatggtgaaaggaaaaacaggagatggtagctttgcagataagcaggggcaagggaaggggggtggttttcctttccttagtttaggagcttgtttggagtgggaggaagagaagaagagacaaggagaatatttggtgcgggggaagagagtcacacatgctgaaggggttagccagccagggaaggagcaggggtgctctcagagacaggacagctgggaaaggctgagggagtgattgtggaaattaaatccagcacctcatggaaagcagctgacgggttgtcatatagtaggagctcagtaactgtttggtcggttggtcctgccttctgtctgattcccttccttgtcctgagctcaaactcatttctccagctgcttgctggacatgtcacctgagccacctcagttaaaaatcttatctctaaaatgtttctgagttcctcccccattttcctccatctttctgtcgtcattatctcttgcctgcattattagaattacttcctaactggactccccccttactggtctctcacttgctggtgcacacttggcactgctactcaggagatctttctaacccacagccatctgatcatgttactcccctgcctcagcctacgggtgtctcaatgcctggtgcagaaggtgtgtcgctgctgtccgtctgttgtgctgcttccacctctcatgtagtctcccgacactccatgtcacccatgctgctcctcaacacactgagctgcttcctggtccctgaacttgccatgatctgccacgccacgctttgttcctctggctaggatgtccttcctccttctgcaggcccagcacttgttgacctagcttggcatcagccctttgcagaactgtcctcggcttccccaggcagtgctttatgttctcttcacacagtcctagagtgcagcacttgagctgtattgcaattaattaatttcctgtctgcctcccccactgggctgtgagctcactaggggcacctgtagtcctagtacccagcatgaggcttggcataaaacctgggagagcctcggtggctgttgttgaatgaagtagcgaatgctctgcttgatggagaggtctgtggcactgtcatgttttaacttggtgtgtgcccaggttttctctcaggtagagaggacccctgttcctctgcagtgctggggtcggggggtggtggcctttgttaggtggggttcctggctggctggttggcaggctggttggtcaggactccctctcctgctgatgtctgggctcttgtcaccagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcaggtgaggaggccgcgggacattttggggtccccattcttcacagaggttggtgactgagcctgtggcacttggcgtgtcagctccatcctttcccctcctgaggcggggaaagagtgtccaggtgtctggagacgtgggctccttgctctaattctgcacttccctgtcactttgggaagagcacgagagaggccagccgtgcattctgtggccattctctgtgggtgtgtttcttttcccttcagcctgtgagcctggaaaccagggtcatggagaagagccttttgtgcctctggtagccttgcggctcttcctggcagcacccagaagctagtgggagttaagggagatagccgctgtgggagtctgggcccttctgatgactctacagcagcagctctaggaaccttcccactgtgctcctccggctcaaggaggagctgtgagccggaggggatcggggcaagcctggacttgcggatccaattactggggttatgatggtcgctccacctcactcattcactaactctcacatagatgtatgggttcatctacacgcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgagtgggaggcgccccaaggaggggaggcgtcagcagggctgcttgggtctggttatgtgcaagtctgaaactgttctgagactgaggcctgttggtttggggctttgacatcgggtgaggctggcgagttttgcaggggtgcccagtcctctgagtaatggtcttctcaaggcttgaaccttgatctctcccttacattagactagggaaggtatcctcttggtaaaaaccaggtacccttgaagacctgtcttattttttgcagaggcatagaggagggtttctcctgggccttacttgttaccttcagaaatgttttctgcagaggattgggctactttgaggaggtgacaccaggtaggtagtaccttcagaggggcaggcctggggaagaaacggagaagacagccataggaggcacaggccacagtcgagaggccctgagaggtggcctcctggagcctgggaggaggatcggccagtgcacagcccttgttgagaggctcctgtgtgtctggtactatgtgaggtctgatgatacagcaatgaacagggctgtccagaggctcccaaaaagcttagggtcgagcgtgattaaatttttaagcagctattcctgctcggaacattaaaaacaaccaaaaagtgtttaagcagctcatctaatagattaactgagaaagaaagggagcagagggctctgtgttggatctcattgctaagcttgcctttgtgacccactgatcttcctccctggacagacagtgggagtgctgaggggagcggcaaggcctgtaaccttgtgcacatctccacagctttcacagcaggagtaaggaagagggagggcgggaagggacagagtcagagacacacatgcctcgagtgttccctcggcaaggccttcccaaaacccttccccatttctcgattccttcagctgcctgtattaataaatgtagtaaacataagcatctgttcatagcaaacttgatcaagttgctgcacaaacacaggttctcaagcaaattctccctaaactggagagcagtaaagagaggcagagccgtgtgaacactcgtaggctctctgcctgaggcttttgggacctcagcatgccttcatttcccatttccttcaatgttgcaaagggccatgaccagcttcttgactgggctgaggaaagctgcttgccaggaagggatcttagtggaagatccagagggcgtatttaggggagttgttgggttgatattaagaagggtatagaaactggttgagaataagcatttttccagctgagctacagtgagtaagaccaattaatggaaatatcttcaccctggacaaaatgttacatatatattatctgactttttggttgtgatccaaatgttaacctttctgtagaaaacaatgaaatatttcattatagtcccatggcatttgacttctaggaaaaaatatttaaaatatatagaaaacagccgtagagcactctcttctccaggttgggaagagcaaaagcaagtctgcattgggttggaaaggtggccgaagggcacaggaagacgtcgggaagactgtggaagtgtcctggtggagggagagggaagtgccagctggggtgactcatctaggagccatggaaactcagtgggcgtctccgtgacacactggaatggatagggcactgtgtaaacacatcatggcagcttttctttcaaattttcttctggtttagtatggtacaaaattgtgaaaagtttcctcccagaggcaaccagtgtttccagtttcctgtgtacctgccagagatattttgtactcagatcagcaaatgtgtatatgttctctccctccaattttaaacattcagaaaaggtgaaagaatagtataaccaataccataaatccaccacttagatttagcaatcattaacattttgccatatttatgtgtctatatggtgggtacatatgtgtatatatgttttttatttattttaattttttttttgagatggagtcttgctctttcgcccagactggagtgcagttgtgcaatctcagttcacttcagcctccgcctcttgggttcaaatgattctcctgtctcagcttcccgagtagctgggattacaggcacgtgccaccacacccagctaatttttagtatttttagtagagacgaggtttcactatgttggctaggctggtctggaactcctgacctccagcaatctgcccaccttggcctcccaaagtgctgagattataggcgtgagccaccgtacccagcctgatttaatattttttaaagagacaaagcctcactctgttacccaggctagagtgcggtggtgcgactgtagttcactataacctcaaactcctgggctcaagggatcctcccatctcagcctcccaagtacctaggaccacaggcgtgcacaaccatgcctggctaatactaatttttttagagacgagatcttgctatgttgccaaggctggtctcaaaactcttggcttgaagtaatcatcccaccttggtgcctcccaaggtgctgggattacaggtgtgagccaccgtgcccagccaagtatatatgtttagtttggttttttttttttgtggctgaatcacttaaaaatagtggacatgtcttcatcccagacaaagtcacaatgtagacattgtgacttttcactgctaaacacttcagcatacagctcctaaaagtgaggcctgtctcctactgtttttacaatcaagaaaatgaagaatagttacctaatatcctcaaatatttagtctgtatttatattatttcagatgtttcccaaatatctttcagctgctttttttaagccatgaatcagtcaccagttatcccccactgccttttattttctttctttctttttttttttttttttgagacggagtctcgctctgtcgcccaggctggagtgcagtggcgcgatctcagctcactgcaagctctgcctcccgggttcatgccattcttctgcctcagcctcccaagtagctgggactacaggcgcccgccacgatgcccagctaattttttgtatttttagtagagacagggtttcaccatgttagccaggatggtctcgagctcctgacctcatgatctgcccgcctcggcctcccaaagtgctgggattacaggtgtgagccaccgcgcctggcctttattttctttgagatggagtctcactcttgcccaggctggagtgcaatggcgcaatcttggctcactgcaacctccgcctccttggttcaagcgattctcctgcctcagcctcctgagtagctgggattacaggcaactgccaccacatgcagctaattttttttttttttgtatttttagtagagaaggggttttcaccatgttggccaagctggtctcgaattcctgacctcaggtgattcacccaccttggcctcccaaagtgctgggattatgggcatgagccaccatgcatagctgaacactcacctctttttatgatagcattctatatgcaacttactttttttttccccttaaaagcatattttggagattagtccatatcagtagataaaaatttcttcttttgtacagcacatttcatacacgtgccctgatttatgtaaccagtccttacggtgatatttggaaacatttattgttactggaaggatagtaatagtaataacaggtgcaattgcttaaacacctagttcctgctagttgtgtgctggacacttcatgtgtgttgtgacatttaaacatcaagtgaccctctgaagtggatattgttatctccccattttacagatggggaaactgagggccagtgatgttaagttgaatccactttttgttgttgttgtttatgagacacagtctcgctctgtcacccaggctagagtgcagtagctcgatcatggctcactgcagccacaacctcccaggctcaagtgatcctcccacctcagcctcccaagtagctgagactacagcgtatcctgccacacccagtcaatttttcttttttttgtagggtgggggaaacagagtttcgctcttgttgcccaggctggagtgcaatggcacgatctcggctcaccacaacctccacctcccagattcaagcgattttcctgcctcagcctcctgagtagctgggattacaggcatgtgccaccacgcctggctaattttgtattttagtagagacagggtttctccatgttgttcaggctggtcgcgaactcccgacctcaggtgatccgcctgccttgacctcgcaaagtgctggggttacaggagtgagccaccgtgcccagccttaatttttgtatttttttgtagagacggaggtcttaccaggttgtcctgcctggtctcaaactcctggcctcaagtgatctgccttccttggcctcccaaagtgctggggttacaggcatgagccactgctcctgacttggattcattttgatggctcaggacagttgtttccctgactgggtttatcttttttattgtttgcaagtctcctccgattttgacgccccacatcatcgagtcaggggttaacgtgatttttgcccagcccagctttcatccacatctgcttttgagcccctgtgtccacccagcagcaatctctttctctctcgtcctgacacttcctttctgtgttggggcaggtgggcagcaatgctggcatcgtggggatgaccaaagaacacctgggcttggcactggcactcaatgtacctgtctttgtggtagtcaccaagattgacatgtgtcctgccaacatcctgcaaggtaagtgaagcctccagctagcagcagcccctctgattggggctgtcacctgctgtgccttcaggtggtctgctaccacggctttagcccagaaacttcttttcttttttatttttatttttttattttacaatatgtttatttttattatgtgctctacattgaacacttcagcaaagaaaataattataataatttcaaaatgcaatccctggatccaataactatcctttataatccgttacactggtcagtatctagaaatatatgtagacaaagttagctaatgaataaaataagtaaaatgactaggtaaactataaatttcaagcatgagggatcatgcatgatcagttaagtcactctgccactttttaaaataatattcacatttgcttcaatcacataaacattcattgcaggagttaaatttgactgctgataacaattgaaagctgtgatctttgttagcttaaaagaaaattcagcttaatacaaagacattcaagatgaaaatttcaggacccttgatcagaagctttcaatgtgtgttgctccactttgttgtaggcaagcttcaagtaaggctaagacagaagagtgtttctactgaagatgtgatctaagaattgccttctacagaggcgaattatattctgtagaaactagctagccaccaagatgttaccaataaaggattccttatactagcaactaaccatgtttaaaaggccttagccatttagagtaatatttatgagtacaagcataattggttccttgccttctacagataatcatctataaaatgataaaagcaggcttcaactgtgtttcttctctggggtgagaaggtgcagatacacatgggtgatctactgatttaccttctgaaagtactctttggaagcagctggatttggcttgattgtaggagaatccagtgtccagtttgctgggcagacttctccatgggtttctacatactggaacgccttcaccaagtggagggtttcttccacgcttcggcccactgggaggtcattgacgctcaagtgcttgatgactccattggggtcagttatgaagagacctcttagtgcaagaccagaaccttctaacagcacaccgtagtctcaggaagtttgctcaaatctgacaagagtgggatgttcatgtggtccaaaccaccattatttcttggtgtatttatccaggcaagatgactaaagtgggaatccactgagaccacaacttcacagttcacatcatgaaattccttagctttgtcactaaaagcaacagtttctgtaggaccacgaaggtgaaatccaaaggatagaagaaaagcaccaaattatttccccttaaagtcatcaaggcttaggtctttgaactctccattgacaatggctgtacccttaaaatagggtgcatgctgggcgacagcaggtgcatggtatgaggagctggtgctaaagaattttgcttgactggaaccagaccataatatgtttgtcaagctcgttcttccagaagcagcaagcttgagggctgcagtggcagaaatgccccaaggaatggcactcacatgtcgggcagccgatgctcagagtagccttcccacagcagctaccatcttcagtgcacgcgggcgaaacttcctttgtcttgtacttaggtcttggcctgaatttccatcagcccagaatcttctgctacttcctcccctatttagttcttggtctgaacacagcctagaattatcctcttccttgttccttctggttccaaatgcagaaatcttgagatcctgaatctggcacctcttttcaggtgaccccaggcagaaggagttgggctctaccagctaagctggatatatacggggaagtttggacagagggtctgattaccttttgccaccaaagctttgacacagggttgcaggactaagccttcatgcctttctccctcactgctaaagattgtagaaaagtatccctttgggaagcctcataataagggtctctgtagacttctaaatgtctaagagatcctttttgttggatgagatttttttccaggaagtagtgcattctgagaactgaagtgtgaagtgaattgtttttcttggggaccctcaagtcacatgcttacaggaggcaggtcgtctagacacaagagaaatctgccaggtttcagacgcagaaccctagaaaagaggccccatctgtgcttttcttactctagcagcacccaaagttttgatcctcctttttgcttctccaggcattgtggcatttaacactggtccatctatctgtctgtctcctgcttgcatcagtaatgagtggacccatcttgctcttaaagcctggccaaagagaaggctgtgtccccctaattctgttccattgcaccctttaagaaaccctgaagctgttacagcgcctgctgaagtcaccaggctgccggaagatccccgtgctggtgcagagcaaagatgatgtgattgtcacagcctccaacttcagctctgaaaggtaacgcgtggggagcgcacacttcagacaggcacccttgcaggcaggaccacagtgagtgatgggcctggaatggctgtcagtttgggcataaggtctcatgaaaacaccacatcaacacctctccctattcagagatcggaggaaatagaagcttccaatcttagcgcagggtctcccaagccagcattgttgcccaggggtaatatcacgtaacccagattgtgaggtgctggcattcctggggttggcatcccggctgagacttcagtgtccttatctgtgaaatgggaataacattcccttccctgtagggctcccgtgaatgttggaaatgaagtatgtagagcacttaatgccctgcctggctgatggatggtaaatacacagccatttttgtaactcagttttttatactgttgttcctcaaaagctcactaatcagatcagttttggcatttactcattaatgtattctttcattccataaatatttattggatgtttgttctgcgagactcttcatctagatgttgaggattcagagttgaattgaacacaatccttgtcctcaaggtgttcagctccttggtgagagatgctctctcgataatggtgaactctactaactctgcctgtttgcccagagcttggtctatagcgccaggcccagagcagcctggctttttgcctatgcctctgccctgatgtgatcttcagtaccatcagttagcctgcagagggggcacatttcagacagccccatttgagcttgttgatattcttgagtgcctattctgtgcaggcactattctaggagctgtggggaatgtgtaattcgtgatctcaaggattttaattcagtcaccctgaataggagcaatagaggccatttacaggactctgatgaaaaatcagatgcagtcatgtgtaatagagaaaaagctctccaggaactcagaggagtcaagagtgtccacccaggaaggatttcatggaagaagtggtatttgagatgagctctgaagggtgagagggcctggtagttgcataaaagggaaagaattcaggaaggaaggtcagagtgagcaaatccacaagggcagaaaagttccaaagttttaggagaagggagagttctctggtgtggctggaatataggaatttgcgagaagtgaatctgcagagatggctacaagcccaagccaaagggctgtgagtgttgggagagggatttggggtatcttctctgtggtggaaaggcggttaaggattttaagcaagcatgcgtgtgttttaggaagaagcagtcatgaggttccaaactagggcagtggtggaggacagagaggagaggacaggtgtcagagacagaactgagtgagagaagaaggcctcagagtagggctggccaggagcttgctaggtcagggcaaagaggtcaagcccttggaggcaggtgagggagaggtggagtcatgaatagtggcatctgctcctcgagccctgttgctgcccctggtctgtgtcagggcaggacctggtctcctgagtgcctctctccttttttccttcctcttctccctctgcttaggatgtgcccgatattccagatctccaacgttacaggcgagaacctagatctgctgaagatgttcctcaacctcctctccccccgcaccagctacagggaggaggagcctgctgagtttcagattgatgacacctactccgtcccggtaagtggctctgggcgggtagctgggtgggcacttcctacagtggcatcagggggtgggtctgtgctggggatgcacttatgaggccagggtcttctccttggcagggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaaggtgagtagcgatgatactgaacgctcccctcagactccatcatgctaggctcttggccagatgccctgctcacccactctagtcctcatggctgctctgcaaggtcgggattactggcttcatttttacagatgaggaaactgaggctcagagcccagggacttgcccaagacacacagcttgtaagtgctagagcgaggaatgcctccttctaagctccgttcctccctctggtgcctgagcagggtggcctgagctcagtggtgaggtcaaataggagtatccctgctgtgcaaggatccttctacataggaccattgggatctgcgccacatcctcttcccattcagccttctatctcctggggtttggggtgggttgtagttcaggggtcacctacctttacccaccaactaaattaaccaggaatagtaggactttcttccccacagtggtcaggtcatgcccacctgttgttccccctgaatgcttgcctgcctttgcttcctcatgcgtccttcatggccgagcagctgaagtgctgattcccgcatgaagccttcctgacccccagtagtagtgttgagtcttcccatggagcactgagggtgctcgtgctgtccaccctagaaggcctgtggtccagttggtgaggaaaccaggcagagttggggtggtccctatccctagaaagactcttggtccctgggaccaggggtgaaaccagaaggcataattgtccctgagggctggggctccctctttctttcagatcaagcgctcgtccatccggaagggcatggtgatggtttccccacgtttgaatccccaagcctcctgggagtttgaggccgagattctcgtcctccaccaccccaccacaattagcccgcgctaccaggccatgggtaggtgtctaaggccctgccagcccaggaggccgtcgtgttagctcccctcagaaggtgttccagcaacccaggccccctagttccagctgcagctgggtggtaggcctccttcctgtttagtgatgccgttccttctgttctacccatgagccgcagtgttgattccttcccacaaacactgagggctgggctcttgagacccagacctgtcctcagggacctcacatgcaatccttcagcaaggtctgctgaacgctgctatgtgcccagcggtgttgctaaggtgctgggaacaaagatgaagtagatgggcaaggatccttccccgcagaagcccacagtccagcgaggaggtgcatgtgcagtgtgctgtaatcccaggaactgggacccttgtctgcccagggcctgggggtgggggatgacgggtgggcattagctggaggaaaaggtgggagatggtaaggcaggatcagagccaagaacaggcttcacgggggtctgtagccccagagataagcccccacccttccacagcttaagcgtatttcatgctttcactcactgcctcccgttgtcctgaagccaccaggtggctccagcctatcctgacctctggcttccttgacagtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaaggtatggccaggacagaccttgcctgcctccaggaagcaccaggggccactcctgttctgtgaccctgagtgcagggcagaggtttagtcactgccatgggagagctggacccactgaggtgtggcctcggtgccatctctctactcccttagaggtatcctgtggcctcctgtcctgggcagtggtggtgaccatggagaggagaaggtagggttagggtatgatcttcctccatagaaaactggtgacagaatgtctgggcccagccaggctcagcctccagggtgctgtcacaggttcctatggcctcactgggaccatgtctaaggtctcctctcagagcagaggtctggttggagtaagtgcagggggttatgggcgtgagttctcttggggcttaagctgttggtgtatcctggacacttgcccactgcagaccttgcccctggtcttggaggggcatttgatagaggggtttgacccctgctccgtacaaaggaggtactggccccagcctatctgagatcttggaatcagtctttggctggccttgcctccagaaaaggcccccatccatggtcaccctggggctacagatgtccttgaaggcctgcatgctcctgggactgctgagtttggccaaggctgcagcaaacactgtaatgtcctctgggactcactgggcttcttttgtgctttgtatgagatagaacttgggccacaagggaagatttcaagtcagttatttctggccaaactccagatgtttccagctgaggagacattcacttggtctcttcgggaggccctgagttaacacttgccctagacttgttacgggggcagcagcagcgtgctggggctggagctgcagcatgctctgaggagtctccaccagcttagcaatgaggagatcccggagctccacttgccaggctctgtgcaggctctgggctctgggggctggactgagcgggaggtgggagcaaggttcaccaatttctctgcaggaatagtagctgcagcagagaacaggatggagcctttctgggctgggcagaggcaggaagtgaggcatgagtccagggccatagcagtcctcagccactgagtggggatgagaatgcctcttcatccccactgcctcctgtcacagccttcctgccatctgccttgccctgaactggcaagatcaaggaatgaggagtctgtgggagaagggggctgagggtggggggtagccaagccagtgccactgccccgcagctccagcctcagcctctctccatggctcccacagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcaggtgagcacgggcccctcgcagcttcggcatggtggtgggggctgtggcttttactctgattcggtgagggtgacatgtaggcaagcctcaaacctggctagagggtctcctccacagctctggcactgaagtgctcctaagaatgaggcatttgtctctagaagctataaggcagtgcttccaaatcagggaatacagcccacctgaaaccagtttaattggccctaactagcatttggttttaatgaaataaaatagaacagaaaaatgtcgaagcttccctttcatagtaagattaagtattgcaagtattgctggtgtgagtgtccaagtgatatatgtgtgcactgcagtccagcaggtttgagagacactgccttagagggtcctcctctgtcccctccctgacgtgcacacatcctgaaggggaggtggctttgggatgtgccagtgcgcctcttactcggcatctcctgccagctgtctcccacaggcactctctcctggcgtgatgaaggcctggtgccccttgcacccctctccccagcatctttctccattgtcccctcattggaaaaggaggctatgcctggatctgtctgtccattctgttatctgtctcccatgggtctttcctctggttcgttcgcttcctttctctctctcctgctctgctttgtgcttctctgaacggccgcttctcacaccctcatcatgtgtgtcctacccaccctgtaaggaaggcagggcaggcactggctccattttagagacagaggggaggtgctgcatgcagagtgacccagtaaattcctggtcaggctagggtgaggaccacgcagcctgctcacgcatcttccgtccctgtctccccgctgctcagcacctctgctctctggccctgctcctgatgggccagtgcttctcaagctccttctctctctttcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaagggaaaggcttgctcagtgagcggtctgcacaccgttagccaccctgccacctctgtgccctgggcaggctccaaaggaaagctctggctgggactgccaggagtctcacacgctcctgttgacattcccagcagccgcccctgaggtcgatgtttgttctgtttttctttttcttttttgagacggagtctcgctgtgttgccaggctggagtgcagtggtgtgatctctgctcactgcaacctccgcctgccagtttcaagtgattctctgcctcagccttctgagtagctgggactacaggtgcacgccaccacgcccagctaactttttgtattttagtagagacagggtttcgccatgtcggccagggtggtcttga

SEQ ID NO: 16794 - DNA, 6119 bp, Human
ctgggctcaagcaatcctcccacctcggcttgagtaggtggggctacaggctggagccactgctcctggcgccaacttctgtatatctcaacactcacgattccccaaggagaaagaaaaaacatacttttattccagcatccagtatgccttgtgtataccagttttaaagttgttggtttcatctcattaaataataatgaagagtcctctgaggcagcaggaggatgtgatggagagtggcagaagtcagggtcaggagacctgagttctatgaacagtggcagcaacagcaaccattattgggcgcttacatgtaccaggcaggcactgtgctaagtgctttacatgtatgatctcacttcatgaggcaaggatactcatcagtagtctcattttacaaatgaggaaactgaggctcagagagtataagtcatttagccaaaatgtcccagccaggattcttttggatgcgctccccaaaatctgtcttctaactcctaccccatactccctccactgggagccttgtgactttgagcaagaagcttcatcccattgggcctcggtttaccattggaaaggatttgtgggcgaggttgaatgagcgcagcagatggcctgtggttatttagagcagtgcttccctggttgtttgatatcacagcgctcatacttgtgtggcccagtgaaatggaggcggaaactcaaagtttccaccttcacagggcctgactggaaggggctgaaggatgatggggaggtttcttgtattcttaaaacagactaccccttcccaacgcacaacccccagtaagtggccgtgggttcccaagcgcctctcctccctgggccatgggcgtgactgctgaaaagcgggttaggccggggagttcagaatccggagtgaatccgaactaccccagggagacggcagcgaagaaaatcttgttcttaggagaacgcaatcttcggacaccagaagttcctctatgatgctattctgtggcagccttgcacttgagccggatgaaaattgtaaaaacccaggttgggcgacaggacggcgcgtcttcccggctcctttccagagtttaggaggagccatgcagactcagccggcctttgggggtaggtggacaggcccggcgcgccctctcgaggccccttcaacctcccgggggcagcagcgccgtgtcggctatgaatggggcctctggaaaactcaggcttggaacaggtaaccccccggtttccgcaggccacaaatcaccacccgcaaccgaaggacgcgcaggctgggagcggcggcggggccaccagtgcggacctccactgagggcggcgggatccgaccgcaagggctggtccctgaggccactaaggggtgcgctgggctaaggccgcctgggggcaggagccagcgcgatcgtggcgggccagcaggcggggctggctgaggactagcagcgacccgagaccccaacccttcccacgcggaccccgggatccctctcccagcagccgcccatctagggccctgagccaataagagctcgagatatatatgattcaccgggcctgggccaatcaccttgacgcgcgctcttcgccagcacctcgcgcgataacctggcgtcctcggccttcacaataaaaactcttcgccggaaaacgacctttccccgcccactgcgctgacaccggaagcgaggcgtgtctgggagatcactccgcgctccggcggcgaaggaaagaacggactctgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacggtcacgtggtcgcggcggaaggatgcgtctgtgctgcgtccccatagagacgaagtctataaagggccggcgggcggccacggcagccatttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaagggtcccaggggtcttggctgttgccccacgaaacgtggcaggaaccaagatggcggcggcagggcggcggcgcgggcgtgagtcaagggcgggcggtgggcggggcgcggccgccctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaagggtgagtgggccaccaccacatcgtcctggtgggatctagggttaggggcctcctacctttgtatctgactcacttggccccatcactcaaatgttttgcagaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagtacttgtgcgtttgaattcctttcctggcaaagtaaccgagtgaagcgccacccacccaccccaagctggtcttaacatttcctgtgagatctgggggaggaggcagtccaaggctgaagatcggttcccagagtgggatttgctcatccctgctcggtgtaggccacgatggctgattcatggggccctggagccgtatagttggccatttatagtaagctgggtcctttgcccagagctgagtgctggttgtgtagggggaggaggctggagatctctgggagattcagagggagggacagcctgggcctccacctgtttattcaagagggcttcatgccaacagctgtcgcataaaaccctgaataaggttgcacggtctttgagatagcacacaagattaggtttcacttgttacctgaacagttctgcagaagcctcatcctgaagaaagaaatggctccttttgggaattgatgctgaaacaggacaggagctgagggttggcctccgtttctccttacggggtggaaggatgacagcctgcgcaggttctggctagagctgggcacaaaggcaggcaacagttcctgtgaaggctgttgtgcctgctgctatctaaactaggaggcctgacggcctcgggacatgttaggatggatcagtgcttagaagccacacctcactgcagcttcggacttctggcggggcgacttcgcctttccaggcaggcgatgtcttttgtcctgtgttgcggatgaatgcttgaatgcaaagatcagcgcagcccgggtaggtctgcccttcctcttgtgtccttcgggattagcctcgttttccgtctgtggaaggtggtgtagaccgggtgtgcctggggaatggctgggaggagagtgagagtgagtgcagcccaggcactgctgtaactgagcacagcacatgtgttctttcacccagtccccgcagcacacccgtgaggcagacgccacacccaggaggaattttttttttttgagatggagtctggctctgtcgcccaggctggagtgcagtggcgcgatcgcggctcactgcaagctccgcttcccgggttcacgccattctcctgcctcagcctgccgggtagctgggactacaggcgcctgccaccacgcccagctaattatttttgtatttttagtagagagggggtttcaccgtgttagccaggatggtcttgatctccatctcctgacttcgtgatccgcccgcctcggcctcccaaagtgctgggattacaggcgtgagccaccgccaccgcgcccggcctttttttttttttttttttttttttttgagacagggtctctccgttgtccaggctagagtgcaatggtgcattctcgggtcaccacaacctccacctcccggattccaacgattctcctgcctccgcctcctgagtagctgggattacagacgcccgccaccacgcccagctcacctaggaggattttgagcaaagaggtagagctgggatttgaacccaggacggctccagtctgggctcttcattttgcctcttgagctggaaacaaatggcccgtaacgacctgcatggtggggcccacgtgacctttctggtgcccagcatagactgtcacctgagagccaactgttgatggaatgcatgcagctggttgtggagaagtggcccgaggcaccactgggagtgggcatcacacatgggtcttggacctggtgctctttgaggtctttcctgttgagattctagaattctccaaaggccatgggcctccatccacatccaggtactaaataggtgttagggtgtggccaggagcatcagagtcatccagtgccagtgggggtcggccctcatttggcagacgagaaactgaggcaccaagaagggcagtgcaggccagtggtgtggagccaggatgctggggctgtgcccttcccaggcccctgcagctaagtcctcccacaccc

SEQ ID NO: 16795 - DNA, 28063 bp, Human
aaggcatttagcattaacttaggagggcagaatactccttcctgttgagtgggtcgtcctaggtcacaacaattttaatttgccttcgatagatggatcttgaagaaagtgtacaaaaagtatatttgtgatggtgttgtttgggagtacgttttgactcaaagagttaactgtgacattttactttggctcctggtctattttttgcttaacatctacctttgaatgggtaatagtcatctctataaattaccttcgaaagattgaacaattgtggagaatcagagaaatgagccccttgctatcaccctgttgcagtcggctttaatcctctgatctcctggcgtttcaccctctcactggcagccaccttccttatttacccaaatcttgttaacttgggtaggaattcccactgagaggacaaatgtggtcccagttgactggtcgctgaaagtctattaggttggagagtatttattttctaccctaaagggtttgaaacttagggaaattttgatcaacaagaaaataacagctttcaagattgtcctgacagttaagctgtcttagcagagaatcacaggatttgatagtcatggagattagttctcaaatttcaatgagaaaagttcataggagatggagtgaggaaagaaaacttgtgctgattttggtcaggctacctttgctggggaaaaattcattccataaaattattttaaaacgtaaatactatttagctttatctggtgtaatactttgcatctataatttttttgttttgttttgtttttgagacagagtcttgctctgtcacccaggctggagtacagtggcatgatcttggctcactgcaacctctgcctcccaggttcaagcgattatcctgcctcagcctcccaagtagctgggattacaggcacgtgccacggcacccagctaatttttgtatttttagtagagacagggttttgccatgttggccaggatggtcttgaactcctgacctcaggtgatctgcccgcctcgacctcccaaagtgctgggattacaggcatgagccacagcgcccggcctgcatctataatttgatttaaccttgcaactttattaattgaatattatgatcaccattttatagatgaggaaatggagactccaagggtttaattacttgcccaagagtctacagctatctaccaacaaaactgggattggagccagctgtcttaccattacatccccgctgcctcctaaagcacagctctagttcatactaaatgtattacataggccgactcatttatctttacatgggtctcatgcattacaagaagggggccactattttaactcaattcaaaaatgttaaaatcaaaattcccaaaatgtacttggtttataatatatcataaaataagtaatctgaccaattgagcctcccaactcgaagaccaagaacttctttctactcccaaaccatgcagaaggaagctgagttccccactggccaatgctgtctaattctcttaaatgattcagatgtaaaagaggaaatggcatccgtctaattaacactgcctggttaaatatagctgccaagggacagccttgggacagtgtttacagaatagtctttccagcccctcaggcctcaagttacagatgatagcaagccttccctccttatcagctgcaaacagagatgcccccaaaagtggtgtcaggccaggatgatgaaaggagaagggaaaggctgcggatggccttcatttcctgctcctggcatctggggattccgagaatgatcccaggacctagatcctatagattccggcagctcttcctgcaaacacaagcccttgttgtgtgcctgagccttgctctccggcctggagacatccatctgcccactctcctaggaactgctgattaccaggaagcaccatcggctctgctgccctccccctggcagagaggcacaatgaccacattatttctcttccagcttcacgttacagcatggaagctgttgccaagtttgatttcactgcttcaggtgaggatgaactgagctttcacactggagatgttttgaaggtaggtgacctggggccccaggggagcagtagggagtttcagttactcagtaatctgacagtccctgcctttgtctcttaagaactgcatgtggttccttttaaaaagagaagttcaccttgattccctttgtgcacccttataccagacaccaaccaggccgggtgatggaaatacagtcggcataagccaccatccttgtcctgggaggttcgtagtctggagaggggaacacatccacccaaagggctgttacagatgttcttggctaagttctcagggagcacaggtgagggaacaagtgattccatcttgaaagatgggggttgtaggagtgtgtgcaatgtgaacgtcaggaatgcactgaaggtgacttgggcttttagctaaagctcagagatgtgcaagcccatgctgaatgcagggagcagcgccaggctcagcagagctggaactcaggaggagaggttgtgggtggagacagcttgggaaaggcagccacagaggacatggctcaacaaaggccatgcacacctggccactcaggggctttttaaagcttgtcctcatcctgcacttgagttgtagtggccacttgctgagctgaagtggccttggacttctcccacattcatgcaccatactttcagactctgcatcttagcccttgggtttttgttttgttttgtttgtttgcaaaagagcataagcccttcaaaagggcatttgggagtgtgtggagccagaccccctctgcctgacctcagagcaccctcagatagcctgatccctggtcctcagatagcctgatccctggtcctcagatagcctgatccctggtcctcagcagtcccaatgagccttctcggacgcccagcaacactgaggccattagtgtctcaccaccgagaattaggtttgttatacaaagaaccttgtcagcatgtgagagggtgacattgaaagtgtctgaggagcacaaaacaccacagaatggcttcttttggaatatgaacatgcccattaggtagccttctaactgctctcaactttcaagatctagtaacatagtggcaaagcataggccttcacaaacttaaaatatgagttgggcctcctgacccaggaaaacctgtctgtcactgctttggggtcttacgaagctcctggagggacttgccaagcagcgagaagttcctgccttctctgtggggcactgtgatcatgtgactgtcatccactggagaccatccttgtaccaacttccaccctcgtcttccattacaaagagaacctggtatcttaagttttctctattcctcagaaaaggaaaaaggaaagaaaaaaaaaaaaaactttgctcaactctgcttcccaatccagctcctgatttctttcctcccctttgttgctaatactgggaagaattctctacactgggcgtgcttcacttcctcacttcccactcattccacaactctctggaatctgccttttaccctccctgcaacattctcttgaagttcaccagtgatctccttaatgtgtagtataatgaccctatggaaatgtctgtgggattgacactgctaactggccctctcctggaagcccctttctccctggctttggcagcaccaccctctccgggttcttctcctcccttcctgaccactcctacaggtctcatttccaagcattctttttcctctcttgatcctgaaatatacacttccctgaaggtgctgcctttggctttctgatttttcttctcactctgagccacctcatccacttcttcagctgcaactatcacctctgtgccaaagaccctcaagtctgtggctcgtgttctagctctggccttgctcttgaactccagacccagacttccaattgtctgctggatgtccccacatgaactccagcccctaactcaggatgccgagaatcactcaaacccccatgcccatctcacccccatttccacccaagccactcttctttccatgttctaattattatcctaggtcagtcacaagctagaagccccaattatcatcaatgcctcctttaccaaatcctggtgaccagtaaccaacgtctcctgagctcctgttcagggccaggatctagctaagtggtttgcaggcatgatttcatcatctcagcaaacctgtgaggtaggcattcatttcccctccatttcatagatgagaaactgaggctagggattaaatcacatgtccacagtcacacagctagcatgtgaccaatccaggacctggacagaactctgtctgactcctaagcactaaactctgctctgaatgtatttttttcctcatatctctcaagcaagtctcttcttcaccagaaaggagtgtgaggcagtaaaaaggagcatagactttgagtcagatggatctgagtttgaatcccagcttactaaccatggagactggggcccagtcatctgccccctttgagctttagtgtcttcctcagcaagtggaggtagtatccatcttgccgggttgtggagaggattcgaggtgatgaccctgtcccaacgtagacgcccaataaatggtggcccgcattatcgggatcatccatccccgctgcttctgactgctcagatcattgccacagctccttgactgacctcattacctcttgtctttttcctccttcactcattcttcttactagtcccagagggatctttccagacaaatcagatcatatcatttccttgctcaaaagcattcaggggtttccaattaccaattgattgagactgaaaacatctggccccaaaccactgtccagtgtcattatgcacatgtacacatgtgtgcacacacccacacagagacatctttgtagatgtaacgcccccaggttgcactgcaatgtatacaccgccctttctcagcctctcccctatatactctgattgcccctctcctacacacacatacttgacctcctctaccatggaaacctcgctggtcctctccactccctaccatcccagggaaacaaatcactccctcttcagctcctccccaacatttcacataaacttcactcatttccaggcacttatgactttgcctcacatggcagctatttataggcaggccatgaccctgtggtctcatgcaccctctatttctacctctcattgctgcctttgccccgtgggatcctaattgctcgtttatgtgttgtctactccactagcaaaagctgtgcaagggcaggggctgtttctgcctcaatgtctagaagagctgtgcctagaactccctgacacttgacgaatgaatgaactttcaattcctctccattccctgagagcaatgtcatgcacgtgtgcacacaatgccaggttcgtctttgtgtcttcacagcatctaacacaagtcatggcccaaaatagatgcccagtacatatttcttgaattgctaaattgcatttcttcctgttcatttagaattccattggaaagccaaccccctccctcttttcaaattctgtccattgcaggtaaagagcaaaatggggagggcttgttgactgagccccacagaatgtctacaggatggtgattggttcccatggctgggactccccacatgtgattgcaatgtctgccccccaccttcctcaatgggtaacacacccaggatcctcacaaatactttcaaagccagctcctgactaccccagcaattcgcttctgggattctctgacttgtttggccttttgtgctaaagactaaacagaggttttcattagaaaggtacaaaaaagtctgagcagccacccaccctcaacagaccatcagtttcctggggcagaggccccagcttatttatctccatatttcatgcacctaagtgcaatcagcaggtgctcactagatggtgatctacacggcatgtagatcaagatggtggacaggaaaacgctgccaaatgacttgatcctgcttctcctatgacggaaacatttggaaactcaggaatcagatttttttcctattcatgccacaaaccaccatacctgcagctacacacagcaccagcctcacatttgaatttgccattaaatttgccagtagctttgaaaaatatctcttgacccagtccatttctgtctccttctgtaatgcagctaatgcgacctcatttcttcctgctaaaatagcaacctaaaagcactaagagttaattccacataattcatttcttcaatacttcagatttttgctatgtttctaaaagctacaatttcatccaatttaaaaattcttccagccgtaatttggcccttctcttcccacgtctaacttattcacaggccatgtaacccaaaaaatcatctcttagggaacattataagaattaagaaacagtcaagagtaaaacttcaagtgttcaggctgaacgccttgctcaggtttacacgatgggtacacgagatagggggaaccgaacagatggagagatgagaagaacaggaagtgtggggccctgggcccacaacggcaggaggaaaccatctcccctcccctcaaatacttttctttgcagaaaatgagaattttttttaaaaaaaaacctcaccttctatacatggtaaagagcctgcaaattcacctctctagaaacacagtgttaggcagaccaagcaccaggtggcggagagaaatggctggcattgtgggataatctttcagtttctagaggaggtctgaggcatgataactaaaattacagagctgctttcaggtcagaaaatgaagtacaaagtgtgtggtttttttttttttttttttctttttgagacagagtcttgctctgttgcccaggctggagtgcaatggcgcaatctcggctcactgcaacctccgcctcctgggttcaagcaattctcgtggctcagcctcccaagtagctgagattacaggcatgcaccaccatgcctggctaatttttgtctttatggtagagatcaggttttgccatgttggccaggctggtctcaaactcctgaccttaggtgatccacccgcctcagcctcccaaagtgctgggattataagcgtgagccatggcacccggcctcaacgtgtggttcttacggtgacaaggtagtttccaaatggcctcttttacccctttctgtgtgacatttgctaccctggccaaacaccacattcccatgtgacgggagaaaggaattccaatgccatgaattcagaagcgatggatggagtgcagtgtgctcttgtgtttttacgtggctacgaggcgctgctgctgggtttcctagttcttttgacctagattttctgcttcctcccttgccccctcagcacacacatacccacatgtccttagtgacaccagcagtcacatttgatgttagaaactataaagttttctgttctcagcaatctcaaactcaaatatgggacacacttttattccttcagaataaatgactaaattcaaaacatacacacataatgctttaaagaacgtataaacccttccatgtcctattcagagctggaggcctccctcataagaataccacatttgatggaattgtattttttgaaaagagtctacactttctgaaggactttcaggtaccagggctcatttgatcctcacatcagctctgtgaggtgctaggtggctattattatctccatttttcaaatggctgattgacttggccaagatcacatatctagtgatggagccaagctagaaaccaggtcttctcgttcccaactcacaacactgtccccttccttccaccttggagtgatgttagaaataggtcatcatctccactcaagcacttagttctttccattatcttcccatcttcttttctgggagaaagaagcccaagggccctgtgacttcaactccacccactttctgatgactctgaaaccccaagccccaaccttagcctctctcctgggtccagactgacatatccagctgctccctgagcttttcttcttagttgaagaattcaactcacagtcacccgcatgcaatctgaagcccatgagccctttctcagccctgcctcctctcatgtatcttctatttctgtaaagccgtcaccacctactcagtctcccaagccagaaatccagtggcatcccagagtcctcctctcccttagcttccaagattggtcaagaaatcctgcctgtttgcttcctgaatttctctaaaatatatcctcacctcttcttagcctaggccctatcatctcttgactggaggcctgcgctcatcttcctgcagtttttctgccgactttagccttgcaatctatcttcacattctgatctctgatacagagctctgtcgctctctcgctctctcttaattagagacagagtctctctctgttgtccaggctgtagtacagtggtacaatcagagctcactacagcctttaactcctgggctcacaccctcctcccgcttcagcctcctgagtagctgggactacaggtgcgcttccaccacgccttgctaagttttatttttattttcatagagacaaggtctcgctttgttgcccaggctggtctcaaactcctgggctcaagcgatcgtccacttgggcctcccaaagtgctgggattacaggcatgagccatcgcacccagccagagctctttctgaactctaattcttactgttacttccctgctcaaaatcctttaagggctccccctacatttcaagatattcacagtctacattccagccacctggaggcatttcattcccagaacacaccacacctcctcagagctgaaggaggaagtccattgccatctgacttggcctcagtaactcctttcgttgccaaggcaagtggtctctcctctacatatggatgccttttctatctatttctgctttcttctttatcatcacacttctatcagttaagatattttcaggagcaagaaacataaactaaaaatggcttaaacaataacaaagacttgtaatttctcaaagtccagaagtaggaaggctcctgggtatcatctaattcagcggttcagtgacattatcagagttctttccatcttttgctctgctatccttatttagaattattgttctagtctatatcaaagacttaaaaaaaattttttttttgagagaggcttgctctgttgcccaggctggagtccagtggcaagatcacggttcactgcaaccttgcctcctgggttcaagcaattctcctgcctcagcctcccgagtagctgggattacaggcatgtgccaccaggcccggctcctttttgtatttttagtagagatggcatttcaccatgatggacaggctggtctcgaactcctggcctcaagtgatctatgtgccttggcctctcaaagtgctgggattacaggcgcgagccaccacacctggcctcagactttcaaaacattctcagtggcggtgtcaaatattttgtcttttaatggtgaatctcattttttgagaaaccagaagccacatacagtcaagtctggtgagtaatatgagtaactgaggtagacaataacatttggggtcacagtcaaagtcaggccacagagtaacaagacagaacttttggttttgtttgggatctggctttaaaagcaagtttagaaaaggcatcccaagtatcttgggttccagccaaatatctgtgaaatacacagcatgtgaacacaaagagttactgtttccaaagctggccccactgggatgtttaagttttaatctgcctgtttaaaaaacaataacaaattgaatttttgaaaagtttcctgggcctggtggctcacgcctgtaatcccagcactttgggaggccaaggcaggtggatcactaggtcaaaggatcaagacagtcccggccaatatggtaaaaccccgtctctcctaaaaatatgaaaaattagccaggtgtagtggcgcatgcctgtaatcccagctactcaggaggctgaggcagggggatcgcttgaacccaggaggtggaggttgcagtgagctgagatcccgccactgcactccagcctggcgacagagcaagactctgtctcaaaaaaacgaaaaacaacaacaaaaaaaagagaaaagtttcctggttacctggaagagaaaaaaaaaaatacaccgtggagtaaccattcttccttcccaccatctgctgagatgaggaacttaaggtgctaactgggacaaatgaatttccaaaatagaaaaagggattcagggaagtccttgagtgctgaatttgggaggccaagccacagtggggtgacatgagtggacggcacaagtggacagaaataacctggggtcaggagaagctgactccaaaggtaaacccacggctcctccacaggcctggggtaaatcctagaacagctgttgagttctttcaacttattaacatattttcctctaagtccaaaagggccttctttgcctggcagcccctttctcttgtttttttggtgtcctccctccaatgtctttgtctttccttttcttccatgtagattttaagtaaccaagaggagtggtttaaggcggagcttgggagccaggaaggatatgtgcccaagaatttcatagacatccagtttcccaagtaagtatctgcagcctgctgagatgggcctagccacacacactcctcttacatttccagcagtcactacagttatccatgggaacccaagacattgtcaaaaatggctgcctctggagctctctccggagagcctccagagcatgcagctgaaggccagggcaggagggagactttgcatttcatttcattcccttttgatgtttacaccatgtgcatgtattgctattttaagttgttcttaactttttttttttttttttgggagttggggtctccctctgtcacccaggctggagtgcggtgactccatcaccactcactgcagcctaaaactcctgggctcaagccatcctctcacctcagcctcccaagtagctgggattacaggcacatgccaccacgccaggctagtttttgtatttttagtagagacagggttttaccatgttggccaggctggtcccaaactcctgacctcaagtgatctgccgcctcagcctcccaaagtgctgggattacaggcgtgaaccaccatgcctggcctattttaagttttgggtttttttgggtttttttattcatgtgtttatttgttttgagacagaaccttgctctgttgcccaggctggagtgcagtggcatgatctcggctcattgcaattctcctgcctcagcctccctagtagctgggattacaggtgcatgccaccacacccagctaacttttgtatttttagtagagatggggtttcaccatgatggacaggctggtctcaaactcttgacctcaggtgatccacccgcctcggcctcccaaagtgctgggattacaggtgtgagccactgcacccggcctattttaagtttttataaaatgagtttgtaaactcaaattatctatagtgatttcaatcacggcgttccccagaattccaaaggggacgctattggccaccccacttcgggagctgctctcctaagcgcttctctgtgacctcctaatcctaaccatcctcaccaggctctcacccttcactcagtgggtggacagacactccctgccttcagtaaagcatgctcaccccaatgagagaagtcagcggggggaaggggaaattctcttcctaaagaggaaatgaaaaattgagattgggcttcgtttgtctcaagaattgaccacaagggttagatagaaatctaatcttgcctcagaaccagggtctagctcaaagagcaaaagcttgttagaaaaccacagtagtattggtgactccagcaaggtgcaagagcaccagtcttggtaaacctgaactgaccaccaaaccaagagaatgaccactgaccttgacggaacccttgatgctgcccaggaatctgctaggtgacctctgcataccccacctgctcctcaaaccttcagcccctccgtgcatcactcttagcccgtgaccttgattccaggttctctggaacaatgaaagccaccagaagtgaagctcccagacccccctcccccaccgcatccacctgcctcctgcaagtgtgctcaaacagtcggcctttcctgcagctggctggaaggaactgtcactgcttctagcagaaattctcctctctctctcttccacgtcaacctcctttccctctctgctggatcattcctgtcagcaaacacacacgctgcaatttctcccaacttaccaaaacacaaacaaataaaaccaaacccagaggccaggtgggttttgttgtggctgatgcctgtaatcccagtcctttgagaggctgagggaggaggatcacttgtggctaggagtttgagaccagcctgggcaacatagcgagccccatctctacaaaaaatttttaaaaattagctggtcgtggtggcatgcgcctatagtcccagctgcttgggaggctgaggcaggaggatcgcttgagcctgggagttcaaggctgtggtggaccatgattatatcactgcactccagcctgggcagcagagagagactctgtttcaaagaaaaaaaaaatttaaataaataaataaatcaagaaaattcttaatcccaaatccccttccacttgccactccatctcttcaaaaggagtgtgtgcatttgctacttccaactcctcatctcccgacccttcccaccaggctccccatgggctgtagctcccaggggtcatctcagcatgacctgccctggggatcccccctcccactggaacacctctttcattttggctccaggacgtccttcctccggttgtcctcccactgccctggcttctcctcctcagtctcttgtgttggttcctcccactccccagtcccctataggtttagaatgtctccttttcagtgaggtctttctcatcaccataccttacattaatctcccacccacagcgccccatctctcctctcagttttcatgttctccacagcacttaccatcatctggcacgcttcagatcttaattattttgttcttttgtgtgtgtccccctcgactagaatgtaagctccctgagggcaggggtgtgtgtctgttctgcccactactgtgtccccagtgcccaggaggggcccagcacagtactagatgttcagtaaagctgttgaatgaatgaatgaatgaatgaacgaacgaatatgtattattgaaaccatgaccactcatgtctaatatgcaatgtgtggtgatttttacaaatctttaaagaagccccctatcagattgcagtcagaggacaaatgtgtatttcctaaatccccttcacttctgaaatgtttcctttgcgatatggctgctgtggtgcatactccattcctcttcccatccccattacatttcccacacgtggcagtggtgtgtgtggtggcctcttgtttagccctgtagaattgtgtggcaaatactcaggcagaatctccaggccaccagaaactgctgctttcagccctctcagagcacagccaaacttccccctcagtcccagtgggggactcagtctccagtaagtacatccttcctgctacctatgtctcaggttcccaaattctagaaagcacagagaattgctcacaaaggaatccaaagccaaggcctgacgggcttttatcttaaaggaacatgcgtatgagccttctggtgacagcaattagagcagccaccttgaagcaatgtgacacagtcccacctttggccgctgagtgattgcagacactcattttgcttgtctgtggtggagagaggtctctggcctcctgctttgaggctgcagccacagcttgcctggccctgtgtaagtgtttgacctatttcatacatgccacgctgtatgcagctgtacctccaggggctgccaccctgaccattctgctaaaagagtaatttctcctgtttcttcttttccacagtaaagattatttcccagcctggatttttggggcaggcccaggatctggttgtatagacgccgctctctggcggctgccagcctcgctgatttccaagcatgtacactggactccctaggaacactgcagcctctgctaggcacactgagcaaagcccccttgtgctccatgccagcctaggtaacgtgacgccctgggctgtaactttcctttaatacccagggaggaacctctaggccactgagacctcagggcaggcatgagcaccccaggccctgctcagccggctgcacctggttggctccagtgcctgaagccttcccttccctccccagtgcatcctctgtcctcgcagctctggtctatctcttccgcagctgccggcaggcggctgcttcctgcagtgagtcactcccacactgccccattttggtgcagcgacacatttccatgattcgtttcccaggctggagagagacttctcctggagagaaggaacaaagagggtgaatcaaggggaatgctccctcgcctttcctgaaagctgcctggagcactggtttgatttcaaacagcacctggtctctctctgctccctactgtacagagtccccagcctctttccctctgggtcacctcttctccacgtctccctcttgtcactcctgtgtctcatcctgatccttttgtttgatctcgcccccacagatggtttcacgaaggcctctctcgacaccaggcagagaacttactcatgggcaaggaggttggcttcttcatcatccgggccagccagagctccccaggggacttctccatctctgtcaggtactgaccattcctgacactgccttggcccttctcggcctgttaacctcacagaatgctgaagccatgaagggacctctggaatatgacccaatggtcagaagcatggtggcctaggggccaagcatggcagcagcttcacaacctgctgctcccagtgccttcccaaaacatgcacacaccactctttagaacactggtgtgtgtttgaaattatttctacgcccatctgcctccccttctagcccaggtgcttctggaagggcaggattttcctctacttcatctttatgcctttaacagtgtcttgcataaaagagagacactcagtgagtatttgtggaaggaaggagggataggaggaggagaactcccacttgtccagatccatctgggggtttaaatcttaaccttttcttttatgattgatgcatatctgaagaagagtcagagaaaaatagaaatctcaagtcactgctgtaggatatacaggggcggaaaagttgtggcacctttctttgcccatcagaggagtcacagctgacactcctacaagacaggttaacaagaggagagtggacacatttatttaatcaaagacttgtgtgacacagaagccttcagaaatgaagacccaagacccagggaaagccgtctatttttatgcttaggtttgtcaaaggacagacagccctgtagaaatgggattggacaaagggggtttgatctaaggtaacagactgaggtaggaaactgaacaaggcctgtcccaagtcttctttttttttttttttttttggagacagctgttgcccaggctggagtgcagtgacgcaatcattgctcaccacagcctctgtgtcccaggctcaagccatcttcccacctcagcctctcaagtagctggggatacaggtgcacaccaccacacctggctaatatttttttaacttatttctttgtagagactaggtcttactgtgttgcctgggctgatctcaaactcctggcctcgagtaatcctcctgccttggcctcccccatagtgacccttctagtctctctgacccactgtggggaagaggaattctaatttctatgactcactcagggggagaaagaggagcgggagacaggagggcaggagaaggccaaaggaagactttgcttccaaggctgcttctgaaaccttcccatctcctttggttcgaagcactcagcatgccaaggggtgtcgttttctgagccccaacaaatacatgtatagttgtaggcagctgaacaaaaagaaaggctacttcaacacagtacagtacagcaagaccgaaaaccacagaacagagggccaggagtgggggaggactgtaacagcgaaatctcactaaggtgcagcaacccataggaagtgactcagtccacgcgtagacattacacagccccaaactcagaagcccagttcggaacacactgtgtgtggtcagcatgttgaggatcgcaagtcacgtatcagacttcaccacatgtgaaactgcaagaatataatgctgttagcagatcaggagaagtacagcaaaaccttactgtcaagttattggcaggaaataccgatctggtttattcaatatattttgaaaggcataaagctttgttttaaggacagaaatccaatctcaagtaataaactgtggccactttgctgtttagaaagaatggatatttgaaaggataggtaggaaggacttaaaaataacaggtcaacaatttgtatgcatacatacctttaaagtggtctctttagcattgcccttgcaatcttgcttaaactcttttcttcagtaaaaactttattttcatagcttggagaatggttaactttagttcaggccaatattgatgtatcacaaattctaatcttgttaggtcttaattaatgaaatttcgctccattaacatatattacaagtcagggttgggcgccgtggctcatgcctctaatcccagcactctgggaggctgagttgggaggaatgctttaagccaaggagttggagaccagccggggcaactagtgagacctcatctctactaaaaataaaaaattaacccagtgcagtggcgcatgcctgtggtcccaactacttgggaggctgaagttaaaggattgttggagctgggcggttgaggttgcagtgagccaagatcgatcgcaccactgcactctagcctgggtgacagagcaagaccctgtctcaagagaaaaaaattatttacatatattatatacatatattattagaaaaaacaattatacatatatttaacatgcgtgtatatatattacaagtcaaatctatttcttaagcctcccctctttaccccatcataaacttgaccaagtaatttgttagactgaggggtatctcttgggcctttggtttgcatgaagatgactctggctttttcagctagaaactatggtttttgtggtttcgttggttttttgagacagactctcgctctgtcgcccaggctggagtgcagtggcgcaatctcggctccctgcaacctccgcctcccaggttcaaagcaattctcgtgccttggcctcctgagtagctgggaccatgggttcgcaccaccacgcctggctaatttgtgtgtgtgtggtttttttcagtagagacggggtttcgtcatgttggccaggctggtcttgaactcctggcctcatgtaatccacccgcctcagcctcccaaagtgctaggattacaggcgcgacccactgtgcccggacccagaactatggtttatatttccttaattaaagtgagttctacaaaacagtaggccttgacttctaccgaagtcttcccctgatattcaggcgatgaagcttctagttatggtgacaattaccgtaatccttatcacgtctttgcagaaatgtagtataatattttccaaagcaaaatcattattaattatttttacatctgtcatgggcacagataattaagagctaattgtagttctatcactcagcatttgttaagggcctgaaacaccagattttggagtccagcgccctgagtcgcatcctttcctttgttcctcttcaggcttgagacaatggtcaggccatcctctccttgtagacccagataaccagctgcaaccctcacacccatccttacagcttatgagagtaaaagggtcaatgtttcacactctgagttctttgaggtggtggatgaaaaattataatatcacaagaatattttctcctcctcacctggatgtgaaggataatgactttgagttgatccatgttgtcttagaatgaagaaagtatctgttggtggccaaaaccaaggggaagaccacaaagtgattgcaatatgttgattaccacccgaaatcagtcaagcaagaggccacttgtacaacctgtggcttcacccagctatgagcaaatcccagcacataagatgagattgagggtcagaatttccatctccttcttaacacaggtccctaaatccatccctaagaaacctccatggtcaggcgcagtggctcacgcctgtaatcccagcactttgggaggctgaggtgggcggatcatgaggtcaggagatcgagaccatcctgtctaacacgatgaaaccccgtctctactaaaaatacaaaacttagccgggcgtggtggcgggcgcctgtagtcccagctacttgggaggctgaggcaggagaatggcatgaacctgggaggtggcgcttgcagtgagcagagatcacgccactgcactccagcctgggcgacagagcgagactctgactcaaaaagaaacctccacttactctcagaggtatctttactctccgagaccctttaaaattcttgacctttcttttacatcaggcaattggcatcactagtgccagtttatttttagatataaatgtatgtctgtttgaaaaataaactttacatccaaaagagaatgacttggcaatgaagtaaaactggatctaatggtaaaggctcagcccacccttcctagatggataaaatccattttctctagccctggttcgaatgtgtcccatcacttgtgagtccagactggcaacaaaaggtgctgatctaaaagaagttatcgtccagtggcagggtctggggaaggggcggcaggcgccatgtccagccacgaaggtggcaagaagaaggcactgaaacagcccaagaagcaggccaaggagatggacgaggaagagaaggctttcaagcagaaacaaaaagaggagcagaagaaactcgaggtgctaaaagcgaaggtcgtggggaaggggcctctggccacaggtggaattaagaaatctggcaaaaaataagctgttccttgtgcctaaggagacggtgaccctttatttcatccgtatttaaacctctctattccctcctataatatcttttgccacctatagttggaattaagtgtcgtcttggagctgttgtacatttaagaataaacttttgtaaaaaaaaaaaaaaaaaaatcttccagtggctcatcatctctttagttgttttcactaagtcattcctaccataactgtgaatttaaagtaaaaccagctcagaatcttgccagaatctgctctttggtcgttgttctaccctaaactttgtatcacctgaaattaaaccaactcatttgaaagaaaaaagaagttatcatgtttaggtggcgtgacaggccaagctcactagactggagtcagagactcagggttctggcctcagcccttactcagcagtgaccttgaccaagcccctgcacctctgtgagcctcagtgtcctcatctgtaaaatggagaagtaaggctaaacaatctccaacatccttgccaattaaaactctatcatttcacagggcgcagtgcctcacacctgtaatcccagcactttgggaggccaaggcaggtggatcaccggaggtctggacttcaagaccagcctgaccaacatggcgaaaccccgtctttactaaagacttggtggtgggtgcctgtaatcccagctcctcaggaggctgagacaggagaatcgcttgaacctgggaggcggaggttgcagtgagcagagatcacaccactgcactccagcctgggcgacagagtgagactccatctcaaaaaaacaaaacaaacaaacaaacaaaaactctgtatttcatacaaagctatttcaccaaaagctgaaaacactttgtaaccttatttatgcaaaacataaaccaagatcaagagatccttattacatagagaaaaaatgtgacatatttcttaggaaagagagtagcttcttacctgccagtgctagcttatgggcttaaaggagatggttcaaagaatttctggtaacagaaagataataggagcttgaaatacccctgttgacatcttgcgaataaacattgtgaaaaggtctttgatctctttgtcgttaagtcacttggaacatgcttttcttgtaaaaggttagttccagtgtccaaaacaaattttagctcatctgattaccttctgctgatgtaaatcccgtctagcatagcctgtatcctaagtggtccatcctacaaagttcctgccgaagcctgactgggctggcccacctgcccagtgatgagtgagtcatccatatctacatctcctgctcaaagagaactccaccatcccagatgtgagcagcctggaggtggtgacattatcaccgtgtaacatacaattttgttttgccttgatctccaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccaggtatgctccagatccagtcgaccccaatctagagattttaggcagcctgagttctcacatgaaccaccaggaaaaatgcataggatgggtagatcctctgagtatactgaaagacagagctcagagctctgaggtcagatctcaacttaacacttcctagtcgtgtgactttggaaagttctctgcgcctcagtttcctcatccataaagtagggacaatggtaatatctacctcccagaatggctgtgaaggttggagaagataatgtatcccacgcctcatgtcattcctcatcacactgcgctcagcaagcatcagctcttaccacaggtgctgtttttttgttattcatagacattgctacaccaaagttttcaacctagctcaagagttgcccaaggatgaaggagttgggggtgctacagacagggacattagggaacagcctagagttcaggagttaaatcagcatgtggagttttatgatgggattgggggtagggaggacatgggaggagaaaactgcacttggaattattgctgttgcaactgtttgcaatacagactattgctttaaaaggaaatgcgtcagacagacctggtatgaaatcctgctttaatcgcttagctacctgtattacctagccaagttaagaaaccatctgagtatcagttttctcatctgtagaatggagagagcaataaaacctccctcactgggctgttgtgaggattaaatgacttaatacagctaagcactaccagagtctggtccatattaagcactaagaacatgttaacttgcctcccataagtaaattcacacatgcacacactcacacacacacacacaccaatttatgaactatttttcaaaggaaataacatggttataagagacaggtatcataggaagaagcattcactagaatagctgaaatcctagggacaggttatttgaaaagatattgagactgtgaaagcaatgtgtgctttggggaagtcaagaaaatcctcctttttcgagtccctagttgcttttaagcctgagaagttactgccaaaggagaaaagaagttaccaccaaatgcacacagaagttcagaaaggaaaacaaaggctagccaagaccttgtgaatcactctaaccaggaaacggacagaggtattaactcactaggatgggcattcagagaagcaatataaaattgcattaaatgggattaaatgagttgatatttgtaaagcgcttagaacagtgcctggtatatgctgccctcagggtcctacataattgtttgttaaatgaaactaacaatacggtatttctgatttgtaaggttgttgtaacattagggaaaaaggccttacttcttcccccacgcccagcccggcggcaggcctggttcccatggtgttgcaagaatgttgctgtttgggtctctatcaccaggctgtaaatgacagttcaaaatcatgcaaagtcaacagtggagcttatctggagggtagattgtccagtggtgtggcaacatgtgataagaaggggtggcattgtatcagtaaaatggaatatttcagcttgattacacagagaaaaaacgagcgccctagaaatggactaaatggctaccaggcaaaaagtgttagtctgtgaaccagagacctgcactcctaaaactgggaggatctgagaatgcagaggccactttggaaaatgtgaaggtctaaagcatcaattatcttttagctgcccccaccccaccagctatttcttggagccagatgagcagggtctgggaacaactgcccgagggtagggtagggccagacgatcagagaggaggatgcatctgcagcatctctgttctttctcccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggtatctggaaagaaggcagtgggcacagtacggtggaaaggagaacctgcctcccctccaggcctggcccagcctcttgagttctcagagagttcatgatgaagaccctggacccccgcaaatggcagaaatagggaaactgttcttggcaaagacatctctatgaattaaatggctcccacctgaacacacacacacacacacactgtctcacacacacacacacacttaaactcacacacacacacacttcccctgaggacccagtaaacaattgcttcattttcctatcagcacaattccaaatctattcatgccccttagcccatctggctgtcagatccacaagagaaaaaggcttaatacccacaacagagccttgtttattacttatttatctccctccacccttgttcccgatgggatttcaggcggcttactgagatggacaatacggccagataacatcattcctgaattccttagcagggcacacaaagtcctttgtgagctgccagaatctatttccccagcctcgtccctgctgcctccctgccaactccccgtgcaaacacacattccagcaaccccccacgctgccttagttacccgaatggtccattgcgtttcctctcatgcctttgtggcgttttatatgctgatctctctgcctgatgagcccctccctgggcagtcctacccctctaagctggagttcaagcatgacctcctctgtgaagccttccttgatttcccgggcagatacagacatttcttctctctgctcacttaccacttaaatgtgcatggttccccctctaaatggaagctccatgaagccagagaccttctctttccagctatatttcccttgtgtctgctactggaaacatggtaggtgcctgataaatatttcttgactgaataaataaaacctgcctttgccttctttgccttcagaatctaaggtgcctttagaccttaggtcctcctcaacgtggagggtttattgtcattatcagtaagtattcctggaatataccggctctgtggatggcatctgagcaaggcactgggggaaccggtgggagatgtcctggcagtggggtgaccagtcttctgttgtatgtttctaggaacgccgaggaggcagccttgacataaatgatgggcattgtggcaccggcttgggcagtgaaatgaatgcggccctcatgcatcggagacacacagacccagtgcagctccaggcggcaggggtatgggaactgtccttctctgggatccctggggaaaggccttgggacagaggtcaatggaggagatgaggcaggagagactcaaaccacacagatctggctgggcacggtggctcacacctgtaatcccaacactttgggaggccaaggcaggtggatcacctgaggtcaggagttcgagaccagcctggccaacatggtgaaacctcacgtctactaaaaatacaaaaattagccaggcatggtggcagatgccagtaatcccagctacttgggaggctgaggcaggagaattgcttgaacccaggaggcagaggttgcagtgagccgagattgcgccattttactccatcctgggcaacaagagcgaaactccgtctcaaaaaacaaaacaaaacaaaacaaaaatgcacacacagatcaacgagaggtgatggaatgtttggggaggcctggggctgagccagcaccgtccagtctgttgatctcagtctggtgccaggccttccctgttctcatagttctcagttctagttctttatcatctttatcatagtcctttaccattgcctttatcattgcatcttttttttgttttttgagacagggtctcactctgtctcccaggctcaagtgcagtggcacaatcatggctcactgcagattcaaactcctaggctcaagcgatcctcctgcctctgcttcccaagtagctaggtatattatttgtagcgataagctcttgctatattgcccaggctggtctggaactcctgggctcaagcaatcctcctacctcagcctcccacagtgctgggattacaggcatgagccaccgtgcctggcctgtgatccatcttgacttgtgacttgattgccctaacaccaagggctgttgtttggggcatgttgcccttctgtttgtcactcaagataaaaataccacctattgatgtggagagagtggttctcagggagtctattggggctttggacaataacatctgttggtaaaagtcctgggtctccagagtgacgctggtgcgttctgggaacttcttgctcaggcctgtgcataggtatctgatttaaattgcagcagggtagccgggcatggtggctcacacctgtagttccagctacttgggaggccaaggcaggaggacttcttgaggccaagggttcaaaaccagcctgagcaacatagcaagaccccatctctacaaaaaaagtttttttaagctgcagaggggtcagccttcagggaatgttgctctcaaagacttggatgtggtgggaggagccagcagaccctcccctgcctgcccagcccacagctcagcagagcctcttctgtgcttcccccaacagcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggccttcagctgtcactgcttcctccttgtcttgggaattttcacggagaacagctaagcagagaccacacctcggcactggacacagaacaacagggtggggttgaacttggtggggcacgttctagctgacctgcaagccccgctcacctggagggcttgcagagcagctctcctcctgttctccaaggggtgggcactgttgcattaggaattaaggtgcagcccagtgctgcgggcagccaagcgagtctgagcggggatgtgaaggcaggacggggttggagagaccctgcctgtgcaaggctggcctcctagtcaacacctagctgagacattcatctctgttcaaattaatattccttgggtctttcaaatgaatgtttcaatgtgaggagcgaagtactgggaaatcgagggattttccacaatccccaagcagcttactcagtggaacctctgtttccccagctatgaaggaaatagcatcctacattccgtaaagtgcttgaagaagctctagctgagaatgctgaattttacagtcattgttttatggttacaagggtatgtcttcagggctctgttcattttccctcttgattttctcttttgaagatgccttgcccagtggcatggaaagaagcccacttgatgataggagcctgactatgaattgattgactaaacatgaccccaggtggaagctggctttgacaccagcttcctgttcagtctgaccactgctgtcctcctgctgcccaagagttgcacctggagcaaggaaccccaccatggctgtcgctctccatcccatcacgctagaatcatgtgtccaagggctcaccctggaggtgcacagcacaggtcagcctggccaggggcgaaggagacagtagagaggaagctcagggccttaggggaggccgggtgcaaacccgttctgcaccaagtgcactcggagtttgtgggtatgggtgtgtacccctgcaggtgtgcacatgtgtgcttgcacgcacatatttgtgcactcctgtgtgtatacatgtgtgcttgtgtatgcatatgtgtgcattcctgcatgtgtggacatgtgcgtgcatgcatctgtgtgtctgtgtgtgtgctgagacaggaaagggggtgaaagtgttggtgagggagcctggaagttttctcttccccaacctctcttgctctaaggagggatggggttgggggcagccattattgaaggtgatcggagaagaaagattttctgactcagaagtgactgccagtgtagcacaagcagtgtcccttgtgactgtgattctacagttctctgatcctcatgtttcctttagaggaaagaggaaaaaaggaactctgtggtgggtattgggagggaaaagaaaatagcctggtggaggcaggagggagtcgagtgtgagtaaggagcacctgcagcttttggaagtgaaagcagagagagggaaaggtagctaagacatccaggaggatcaaggggcagcgtgagaggcacagggggaggaaagggagagggtgagtggggccagggaagagaacggtgtggagttggtgggcagatggtgcaggaggagggctgggcagtggggagaggaagaatcagagcagagaaaccgctgctgcggaaggcagggagcaaagaagcataaggaaaagaacaggagaaagaacaaaggcagagaagacctcctcagctattttggtgctaggtaatgtgaaatgctgcagtaaataaaagcc

SEQ ID NO: 16796 - DNA, 41062 bp, Human; identical to SEQ ID NO: 12761

SEQ ID NO: 16797 - DNA, 7052 bp, Human
aagtcagaaatgatgaggaaaaaaaagaaaaacaaacccccacctctaccacaacctctaaattaaacgcaatgacttaaatacacacaattaaactgtattccttttccagggacctgaaaaccctttactaacactgttctcattcatcttcagaagacccataaaggtagccatggttactgttactaaatgtacagatataaaatgcaggcacacagaatcagtgacctggctatgtcataatatcagtaatagaaccagtactaaaatccctattatcttctgcactttcgccaagtgccccttctaaatctgatcatgcatgtaaaattacttaaaatactcaaaccagccatggggctcctggtttttgcctgacggaattacttggtcaaagggttacccagtaccagggtcaatttgtataatttccagtactgtggcacctagatttatcaaatttataaaattttcaaagaggaagctacagaagaaaatgaccacagaccctgtaaactgtggtctaacctagtctatccacacaaacacacacacacaaacacacacacacaaacacacacacacaaaactatcagcttctgtataagcaacggtctgccaactcaaccctggagccaacccagacctaatctgcactacctgccacgtatcctgttgaactctaattaaaaccaagacatcctcatcttcccttctttaaaccaaacctatacacttgaatcgagctacacctacctcatgacaatcccaccttaatctactcaaaccgattcaaaatccccaatatatatcaacctgcctcgcctctctcaccaatattcaccaaactcttaaccacccaaattgccactagatgccactaaattagagacctctctctcatcaagtcccttcaaataaaggtctctcttcatctcacctcctcatctaatcgagcagacattttaccctaccccagtcctattcgtgcagataccgataccaaccccatccaccccttcgcgcaactatacccctaactccgacccagcccaactcgcccccctcaggccagcaacgccgtaggttgtagtgggatttaactccttctgcagcgcatgcgccgaaaccacagatacaaacaaggagggggtgggggaaggaggaaggagcttaagacactcctggagagtagtgcacaccctcccatttgggctcgcgctgctgccgttaaggcgggaaccggcgcgatctccattccagcgcgaacctcatcaaccaccgtgcgcgcggatccagaggctcgcgctggcggcctgagcgagctcgcgccgagcccggatactgcgcctgcgccgcggcagaggctcgtctctaccgggtccgctctcctccgacaccccagcaacgccgactcctcacccctttgagccgcttgaccagggcactcttctgcccgctcttggctaggcctcgctgctccagtgcggccttcaggtcggtcacccgcagcgcctgaagaggcttcccgtccagagtcacctcctccagctccgccatcttgcgtgaggtactcgggtccgtcccgacggcttcgggcatcttcggtaatttccgccaacgcccttcgaacgtaccgagatgaccccgcccactgccatactctacccctcgattaccactcagaactccccgggttcctccggatgtcctcggatgtttccgtctccacatcgttaccaatcaattctttccatccgccctgcagcgccccttttctcgccctgctttcaggctcggttttcttcgtcttgccgaagctttgaatcgaatatattcggaaaccctcgaccctggtataaccataatcggagatgttcgtttatttccggacctagagatgaggcgctggggcgcttgggtgtttggggcgggtccgaggccggaagtgcgtgggctgccgggctggcccagcttagggttttcaggaaatttggaagctgccgcagtagttggagtctaaggactcgtgacaatcttcgggtgcccttcgagagaaaaggggaggtaagcggggtagaagtacctctatgggccgggtcagactcggtgtttgcggattaccttaatagggcaagccccccactccttaacgcaaacagcttctgccctctgtcctctgaatcatagccactcccatcttaggctttttttggggaggggcggggggctggtgcggaatcggaataataagctccgtgggggtgcgcaagaagcatcgccgtgtcttcggacccagactatgaactgatctatgacgctgaacttgagtttgagtttgccttggaagccatgtggcaagattctgggaaagttcttccttgctccgcagaagagagtaagttcccttggaggaactgcttcctgtagggcaagaactggaaaatgcaagcgccctgaacttttttggtacttgaactaatattaattgtttaggggcttctttctttgtcactaccaatcctccaacttgatgcagaagaaacacaaacagtaaaataggtcacagacaaatagtttagagatttaagagatacgttagagatttaagagactgaaaactattaaagtcaaattggctgatctttccgttgcattcatgatgcaaaatcagtggcaaggtgccgggcgcggtggcttacgcctataatcccagcactttgggaggccgaggcgggcggatcacttgaggtcaggagttggagaccagtctggccaatatggtgaaaccccgtctctactaaaaatacaaacaaattagccgggcgtggtggcgtacgcctatagtcccagctactcgggaggctgaggcaggagaatcgcttgaacccaggaagcagtggttgagatcacgccattgcactacagcctgggtgacagagcaagactccgtctcaaaaaaaaaaaaaaaaaaaaaaaaaattgcaaggcaccaatagataccatactaaaaaaaaaaaaaatttttttttttgtcactccactctgggtccctccactctgacgcaggctggagtgcagtggcgcgatcagggctcactgcagcctcaacctcccgggctcaggtgatgctcctacctcagtctcctacgtagctaggactacaggtaggcacctctacgctcaactaatttttttattttttgtagggatgaggttttgccatgttgcccaggctggtctcgaacacctgggctcaagcgatcctcttgcctcggcctctcaaagtgctgagattactttggaagtgcaagaaccaccgcgtctggcccatactaaatattaaggacaattgtttaaagacatggattgtcataaaatagtataacacttgttagatctctaagccaacaaaccaactggactcttttttaagaacgtctcaaacacccgggcttctggttctttcatgcgttaccttattttgagcaaggtccttactctgctttttaacttttcctggtgctttacaggaaatgtaaggaggtaacggatgttatggagttgttggcatatttcagaggcttatatgcacattgaaggctctttcatcataaataatgttttttctttcttcccccactgttgatagctgcaaaacaattagcatcagccttgaccagctgcacgtactagattttaaaatgtgtgcattttcattttggagaagatgtaatggaccaacattaatcattgtttttttctttacccaacctggcacatagaagtaagaggaagagaatgaacaagaaatatattggttatttttaggttctttataagaaagatggaggaagacagtgggtggggaagaatgggtttgaaaaaggcaggcaaataggaaatgaagttatttttggtgatttttctaaggtagttggataataatctaaataaaggactcttattattttgggtctttgaattcataaaaagtaattttctctgtagatgctaattgagtgtggtaagatgtcttgttgcttgaaagttgtattttcgttgctctacctggagagcatataacagtgcttttatgtttcaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagtttacccagtgatgatttaataaaattatgaaaaatcaggagagggagataattagttgcttcctccttcacactgtttgaatcgaactcgcggtgacttttttttttttttaaaaacatgggttgtcacttaagtttggagtgcagtggcatgatcatcagtgagcgtgagatcactgtaacctcaaattctaggctgaagtaatctttctgcctcagtctcctgagtatctaggactacaggcccacacaacaatatctggctaatttttaaattattctgtagatacaggggtcatgctacgttttctagtctggtcttgaactgctggcctcaagcgatccattctcaccttggcctcccaaagtgctgggattacaggcatgaaccatcatacctggcctttttctaaggcatatgtatgtgatattcttggaactggtagcaggtgttcctattctgtaagtttgctttacaacaatacgaaaataagtgacaatttacaggttgaacaatttatttttgtaccaaaataaagaatggatctttagaactgtaaaacttcacccttttttcattgccaggctatataatattgacaaccggggaaagaggcattccaaagaaagtagaaattaagtatacacaatagattttccatccagttgtctcacaagaaattattctcttccttaccccctgtcatgttctgggcaacatcacacctcccttattcctctaactgggacccttgtgctgtggagctctggtgaatggtaagaggcagatggtctcacaggaagagtggctcttttctggtaggctgtggttcccattacacccaccaggattagcagcattaggcagagtcccatggacagccttaggtgggtcatggagggattatggtctgaagtaaccagcaacctaggaacatagaaggtaatatttggcatggaataatgcctagccttagtagataaagcggcattaccttttttttttttttttttttggagacaaggtcttggtctgttgcccaggctggagtgcagtggtgtgatcttggctcaccgtaatctccgcctcccaggctcaagcaattctcctgcctcaaccttccgaatagctgggactacaggcgcacgccgcaccaccacgtctggctaaggggctttacccttaaagatagagctcatgaagccccgcctcatccaagcattaagctaaacaggaaatcattaagagggactatcgaaccttaaagtagaaataagatcaagatctaagtcttctagcatcttatattattggaagaagacctaacttggcagcgagggaagtggcttaagggaagagtcagtctatgttctttaggtagctagacacaatccctaacagtgcttaagaaaggaagggggctgggagtggtggcagtggctcccagcactttgggaggcagaggccggtgggttgctttagctcaggagttggagacaagcctgggcaacatggtgaaactgtctctatcaaaaatacaaaaattagctggcatggtggtgtgcacctgtagtcccagctacttgggaggctgaggtgggggaatcacttgagcctagggaggtcgaggccacagtgagctgagatcaccccactgcattccagcctgggtgacagagcgagaccctgtctcaaaaaagaagaagaaaaaggtggggggaggggactaagatccctatgtcctagagatgggggaatgtgttattgtatgggaggagggagtcaggtagtgacgggactggatgatcgtgttagggatctttgttctctgaaacgcaaccctgtctaggacaatatacacgtgagtgagtgcttaataaatttaatttcaaacatccggactccatggatttgaaaggaaagtacttggaatatcttacttgctgggttgtgtggtaaagttggctcctccatgatacacttctaggggttttttctggagagtcagagtcagggccttgtgcagtgtagcaactgaa

SEQ ID NO: 16798 - DNA, 12797 bp, Human
tagttgcactgcaggggtgactgcaaaataatatatgctcagtaaacagacgcactccgcattttccacatcatccaagtgtgaaacacaaagatctcctgtttaattctattctgatgattgggcttggaaagggttgccaatttcagcattaaaaatacagcataggccaggcgcagtggttcacacctgtaatcccagcactttgggaggccggggcaagcggatcacctgaggtcaagagtttgagaccagcgtggccaatatggtgaaaccccatctctactaaaaatacaaaaattagccaggcgtgaggccgggcacggtggctcatgcctgtaatcccagcactttgggaggccgaggtgggtggatcacgaggtcaggagatcaagaccatcctggctaacaagcggatcacctgaggtcaagagtttgagaccagcgtggccaatatggtgaaaccccatctctactaaaaatacaaaaattagccaggcgtgaggccgggcacggtggctcatgcctgtaatcccagcactttgggaggccgaggtgggtggatcacgaggtcaggagatcaagaccatcctggctaacacggtgaaaccccgtctctactcacacacacacacacacacacacacacacacacacacacacaaattagcctgttgtggaggcaggcgcctgtaatcccagctactcgggaggctgaggcaggagaatcgcttgaacctgggaagcagaggttgcagtgagcagagatcgtgccactgtgttccagcctgggggacacagcaagacttggtctcaaaaaacaaacaaacaaacaaacaaaaacaatacagcatatgcagagtctgctgggggaaagatggggccgaactgggcatcagaggaaagtggaatttcggtgttgatagatgttgctgctagaatccaacaaggaaggccagagactgacttcatagaaccataaagcaggaggcaacatttcatacatatgcacacttcccggtttgttatagttcccaaaagatttgaaaaatgaaggtgggtggagggaggaagaggcaatgaaatatagtatgttcctgaataaaaggcatcatcttagcaagttgaagttagagaatctcttggtacatatttatgcagtctcaaccgtcctcccgtctctgagatggtaaattactactgacacttattcaggtctgaactgagaatctagtttgtggattaactggaccctttgctttttcttcttccatctgccttttaggcaattcattacttattcgaatttccaccagaaggtaggagtcaagagaacgaatattggatattaataaccggttactgttaaagaagggttgctgtatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaaggtgtggagccagcccccttgccaggctgagtactgaacgcccgcgacttgcctggcctcccagcctgaccggagtttgcggtggccttggccaccaacccaggcggaggctgggtcctctcgttcggaccgcagcagttttgctgtctcattggcccaggaggcccctgtctttgctctggttggaaagggtggcggtggggccgggggtaagtcgggggaggaaggtgaggcctcttgggttgattcctaggcgaccccaggttgctgctgttcaggatcttctagctgggaaaggccgcaacaacaatgaatcttggccgagggaaggctattgtaaacgtttaccaaagttttggaaactgggcggcccctcaaggcaggggtaactgaaactggcatgaaggggaagcgtggtgagggtaagcattgtactaagaatcagacatttggggttccttgcccagctctgcaataactagctctagattgagaaatcatttgatttcattgaacctgtttcctcatctataaaatgatttgttttttttttttttttgaaacagggcttttcgctgtcgctcaggctggagtgcagtggctccagcgcctcagcctccagagtagctgacactataggcacacaccaccacgacaggctaagtttttttactttttgtagagatggatctccctgtgttgcccaggctggtctccagcacctggcctcaagcggtcctcccgccttggtctcccaaaatgcctgggttacaggagtgagccaccacgcccatcctataaaatgaatttaatatgggttatatccatgtcaagggattgatgtgaagctcgggtgacattaatatatggtgaagtatagaagtatactgtgaagtataaaaggacggagaaagagatgtgctgggtttggattgatgcaaaaagaagtatgtaggagtgtttttgtggtcttatgtggcctgttttgtgttttcctctgatcttaacagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggtgagttaagctgcaaccacatgatccttgggctgacactacagtgaggaggggttggatggacagatgaattaaagggcttggtgtcaatgctgaagaagtgtaattaggtccttagcccttccttctctctttttttttttcctgtttttttagactgtgtctcattctgtcgctcaggctggagtgcagtggcatgatctcagctcactgcagcctccgcccccaggttcaggaattcaagaccagcctggccaacatggcgaaaccccatctctactaaaaatacaaaaattagcccggcgtggtggcgggcgcctgtaataccagctgctcaggaggctgaggcatgagaattgcttgaacccaggaggtggatgttgcagtgagcagagatcgcgccactgcactccagcctgggcgacagagtgagactctgtctcaaaaaaaagaatttaagaattcgttgtaaggccgggcgtggtggctcactcctgtaatcccagcactttgggaggctgagacagtggatcacgaggtcaggagatcgagaccatcctggctaacaaggtgaaaccccgtctctaccaaaaatacaaaaaattagccaggcgtggtggcaggcgcctgtagtcccagctactcaggaggctgaggcaggagaatagtgtgaacccaggaggcggagcttgcagtgagtcgagatggtgccactgcactccagcctgggcaacagagcgagactctgtctcaaaaaaaaaaacaaaaaaaagaattcgttgaatcccacatgtggcagtagtgctatttcaagtgttcattgaccatgtgtggcttgtggctactgtattggactctaatatatggttgtccctcaaaagttagtcatttctcttctgtttttttctttttttctttttttgagatgcaaagtttcactccgatcgtccagtctggcgtgtaatggcattgtttcagctcactacaacctctgcctcctgggttcaagtgattctcctgccgcagtctcccaagtacctgggattacaagcgcccaccagcatgcccagctaattttgtatttttagtagagatggggtttcaccatgttggccaggctggtctcgaaatcctgacctcaggtgattcacccgcctcagcctcccaaagtgccaggattaaaggcgtgagccgctgcacccggcctcttctctttttttctttagagagtctttggcctagaaggggccttttgggctcctctcttttttgagggggtggggatggagtctcgctctgtcgccccgactggagtgcagcggcgggatctcagctcactgcaatctctgcctcccaggttcaagtgattctcctgcctcaaccttccatgtagctgagactacaggcatatgccaccatgcgcgtctaatttttgtatttttagtagagacagggtttcaccatgttggccaggctggtcttgaactcctgacctcaggtgatctgcccacctcagcctgccaaagtgttgagattacaggagtgagccattgcgcctagtcctgggctcatttcttttatttctttgctggttataatcacccttacaatcatgctaggtccggttctatcatctctgaaaataagttccttagcctgtttttcctttccagcatttaagaaacttgccagacagttcaactttgtatttaatgtcatttcctcatcagccagttttgaattgcccgtttagtaaagttggagtatagctagtcaccttctaattttcccttccatatgcttaaaaataattattctttcctccttttgattttgcttcattcatttacctgcttactaaatacctagttatcttatagaacaattatagggtacctaccactttttcacttgctttcaaacgagaatagaaagggctgtagggagtatccacttactacccaatggaggatgaaaggaaattaaaaaccggatgtgagagaggagctcactttgttactttggaaattgagatgcttttctctgaaaggtgggaaaagacagttccatacattttacgtgatccagggaagcattttggaaatgttgctttgaacctttagctggcggatttgttctaggtgatggaaacagtgtaaaagagtacagggaccgggtaacaaggaaaatccagggagactgagcatcatttaaacagtgccttcttcaagaggccttcctgatgaccctgtcccattcattgtgagtcagccccttgcctcatattacagttggcccttgagcaacatgggtttgaatcactcaggtccacttatacgcaggtatttttcaacctaattctgattgaaaatacacattcccagaatttgaaacccaaatatacagaggaccaatttatttatttatttatttatttatttttgagatggagttttcctcttgtcacccatgctggagtgcaatggcgcgatctcagttcattgcaacctccacctcctgggttcaagtgatctcctgcctcagcctcccgagtagctgggattacagacacccgccaccctgccagctaacttttgtatttttagtagagacagggtttcaccatgttggccaggctggtcttaaactcctgacctcgggtgatccacctgcctcagcctcccaaagtgctgggtggcgtgagccaccatatctggccaacttttcatatatgcaggttctgcagggccaactttgggacttgagtgtgcatagattttggtatatgcaggggtcttgggacaaatccccttcatataccaaaggatgactagttaacccaaggctgaataagataaataacctttttttttttttattgagacggagtctcgctctgtcgcccaggctggagtgcagtggtgccatctctgctcactgcaagctccgcctcccggattcacgccattctcctgcctcagcctcccgagtagctgggactacaggtgcccgccaccacgcccggctaattttttgtatttttagtagagacggggtttcactgtgttagccaggatggtctcaatctcctgacctcatgatccacccgcctcggcctcccaaagtgctgggattgcaggcgtgagccacagctcctggcctgataaataccgtttttaaaagaaccagttggctgggcatggtggctcatgcctgtaatctcagcactttgggaggccgagatgggtggatcaccggagatcaggagttcgagaccagcctgaccaacatggtggaaccttgtctctactaaaaatacaaaattattgggaggccgaggcgggcggatcacgaggccaggagatcgagaccatcctggctaacacggtgaaaccccatctctactaaaaatacaaaaaattagctgggcgtggtggtggtcgcctgtagtcccagctacttgggaggctgaggcaggagaatggcgtgaacccaggaggtggagcttgcagtgagctgagatcgtgccactgcactccagactgggcaacagagcaagactccatctcaaaaaaaaaaaatacaaaattagccggctgtggtggcacatgcctgtaatcccagctactcagggagatgaggcaggagaatctcttgaaccctggaggtgcatgcctgtaatcccagctactcaggaggctgaggcaggagaatcaatcacttgaacctgggaggcagaggttgcagtaagctgagattgtgccattgcactccagcttgggaaacaagaaagaaactttgtctcaaaaatcagtcagtcaatcaataaataaaaagaaccagtcaaatgcggaaggagttttgaggaggaagagattacttatgatgggaggaattggggaagacttcatggattggtggtggttgtcctggatgtaaaaaagggaaagggaacataacaaagaaagggaggaaagaagcatgagcttttgaggagtaactgaaagtccagtttaattggaactaagtgggtgaaggggaatagtgagccataaagccagaagggtactttggaaccagatgatgacccccctctaggcaagagagcatggcactggggctgaggaggggccagagaaaggagtaaggtagacatcagaatcacctgaacctgaaaaccaataagggcagaggtgctcaagctggcttgcattaaaatcacctgggggacttaaaaaacaagttccatacctgtttcccaccccacaccagttataaaaaatacctagggtaagtcctgtgcatttttgaaaaaaatctttgttagatgactctagtgcacagtgagatgtgagaatcactgaaacaggaaaaagagtagtgatgctattggcagaatttcagaagacaggaggaagcgtgggtttgtggcgcacaagagagatgagtgtggtaggtaatggagaaccactggtatctaagtttaggaagtttgaatctgtacatgatgacaaagacatccagctggagggatccagtaggcagttgggattgaacactttgtctaaattttcatctgtaccaaaagtcagctagttttttcataaagggccaaatagtaaatattttaggtctgcaggcctaaatctttgtctcaaatacttaactctgccggtgttgcacaaaacaaccatagacagtatggaaacagtggctctgttccaataacattttaattacaaaaataaaggcagttggcctggccaaaccctggtctataccagcaatagaaatataatgtgagccatatatgtaattttacattttatactagctacgcttttaaaattaaaaaaaattaatttcaatatattttgtttaacctaataaatccaaaatattatgttagcaggtagtactagttcatttcaaatgctcaactagtcctatgtggctagtggctaccatatggacagtgcaggtctttacaatgtgattacaaactctaggctttattatcctcctgtgtaaagtatgtcttgttctccagatagtctaaactctttgagttctggcattatggagtttgtttttctgtcacacaggctgcagtgcagtggcataatcacagctcactgtagcctcaacctcctgggctcaagtgactgggattatggggtcttttgatgggggagtggggattatgttttgtttgtttgtttgttttttgagacagagtttcactcttgttgcccaggctggagtgcagtggtgcgatctcggctcactgcaaactccacctcccaggttcaagtgattctcctgcctccgcctcctgagtagctgggattacaggcatgcgccaccacgcctggctaattttgtatttttagtagagacagggtttctccatgttggtcaggcttgtcttgaactcctgacctcaggtgacccacctgcctcggcctcccaaagtgctgggattacgggtttgagccactgcgcctggccggggattatgttttaaatgttatctttcacagtgtctgaagttctgtgcttgaaacctaagtcatttggaatgtacttgttttgtgggtgtgctgagaggatcggcaacatggcaaggtagttattataatataaggtgagatggggtggtatgttgtagaatcctggagtcttaatattaaattttattccttcaggttttttttttttcctgaagacagcatctcagtctgttgcccaagctggagtgtggtggtgtgattatagcttactgcagcctgcaagtcctgagctcaaacaatcctcctgtttcaacctcccacagacatgcaccaccacactcagctagcttttaaaaaaataataataattttatagaagtcctatcttgtatttatgttggcttccctgggtttctcttttatatatatatatattattttatttatttattattattattattattttttttttttttgagacaaagtcttgctctgtctcccaggctggagtgcagtggcgcgatctcggctcaccgcaagctccgcctcccgggtttacgccattctcctgcctcagcctcctgagtagctgggactgcaggcgaccgcaaccacacctggctaattttttgttttttagtagagacggggtttcaccgtgttagccaggatgatctcgatctcctgacctcgtgatccacccgcctcggcctcccaaagtgctgggattacaggcgttagccaccgcgcctggcctatttattatattattttgagacagggtttaactcttgttgcccaggctggagtgcaatggcgcgatcttggcttaccgcaacctttgcctcccaggttcaagtgattctcctgcatcagcctcctgagtagctgggattataggcatgtgccaccacgcctggcaaattttgtatttttagtagagatggggtttcttcatgttggtcaggctggtctcaaacgcctgacctcaggtgatctgcccacctcagcctcccaaagtgctgggataacaggcatgagccaccgcgcccggcctatttttttatttttttaaattttattctaggttttaagagaactactgctggccgggcgaggtgctcacgcctgtaatcccagcactttgggagtccgagaagggcagatccccagaggtcaggagttcaagaccagcctgaccaacatggtgaaaccccgtctctactaaaaatacaaaaattagctgggcgtggttacgagcgcttgtaatcctagctacctgggaaactgaggcaggagaatcactttaacccaggaggcggaggttgtggtgagccgagattgcgccattgcactctagcttgggcaacaagagcaaaactccatctcaaaaaaaaagaactactgccttggcatatgaattagatatcaaaaggggtgatctttttttttttcctgctaacctcatctccctttccaggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaatctcagcctgtgttgcatcttttgtccacactgtccctcctccaagcacttttcagtcaaataagccaggacagtggaagggaagtgactgtaattacaggaaacagtggtgtgaagacattgtctagtgaatacattaatgtccccactcatgaagctaataacggagaaggagagagaggcagggaggagggagacacttctcgatttggtttacaaagagatgaaaagttgatgaggtggaaagatgcacagggctgtaccaggcagggctccagcggaaaaggctgtcaccctgtggtgggggaagggaggctgaggctacatgcagagcggaagggtgaagagggtaaatcttgactcttaaaccaactgggaagggaaggcttggaccctgggaaggggaggacaaagaagtggctgtgaaagcagtagtaaccacaagcttggtgacccttgtccttttggtcctccagtgcatatgtgtggaggggagagggtagtgatggtgattttatagcctcctggtcaggaagcagcactaaattgtcactggaatgtgtgggtggggaagaggccctgctgagagcagagagatggctgatttatcacacccagcactgttggggctggggggagttcccaagctatggtggcagcagatggcaaggccttctgttaaagagaagacaggggatagaggaggttgatgggagaaacctttaaaaaatgggagcggaggacacaaacaataccaccttgtatttagtcagaaggcagaaagtggttggtgaaggtgacaacccagtgtcatgttttgagactgagaggtttggagaagtcattcacagaagaagagggggtaaaccctcctctcctgtactgcagctaccttcccttccccctcagccttgtgcagtctttgtattgattgatgagggctgtcggccaggaactgatcgaggcttgttaattgcatttgtcaaatgcagggaaattgggaattagtgaaatcggagaagggggtttggaaaacaaatgactcgtgcctaaggaaattttttgcaggaaagtatctcaggagcccctgcagtcagggagctgctggtgtggactcagactacatggttgaaataggcaggagctgggcggggcacagtggctcaggcttgtaatcccagcaccagcactttgggagacggaggcaggcagatcacttgatgccaggagtttgagaccagtctggccaacatggtgaaacctgtctctactaaaaatacgaaaaattagctgggtgtggtggcaggcacctgtaatcccagctacttgggaggctgaggcagaggttgcagtgagccgagatggtgccattgcactccagcctgggcaacaaaagcaaaactccatctaaaaaaaaaaagaaagaaagaaataggcaggacccaagctacatcttccttctcgtagactgttgggaaatggttagctgcgtgagaagcacaggtaggtcatcttcctcccacttaggacattggtttgcagatcttaaaaaaaaaaaagaaaaaaaaaaaagcactcttaggagaaatcccaatgcctgaaaaaaaaatcagaggttgaaattgagctgagaggtccagagcctccactattgagcttccccatccagccactccccgcagcaccctttgttagccccatacacatacacagtccctggcacttcttggaacctcaaggaacacaatttgaacacctcttccctgg

SEQ ID NO: 16799 - DNA, 5199 bp, Human
ctgttattgctgcagaaaagaccttgcttctccagtgaccataagggaagatggtaatacagaggcttggattggaggtagaagcaaagggagctagcagaataggagaattaggttgcctctttctggcctttggttggggcactctttaaaaaagtgccagatccaagagcccagggggctggctgtgagtgccctcatgtggatcagctatggtcagactgcttcacgcctgtgacctgccctgtataaatatactgccatgtataaataatggccccatatatatgtaatctggaaggataaacatcaagcttaacactggcaacctgcagggagggaagtggaattgggtgtgtatgtgtgtgtgtgtttgagaacctgtattttattactccgcacgtctttattgtttgatttttttcataatgagaatgagtttgtgtgttgggtaaaaaaaagaaaaagaaaaaaaccccactaaaatcaatctaattacaaaagaagatgaattaaagaaaagtactgagagaaactgcttgtgatccaagtcctggctccctaatgcctggctgaagcccagcccacaaagagaacactgggttaaaggtcctggagaaaagatgggaaaggtttggtgtctatgtggtgtctgctagccccataagggtaaggcacctggtagacggttcccagcttaatgggaactgctcctgttttccaggcacacagttcagggctggaaaagttcaacaagtgcatggaacatcggaaacctcctgaaaatgctaaatttgccccgagatgtcccgaagtccggcatatttctctgggcagcctagaggctcaggagcccagcccagcccagcccaccgtgccctctcagccagcccttctttgccttcagcagccctccctcttcctgagtagtggccctttgcaggcctgcgtcccagccccgcccctctctctggacgcatctctgggccccatcatcacccggcgccgggccctccctctgcccccccctttctcctccctccttccttccctcccttcctccctctctccctccctcccagctcctgcaccaggaaacggcccggatcccggcagcggcctgacccgtgagatccctaacctggcaggcgggcggggttggagactggctgaggtgggggtaagggaggagctgggcctttgggctgcactagggggaaccgggaatagagatggtgtcggcaggaagcccttggccttgggtttcccgggaggacagtcattaaacatggattcggccacacagctggtagagcgttgggggcaggggcctaggcccagagctgcaaccctagcccttcccaggccagaacctgatccctggccttcccctcctggttctgatctccccctcccctttccagggctccacgctggccaggaggatgaaaggccccagctgggggctccttgccaccagtgctgtgtcttaagagctgccatcccggctgggtgagtgtctccttcctttctctgtctggagtaacccattgcgtctcccacctttctcttcagcccatctgctccccctcatcttgtgtctctgccaacatctttacatcttgcatttggggaggtcctaagacccttcctctagccaagaaggtgtggactaaggagacccgggggtgggggtgttgtaggggtgtcattgagctgacgttgtcttattgtgaaaagaatctaaagtatcctaaacagaaaatttacttgttttacatttaatttggcatattaggaatgtaatggccagccactcacagcctagtctcatatcatgacttaattcccttgttcttgcctctccctgtccagtgagtcctgagcatttcctctctcctcctcatctcactgggttggtcaaaccagaagtgctccttctgattctctcttcatatattcatgccagtctttcatccttgcctcttatagccgcccggatggcgaccccagcctcggccccagacacacgggctctggtggcagactttgtaggttataagctgaggcagaagggttatgtctgtggagctggccccggggagggcccagcagctgacccactgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcggctggctgactggatccacagcagtgggggctgggtaagaagcttctcaattgccgctctgcacatccttctgcaaagctggtctccagggggaagatgggggctctgattggaggctgaggcagctatgttgggaatgaggtacggggctgagtctccccgtctggatggaattagattgagagatgcctggactctgcactccagggctgccatgcagtcaacactggatgggctcatggtcccaagcagaggacagaatacacacccaaggagtgcctgcaggggaatgttgtcagggactttttacatctgagtcatggcgtgggaggtggggaggaccagggatgggtggtggtcaggcaagccttggcaaaggatgctagttctgagcagaatttttcgccaaggaaaggatggaattcactggaggcagagtgggcagatgaaccagtctctcagggtgggggtgcacctggggggatcagaggggcttgcagggagaagagctttggccagagaggagctgggtatggggtagtgctcgcagtggatggaactggaactcttcctctcctcttctctccactctttcctctcctgatatccctttctccttctttctctcctgcttcccttctctcccacaggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtggtgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcagcttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttcctt
